United States Patent 11,549,145 (METHODS AND COMPOSITIONS FOR INHIBITING AND TREATING NEUROLOGICAL CONDITIONS) - sequence listing, part 59

SEQ ID NO: 1371 - DNA, 1070022 bp, Homo sapiens
gcggccgcccctccccgattcccgccacctgccgcctggccaggtggaaggggcgctgccgcgagcctccgggcctcagggtgttccggggagcggcgccccgggtctctgggcccacccgccccgggcgtcctccgagagtgggggctgcgcccgcggggtcagacacctgttcggcccggcccggcgtggtcgccgggggccaggatgaaagtgaccgtgtgcttcggcaggacgggcatcgtggtgccctgcaaggagggccagctgcgcgtcggcgagctcacccagcaggcgctgcagcggtacctgaagacccgggagaaggtgagcgcggcgcggaggagtggggcgcggctgcagccaaggcacctgccaggtgcgacccggtggcgacactcaggggatgcagaaaacccaggggattatggggcactgcctgtagctgcagctgttgtctattgctaatatcagtgatgtgggtgtctttgggtgtttgtgggccttgagctccgagggtcgtgagtggacctgcagcattggaatctcttgggagcttcttagaactgcccaatatgggcagttctccaaacccaccgactcaggatctgctctttaacgagatccccaggtgattggaatgcccactgaagtttgagaaccactggtttagaacttgtttgagggaacgtcttaaaaggtgctgctcacctaagtgtgatttttgacccattaaggcccgcctcacttaggctccttggagttagaaagttgattgtgcaagtgacacatactcggaagttacaactgatggggcctttggagtttcagccttgtgagctgccctgtctcagtgacttgggcaggaacacaggtgggagcatgctgtttgcttagccaacctgtctacattttgagtgttttcagtttaatgtcacagattctatgaccatttactatgtgtgtgggctgttgtcaggtcctgagtgactattaaaatgagaaagacgttcctagctctgtagctgaagtcaggaacaagtataaattaagtgacaattttttttaagtgtgcaatacatgttgagaaaatatctggcactagaacttatgccaagtatttgggtaacattgggcctctgggacttcctcagtgaaacttttaaaggaaggcattgaataaccttttaattttttgaatcttcacatggaacattttgtatgtcccaaatgctcctcaaacagggcaagtcacaaattcttgttttagcggccaatggttctcttaatatttggtctcgtgccatgtgactaaaatagtgggttggtcaatctagtgatggaaaaacgtaagttttaatttcttttaacttcttatcggttatccaaagcataaaagtaattgtttcttacaagtgtatagcttaggggtttaagaaaatacttgcaccttctttgcctccatgaagaattattatacagaaaaaaaattcagctctggacagatacatgtgcatattgctttggatactcaagaactggaggagagtacaatgaaaggtctattaatatattaaatataacccctaaagatgaactctttactgatggaattgaggtggaggagggaaaaaattaaagtggtttataaagctgtgtgaaaatcaactgcaatgttatgtgtgtgtgtgcacgtgcatatgtgtttgccattgttaaaatagtgtttgctgtttaaatcatgtaattcagttaactgatgtttaaacaagtaaccaattgtctattaaatcatatttcactaacttttgaaagtgagctaagattaatagtaacaacattactccagacagattattgaaatagatctcattgagggattgtcttaccaaattgaagttactttttaactattaaataatttatgccctcaaatcttgtatatttagaagtttagtacagggggctatccaagtaagagataaactacaagcttgtaaataacatgaagagaactaaccagctgatatttaattcactataatttgatcttaaaaggtgttaaaatattgacattctggaatggaaacgtaacttataatatcacagaacaatgtagttgcattgatcagtttactattattaccagacttatatttttctgtttacatttatatattagtgaatgtgacatttaaaggtcacctgcagcatataaatccttcctcttattttcacttttaaaatttcattttaagaagtagtaggtgatgatttttcccctccccaagtattcttctcccatagttttattttaaataatattgtaatcataacaagatttaacgaatattaaatcgtattcataatggcactaaaaggtcaataaataccctaacaaattccatgcttttattcattttttttaaatgagaaaaggccagaaatgtcaaaattcaatttgaaaaacaatgtgtagtaaattcactttctgtaaatcagtgaatttctgcacttcgtaataataatcacactaacatgtaacatgtattgtgcttattctgtgcaggccctgttttaggaacttcatgcttatgacttatttctcccaacaaccttaggagataggtactattattatccccattttacaaatcaggggaaaaagagacacagagacatgacaagtaagtcgtagatttgggtttagaaaccaggaactgtgtctttagatgtttgctctcagccattaactgcatagcctagtactatgtatgttgttatgaattggaatttatccatattgtttgttttttaatgcttgatttaaaaagacatttccatctactaactgctatatcacatcaacctaaaaatagcaattttgcttctggaatagtgatgggatatccacaagtttctcttaattatatattttatgaggtctacatgtagaaaatctagtttctgaggcaaatattgtaggatttgcaaatcaactatgaaaaatattcctcagtctaactacaaatgggaaaatgggcaagatcttagacatccaggtggcgagtgctataaagaaccaaatttggtgggaacatgaatgtaaagtaagtccattattttctgaggcactgagtaatgtagatgggagaaagacaggtttcaagattgaggatgaagttgaggtttctaaagtttggaaagtaagtgaagtccaagaatgccattctatatttcgtggacagcgtctgagaagtaaccactacctgttgagaacaaagaaaacctatttgtggaatgttgggaaccccctgaatcaacatcagataaggccagaggttgatgcgatcctgaagatacagggggagcttttgggaaggctttaattatgctctgaagtctgggcctttgaggttcctgccaccatttgatgaactccattggaaacgtggtggactgagaggtgagaactgtgggattgcttatctccgaatcctgacactttatcagtgtcccagcctccaaatccaatttagtgaagttgttagtggagaagtgattgtcttcttatgtgcttatggtggggatcgttgagtaattagttaaatttatcatcaaaattatgtgtcacaggtgaatgggtaattgagctgtatcctgcagggactctcaaccctggctgaacttcagtaacctctaattttcacattaaacattttaaacattacaaatacctgtgtcccttcccccaagattctcattcattgggttaggagtgggtcctgggcataggtattttaaaaagcactccaggtgattctaatgcccagccaaggttgagaatcactaatctactctaatcttttcgtatggctgaactcattggattttaaactcttttgatggcagatactgtgtcttagatatctacacaccaatctgttattaagcaacagaataagcacaatacatgttatttgttaatgggattattattatgaagtgcagggcttaaaaccttgctgtctagggattcaaaccttttaagtgtctttcactgatttacagaaagtgaatttattacacattgtttttcaaaatgaattttgacatttctggccttttctcattaaaaaaaaacaaacaaataaaagcatggaatttgttagagtatttattgaccttttagtgccattaggaatactcctactcctacccttaaagaattcttcctatagaaggtgctcaaataattgcttaaagtgaacattcattttatatagacagttgtcccttagtatccataggggattgattccaggacttccctcggataccaaaatctgcagatgctcaagttcctgatataaaatgctgcagtgtttgcatgtaatctacacacatcctcctgtatactttaagtcatctctagattatttataatacctaatacaatgtaaaagctatttaaacagttgttatactatactgtttagggaatagtgacaagaaaattgtgtgtgtgtgttcagtacacgtagttttttttctaaatatttttgatctggggtttggttgaatccgcagatgcggaatgcatggatgcggagggctgactgtgtgtgtgtgtgtgtgtgtgtgtgtgtgtgtgtgtattcactgaggatgaagtgaataagggaaaggcttgtctagtaatgaggatgtatagtgtgttctggggttggaatgaatgagaaataagagcattgaattcgtggaatagcaggcatgctggaatttacaaaggccaatttgtggctctgactgcgtatgtgagtacacccttttttggaaaggaaaaattatatttgatagggttttcaagatgaatcttttctgtattcagatattttgaataatatgtttgttttacaagttgaggcagcttcccagaactgggagtagtctgattagactaacaattccattccctgattaactgtgggatcggaatctaagagaatttgtgtagttagaagaatctggtatgataatgtgtgggagtagcctggaggaataggctagaactcttgaatttctaaacttttcaggctttgatgccttgttacctaaatagattttaaggttcttgtatacataagctaggcccagactggattcctcaaatgcttttcaattgattgggcactgacttacttgagtgctttatttcctattcagacctcacttctttacagcatgtggacagaactgactcgccatcagcattacacatgcttccaacttggttttggttctgctactcagcttgcattgagcagcttctaagtttgcaaacagagggctcgtggggcctgctgtgacccacagacatatttttgtaggtctgctcagtgttatattttgacttagttgtcagcatttaaatattttgagatttcatgcaaaactccagattcctatcttctttgggggaaaagcaaattggaagctctgacaatgctgggctttactttcccacatagcaaccatcagttggagctgagacacctctgctctctttagaaagaattattaatgcttcagtctccattattgcttccctaacagtgaggataagttattgtcatcatgcttgactgtttttactctgtgcttattttctcacttatggccttaattcatggttgctatttggcctgctggtgggcatttgagtttgtgctcctggatcttctctcccctccctcctctttctctttctctccctctcacacacacatccccacacaccctctgtgtataatccatgcacatagggtttgctgaaccgggtttggctggttatctgagctgagttaattgccctgtgcgcgattgggagccacagccctgatttgtagcttgaggccctgtgcttaatcaagtggcttagttaaccaggaattcattcccagggtattctgtgctacagattccctttgaagaagttgggcaaatggtaatgttgtcagatttttgtgagactattttatgagtggactgttaaagacatctgaggagtgtgttaaacattcagagctttgggcctctcttggaaaatctaaagcagtgtagtgcagtagaactttctgggatgaagagatgttctagatctgcatctttcaagagggcagccactagacatatgtggttgttaagtagttgaaatgtgcctagtgcaactgaggaactgaattttaaattttaatttaaatgtaaatcgccacaaatggcttgccttagtggacagttcagatccaatgctcttctgatgggttctgtcagctgcttttggaaaccactggcttaaagaccagatcccaggcagtccttaacttgacattgctactcagttctgttgagaactttgccatcagaaagggatcttcagccactctttggtatccacaggtggtagagagagcctttaaaccttaaatgctccacctagacactagcacaaaaactagctgggtttgagagtaagcccaggttggcctcagtttacacctttggtgcaacaggctgaggatgtacatcctctgtctctggtactgggtggagagtgggccaagaaggagcagtgaacaaaaatctgggccatttttagtgagatttagatgcttctcgactgatagaaatactaaacaccttcagttcaattaagtcccagctatttatctttgcttttattgcatttgcttttgggttcttggtcatgaaatccttgcctaagccaatgtctagaagggtttttccaatgttatcttacagaatgttgtagtttcaggtcttagatttaaatccttgatccactttgagttgatttttgtgtaaggttgagaggtgaggatccagcttcattctcctacatgtggcttgccaattatcgcagcaccatttgttgaatagggtgtcctttccccacttaatgttttcgtttgctttgttgaaaatcagttgactgtaagtatttgggtttatttttgggttctctatttctgttccaatggtctatgggcctatttttatactagtaccgtgctgtttggtgactatggtcttatagtatagtttgaaatgagagcttttccatggcaaaaggaacagtcagcagtgtaaacagacaacccacagagtgggagaaaatctttgcaatctatacatctgacaaaggactaatatccagaatctacaatgaactcaaacaaattagcaagaaaaaaaccaaacaatcccatcaaaaagagggccaaggacatgaatagacaattctcaaaagaagatatagaaatggccaacaaacaagaaaaaaatgctcaacatcactaatgatcagggaagtgcaactcaaaatcacaatgtgataccacctcactcctgcaagaatggccatcatcaaaaaattttaaaaaaataggtgttggtgtggatgtggtgaacagtgaacacttctggttggaatgtaaactagtacaaccactatgaaaaatagtgtggaggttccttaaagaactaaaagtagaactaccatttgatccggcaatcccactactgggtatctacctagaggaaaataagtcattatatgaaaaagatacttgcacatgcatgtttagcagcacactttgcaactgcaaaagcgtggaaccaacccaaatgcccaccagtcaacgagtgggtaaagaatctgtggggtgtgtgtgtgtgtgtgtgtgtgtatatatatatatgtatatataaggctatatacatatatatgtatatatatggctatatacatatatatggatatatatttatatatatccatatatatatatatatatatatatatatatatatatatatatatacacacatatatataaaggaatacacctcagccattaaaagagagactgaattaatggcatttgcagcaacctggatgagattggagactattacggcaagtgaagtaactcaggaatggaaacccaaacattgtatgttctcactcataagtgggagttctcactgacacaaaggacttcagggactcagggagaaagggtgggaagggcatgagggataaaagaccacaaactgggtgccgtgcatactgctcaggtgatggatgcaccaaaatctcacaaatcaccactaaagaacttagtcatgtaatgaatcaccacctgttccccaataatttatggaaataaaaaaattttaaaaatactaaacatcttaagcacatgcttcctggaacctacactctcctgacttttttcctatctattgtccattctcaggctctttggttgttccttctttcctcctctacgtcttagcactacagtaccccaggactcaattcttaagtctccacctgtctctctctgcttacagtaatgtggttccaaataccactggggtagttccagcccaggtgtcttccctgaactgccagctctatatacggctttcttgaccctttgcctggacatctggtaggcatcttacacttatagcatgcccccaaatgaattcctaatccccaactccaaatcaagtcctcctacaatctaagcatgtcattaaatggcaaggccatctttctagctgttcaccagaaatgcttgtcatcacccttgaccaatgtttttctctcatgatccacatacagtcattctgcaaatctggttgactctgctctcatactagatttggaatctgactacttttcagtctctttcctgttagtatactggagcttgatttttattatttttttctttaaatagactttagtgtctccatttctgcccccgagactcccacattactgtctctccttaacacaaaagctagagtgataatttaaaattataatcaggtcatgtcattcttctactgaagatcttccaatggtgcacatctctcctaaatggccttggaagtgctacatgatctgactatctgtgcagaaaaagttaatgtagcaggcctgagactgctatccttagaaagccctgcttgcgaagcggggccttggctggtggcatctggaaagttagatttgtggagggctaccatcattcccttatcggaatggctcactgtgcaaaactgtttctgcaaacaatatggcttatgctgaacacctgctctttttctgggagtctggaatttttgtatatgctaagcagaaggtgcctatgtgatcagtctgcagtaaaaaccttgggtgcttagtcactaatgagtgttcctggtaggcaacatttcgcacatgtggtaagaactcactgctgggggaattaagcaagtcctctccactaagggaagacccttggaagcttgtgcctggtttcctgcagacttcgctctgaatgccagtttgttttgctgatttggctttgtatcttttcactaataaattatatccatgaagggcctggtacggtggctcacacctgtaatcctagcactttgggggctgaggtgggcgaatcacctgagctcaggagttcaagaccagcctgggcaacatggtgaaaccccgtctctactaaaaatacaaaaattagccagacgtggtggcacacacctgtaatcccagctacttgagaggccgaggcaggagaattgcatgaacctgggaggtggagattgcagtgagctgagagtgcatcactgcactccagcctgggcaacagagcaagatgccgtcttaaaaaaaatttatatccatgagtatgagtatatgctgagttccttgagatctcttggtgaatcatcgaacctggaaggtcttgaggactccagcaccctatatttgacctctctgacctcatcatctaccacacagctgtctgttctcctgtctcagtcacactgatcgcttgtcatgttattcaagcatgccagacagactcttacctagtgccgttttctctcttcctaaaatattttctctcagttatccacctatctgcttctttcatagtttccatcttaaataattgttttcttcttcaggaagccttcctaaccaccctatttatgattataaccttctgagaaccctttctattgcccttccctgatttacttctatctacagaccatattcttcctaccataccacttattttaactgtatttcttgtctccatcactagaatattaacttcaataaaggtagagatatttgtctcttttgttcatttctgaacccttagattctagaagagcaccaggtcatagtagggcatcagtaagttcttttcaaagaaataattattttaccatgcatccatcaccacctgttgcagctatctcttgttgtattacaaactatcaccaaaatgtagtagctgaaaataccactcaacaacatgattgtgtaggtcaggaatttggaccaagcacatgggggaagtctctgtgtgatgttttctaggtctgggatgctcaagatggcatcttcactcacatgtctagtgcctcagctagaatggctctactagctgtgaagataaagcagccactctcgggttttgatgagtttcatggcctcctggatgataaggcacacacgtgaataagccagttttgctttagtggtatgtttgcagggatacaatatagacaaataatgccctttgaaagagaagacactaaagccgttttgaaagatgatgaagaattttccacgagaaaagtgagataagacattctaggtggagggaaaaaagtggttgagggagttgtgaaaagttgagcgtagcctggagaggagtgggtgcacacactaatttggaccagatgctgatggtccttgggtgctgccctaagggattttcatgctgtcttaatgtagctctccattttgttacgaatatactcacattttgcttaatttgcatgagtttaaaaatatgtgtataaacttaaaatggagcattttcagaaaattggggaataaattacctaactttgtagtatgtctgttaaggcctcatcacttggttggttatgctggttttcacacattcccctgcaaaactgttttcaacaaaattatcaagatctagtagctaaaggccatggttaccttttacttcttgtttttgatgatgtcccaccttttaaaactctctactcatgggcttttcaggatttttttttttttgagacagagtctcacccaggggcttttcaggattcttaaacatctgtcttctttgagtcttcacagatgccctctctgccatcttcttgtatgttggtacactggggttctggcctcgtcctccatgggatctcattcaccacatggcttcacctacccgtaaatacacacttctagccctgaacttgctccagatcccaatatctgcctgcctctggacttcattacctggatgtcccacagacaattcaagcccactctattctctgtgaatctgcttgccccattccttgtagcctgttactgcgcacatggcaccatcattcacttggttgtctaatctagaaacctggatatccttcacacctccctcatattccaccacatgtccagtcgctcagaaatttcctttgatgctttgaagttatctctcttggatctgcttcctccttatcgtctctacatcccaagaacagagagtgagtcttctttattttcttatctctgtttttagcacagtatttgatatatagtgtagatactataaatgcttgctaaactttgtcaaattccacatttttaaaataaaaatgagaatgagcttgtagtcaacatggcgtttgtaagtttggagtctatatatggtagatatacatatttttaaatctaagtgcaacttttctcttgattatcttgaaatgccttatcatctccacatttgctgtaggcagtagtttagtggtccattatatctgccacactgattgtcttaaataacagtttcaaattctgacaggttgacttgcttcttagatttttcagactgagtgctctgtagttatggattttccatgaagcaacataatgtttttgcttcatgcaggtttgtgtgatgcagtctcttgtgtttgaataatgtttgattttcagcattcattaatttcatgttgattttaaaattatctggactacctcaattttgatggattctttatttttgacaggcatgatatctctgtcttaggagctactaaattgagcctgcctcctgttgctgaactctcgttttttggattgcaatgtggtggaattgcaggatatcaagacaggccggttaaaaaggttttctctcagtttagtctctatcagatgcagtgccaagtatcttccagataaatatgtcctgcattgctcttgtccgctgcctcaagttgaggatgttaaactctctgagttgtccctgtttgcagatgacatgattgtgtatttagaaaaccccattgtctcagctcaaaatctccataagctgataagcaacttcagcaaagtctcaggatacaaaatcagtgtgcaaaaatcataagcattcctatacaccaataacagacaaacagccaaatcatgagtgaactcccattcacaattgctaaaaagggaatataatacctaggaatcccacttacaagggatgtgaaggacctcttcaaggagaattacaaaacactgctcgacaaaataaaagaggacacaaacaagtggaagaacattccatgctcatggataggaagaatcaatatcgtgaaaatggccatattgcccaaggtaatttatagattcagtgccatccccatcaagctaccaatgactttcttcacagaactggaaaaaactactttaaagttcatgtggaaccaaaaagagcccttattgccaagtcaatcctaagcataaagaacaaagctggaggcatcatgctacctgacttcaaactatactacaaggctacagtaaccaaaacagtatggtaccggtaccaaaacagagatatagaccaatggaacggaacagaggcctcagaaataacaacacacatctataaccatctgatctttgacaaacctgacaaaaacaagaaatggggaaaggattccctatttaataaatggtgctgggaaaacaggctagtcagatatagaaagctgaaactggatcccttccttacaccttatacaaaaattaattcaagatggattaaagacttaaatgttagacctaaaaccatgaaaaccgtagaagaaaacctaggcaataccattcaggacataggcatgggcaaggacttcatgactaaaacaccaaaagcaatggcaacacaagccaaaattgacaaatgggatctaattaaactaaagagcttctgcacagcaaaagaaactaccatcagaatgaacaggcaacttacagaatgggagaaaatttttgaaatctacccatctgacaaagggctaatatccagaatctacaaagaacttaaacaaatttacaagaaaaaaacaaccccatcacaaagtgggcaaaggttatgaacagacacctctcaaaagaagacatttatgcagccaacagacacatgaaataatgcttgtcatcactgatcatcagagaaatgcaaattaaaaccacagtgagataccatctcacaccagttagaatggcatcattaaaaagtcaggaaacaacagatgctggagaggatgtggagaaataggaatgctattatgctgttggttggaatgtaaactaattaaaccattttggaagacagtgtggcaattcctcaaggatctagagctagaaatatcatttgacccagcagtcccattactgggtatatacccaaaggattataaatcatgctgctataaagacacatgcacacatatgtttatggcagcactattcacaatagcaaagacttgcaaccaacccaaatgtccatcaatgatagactgggttaagaagatgtagcacatatataccatggaatactatgcagctgtaaaaaagggtgagttcctattctttgcagggacatgaatgaagctggaaaccatcattctgagcaaactatcacaaagacagaaaaccaaacactccaggttctcactcataggtggaaactgaacaatgagaacacttggacacagggtggggaacatcaaacactggggcctgttgtggggtggggggtctggggagggatagcattgggagaaatacctaatgtaaatgacaggttgatggttgcagcagaccagcatggcatatgtatacctatgtaatgagcctgcatgttgtgcacatgtaccctagaacttaaaagtataatagtaaaatgtgccatgtaatcagtgaggtctcagtcagacttccaattaggggatcctgtgtgatgattgcctgtaacaatctgatcatctaaaagtcactttagtcacatggaggaagatttagacagtgactttgggtcagtattgtgttttttgctgaggatatagagtaaaataagacacagcttctgccaccagtgggcttatagatttaacaggcatagaggagcatggcaacaaatggcatggtatgatcaaggtgctttggggcaaggggaggtggggaagttgagcaggtttcactccatgagctgtacgtggccaggggtttgaaggatgcatggacagttgccagggaagtaggagtggaagatggggcaggacatgagggaggggtgggggcagcctaccgctgtttgaaggtaaacatgtatgttttgtttgaaggaggaggttggggagaagaggatagaattgtgggaagtttctccaggacagttgtgggacgggtagtagggaaggagtaagggtcaaagccagagttaaggaagcatttggggcaggatggagatattgttggacctaccttttttattgattgcgctagagagtggagatagagggagctgggactggaggtggaggaactggctcaggtcctgctgttggagtggaggttagatgtattgaagcagaagcagaaatgagctttgaggtttagggggcaaagtaattaggcttgggggttgactctcagtgggaagagaagtgtaggtggaactggggagagggcgcagtctctgagacatttcagtgaatatgcctgtgttctggccacccaggctggggttccgagataactaagacatggcctttgctttacagaacctgatagatagggataggagaggtgggagactgagaacagatgaaagggttggtgagcagtgtgagggcctggagcaatcagaaatcctgagttcgtaaagatgccaatcttttgcaccagttgttcagcattggattagagccttgattcaaggttgggattagagggcaggtgtgggaacaacctggtgctcagaaataaaagttgttaggctcagttaatgaaagtataaattgatatgggtggcttttagactttggtagtcacagtggctggaaatcttcctttgttcctccggacccgctcttgtcccttttccagtcccctctgtgacccaggaggctgagctgagtggactttcttgccctctggcttctagttagggtcggccattggggaagccccagtgagagaacaagagggtgggcagctccattcctgccaggtcactgtgggctggctgcttccctttcctaaagtccacagctctagccctatgtactcatctcccttgtattttttttttttttttttgagatggagttttgctcttgtcacccaggttggagtacagtggtgcgatcttggctcactgcaacctccgcctccagggttcaagtgattctcctgcctcagcctcccgagtagctgggattacaggtgcacgctaccacgcccggctaactttttgtatttttagtagagacggggtgttgccatgttgggcaggctggtcttgaactcctgacctcaggtgatccaccagcctcgggctcccaaagtgctgagattacaggcgtgagtcaccgcgcccggccatctcccctgtattaaggtcactcctttacctggcctgttgggtctcaaacaatggcaagggattgccgctgttaggaccattgtcccttgatggtttactgccaaagtttggactaataaagacagaaatatttgcctgcatgactcagtatctacatacacacacacatacaacaaacccccgtgccccacccccagcctgaaacaaaagtttcaggagagtacttacctttgctgtgaatgatgccctcagatttctaaattctattttgtttcactgaaaaagtagttggggtgtgctaaattgatttcactaatgggttagggcccatagtaaaaaaaccactggagcttcctgatgtttatggacacaggatggaccatcagatcaagtgactcagaaatcctcacagcgctaagatctgattgcttatagatttatccaaagtgtgaggctgaagttaagcttctaaaatgaacttaaactcctaaaatcaaatgacattgtaggtgttaataggtgaatttttctgtggattataatgccacgtaccttatatgtgtaatagagataatttttggatcttgagacttgtgtatggctagtgtgtgagctaagagtcatcctggcccagaagtcgctgtggctttataaaatcttcgagaaactgaaagagttttacttgtcatcttgtttttcttttgtcatgacatggtgatagtattggtaactttaaatattaggtctggattacttccttttgtagcaaagagatgaggaagtgtaagatggataaataatccttgcctctgtatttatagacacatttatagagattcagtgggcttgagttttgacagcagtgtttgatcagaaacattttcccagaaccttaaaaaaaaactgcagttcaaatatttctaataaaaaaaatttttttttttcgttgctgtaactagatttgcatttccgatttttctctctcttgtttcacttttgtctgtggctgaggaagggccacttgggaaatgcagctgtgggtcgtaaggagtccctcactctatcgctctgtgtttcctggggctgccatgacaatgtaccacaaactgggtggtttaaaacaagagaaatttattttctcacagttctaaagtctgtagattcaaatttaaggtgttggcagggccacgcttccttcaaaacctctagagaaggattctttcttgcttcttccagcttctggcagcccagggcatttctgagctatggcagcataactccaatctctgcctccgtttttacatgccgtcttcccgctgtctctctctctctctctctctctctctctctctctctctctctctctctttctctcttctccctttataaggacaccagtcatactggattagggtccaccctaatgacctcgtcttaatttgattccatctgtaaagactctgtttctaaataaggtcacattcataggtatgggtgggggggactgggatctcaacatactgtgttttggaggataacacacttcaacccataataatggcaatttgtttttaatgcattttttcttgcttttccactaagacacattgggggaattctgttgatttccccattgcctttcttacaatgttactctctttatttcttatatttttgctccaaaatagtccacatataataatcattctgtattattgagaattgaaggttattggtgtgattgacttatctactaccttctccatgtaaacattttggtatctgcttccttgttctcatttaccttttcagttgacacttttgagactcatgtatgtcctaaattctatctcatgtcacatcctttgtggtctgctttattttttattttttgagacggagtcttgctctgtcacccaggctagagtgcagtggcgctatgtcggctcactgccagatccacctcccgggttcacgccattctcctgcctcagcctcccgagtagctgggactacaggcacccgccaccatgcccggctaatttttttgtatttttagtggagacggggtttaaccgtgttagccaggatggtctcgatctcctgaccttgtgatctgcccacctcagcctcccaaagtgctgggattgcaggcgtgagccactgcgcccggccagtggtctgctttattaagcattgattgaagcccagtggctggtatggattacattgctattcagtctgtaattacgttcttttacaggtggcaggtggagtgttttggagcatgtgtcatgtcccccacgtagctcagttcctttccttcggggcttcacatgcatacattttgaaatgaagaaagccataagcaggtgccagatgagtttcctgggcactcagaaggaagagagcctgcagtaggctggaatggccaagtgggaaaatggacagaatttagacaaatgcagtagaggatgagggagagtgtatcatgtggcagagatgatggaagtacaagcattgtagtagttcttaatttgttgatcctaacacccctttgccctcatattttcttagaagacctgagggaacgtttcatgtgcgttatatctatatttatcatattataaatcaaaaatgagaaattaaaaaatatgttcaattgatttaaaataacaaagtgcccattacaagttaaaatacttatttttaggaaaaataactacaaaacaaaaaaaaatgtggtgagaaccatagcactatataccatttttttgcaaatctctttaatgtttggcttattagctggattctcaaatctgctttctcattcaatctgttgcaatgttgttttgatttaaatatatgaagaaaatcctgcctcatacagatatgtagttggaaagggagaagcattttaatagcttcgtcagataattgtagatatgctttttgtagatatactacatgaaaattcagtaagttatagtttctttttcttgcttaaaaatacatttattatatcacagtttctatgggttagcagtctgcacacagcttagctgggtccttttcttagactcaccaggctgcaatcaagatatcgcctaggctatgctctcatctggaggcttgactgggaagaatctgctccaagctaactcaggttgctagcagaacgctttccttgtttctgtaggattgaggggcctagcttttttctggctactagctagaggccaccttcagctcctggaggccacccttctttcctagaggtcacctgcagtttcttgtcatgtgggctttcttaacccaactgcttactttatccagccagcaaggagtctctagagcaagtcagctcgcaacacggagtattatataatacaacataatcatgggagtgacatttcaacatggtttcttaaaggttcattgcaatgttgaatttggaatcacaaccaatgaaatattcatactccattacaatgcattggttcatgtggtactttgactgatcttgtattcctgtgtgatttaataccatacattggtcatttggaaactattagttcactgagttgtatcagttttccaaacgttgacatatttcattatataatatcaaaaactacgcatattaacattactatcaatttcatcagaaacatctaagtattgagaagctatcaagctcacagtggtggatacaggtgttaaaaatttttaatttttggattatgattgacaacaaatgctgtcatctgttttccttcaagtgccgaggtgtacatcattcattctcaagaaatacctatcaaaatctcaagaataaatatccagagttcatctgccagtcattcccttcaagcaaaaatggtgcaccataaaaaaaccagttagttcagcctgcagctcagtcagtcaatcaatcagaggagtgcttttctctgaggtgaccactgtacttcagtatgcggcagaatgctttatgtgtacttcccatttccttacacacaatgtcaaaaacatgtgaaatcaaaggtcaagagataatgaaattttacctgcttcatcaagggcatgcttacattattttttaactaccaatgagtggcagtgaataatattaatacaatgactgctagtatagtttagtgtcactacctccattcaagctaaggcatcagtagtgccagtgttgaacatagttgtttcaaggataaaccatgagattccaaaagttattagacacattgactgtttaagcaccagtgtttattttcagaatttcacatttaaaaaaaatcttcaatcagcatcagcaccaattagtcattttataatccatttgtaaggcaaaggtacagctctgcagttgggatgtgaactcagtcgtcatgtttgtagacaaacctttcatttgaggagttactgtgtcattaggaaatggcactgccatgttttttttaaactaacttatccagcaggccttcagcaatgtcagtggtacaaagttttcttagtgtctcagttactgtgtgtttttctccagctaatgcagtatgataccctataaggtctttcagtggctttttctcttctctcttgaaaaactacaacaacgtttgtcttataaagttctcatcatgtctgcattaaaaaaaatcaattccttttcctttaaatccttagtgattattttcaaaatgatgttgcaactgaactatttgaaaatattctgttgcgtaagacatagtataaattactaaatatctataaagacaaggtaaagacaactttgttaatgtttttgtttatttataattttcctcagggttgttttgattttttttcttaagtagttgcttcccttccatggatcagaggcctctaatgtgtcagtttcatcttttttagtatctttaggcataaaaagtatgtatacctgtgggtaggaaagcaggctttctaaacctctttttttttttttttgagacggagtctcgctctgtttcccaggctagagtgtagtggtgcgatcttggctcactgcaacctccgcctcccaggttcaagtgactctcctgcctcagcttcccaagcagctgggattacaggtgcccaccaccacgcccagctaatttttgtatgtttagtagagacggggtttcatcatgttggccatgctggtcttgaactcccagcctcaggtgatctgcaaccccttagcctcccaaagtgctgggattacaggcttgagccactgtgcccaggctctaatcctcctcttttatgttggatttttttttcgttaaaacgtacataacataaaatgttccattttaagtgtatagttcagtagcattaagtatattcatattgttgtgcaactgtcgccaccacccacctacaaaacttgttcatcttcccaaactgaaactccatacccattaaataataactccctattccccactcccccaggctctgacaaccaccatttactttctgtctatgaatttgactactctagatacctcagaagtggaatcgtgcactatctgtccttttgtgactttattatttcatttagcgtaataatgtctttggttaattcatgttgtatcatgtttcagaatttccttccttatcaaggttaaagaatatttctttgtatgtatgtaccacattttgtttattcatttatccattgatggatgcttggttccttccacttttggttattgcaaatagtgccactgtgaacatgagtgtacaagtgtctgttctactctctgctttcactattttcgggtgtatacccagaagtagaattgctggattatatagtaattctatgttttattttttgaggaatccccctactgtcttccacaatgctgtatcattttacagtcccatcatcagtgagcaaaggtttcaatttcttcctatctctgccaacatttatttctgttttaatagccattctaatgggtgtgaagtgtctaatctcttttaaggcaacaatccatctttaaatataaaaagttagatatttattttagaatgatatagtaaattctaaattatagttttcatacaactaaaatatttagaataatttttgaaaagatttaaaatactattgtaaatctgtgaaatgacaaatcaaaagggcaaataaccttttagacttgagaaagagttttgactttgcagattttcaaaaaaggtattgggatacctaggggtttgtagaccatacctgaagaactgcttgatgaaatatagtattagaaacatggtctcagcttctcatgaaactctttccataggtggataaataatgatttcttttgatttacaaatttgtttactaagaacttaaaaaatgttttttcacattctacaacaaagattttatttaacaataacagaaaaagaaataacaaatcagttgccatggaattaaagttgggaaagaagaatgttttgttcttgactgggaaaccatttagaactggcaatagaaggcaggaataaattgtacttttctgacaataggaatgttttaagtctgttcttaatctttaaaaaaatttttttaagatcatttaaggagggtgtatgtatcagttttcaagttaagagatttctctgaagcagcaattacaacacttatttaaaatatttgaaatatgttgttagaataccaattaggtaattacaagaaattattgaaatttcattcaagaaaaaattacaggctggtttcggtggctgacacctgtaatcccagaactatgggaggcccaggtggatggatcacttggggtcaggagtttgagaccaacctggccaatatggtgaaaccctgtctctactaaaaatacaaaaattagccagatgtggtggtgtgtgcctttaatcccgactactcggggggctgaggtaggggaatcaattgaacctgggaggcagaggttgcagtgagctgagattgcgccactgccctccagcctgggtgacagagtgagactgtctcaggaaaaaaaaaaaaaaattgcaggaaaactcaggcatattattttgttttataacccaaatatatcattgctttaaatgacataccaaaacccatcagcatttaaataagcttatttctttttcttcccatcagccatctactgaatattgggagtgtggtgctgaaccgcagcctcacctgaggtcaggggaagactcagtttttttgctttcactgcacagtttgcatatttaaacattcttgaaaagaattgctctaaatatcactaattatctccatgcgtatagctcttatcttttatttttcatgaaaccaaaggttgtgatctctcatctttacaatatgacatctttttacttagatttagatgctatatgaaaccgtaatgcctctctttaagctccaattcagatagtagatttggatagcataaatgtttaatactgtatgtaaatgtccacatataggttgaaattataagatgtgtaacatagagtagtaatcatcaaataggtgacagatatccatgtggctattcattggggaatgtgactgtgaatcactgtattaaattcacctcctgcagtcatgggctaggcggtgtccattggtgctgcctagcattcttagttttggccattttgtttaggtagatagttgtctattaagcaagatacttactgtgtgttttgtaactaaaaattgtttgagagaaattttagatcttccctttggtttcaacattatgaagtatgaaattatgaatagtgctttagattgtcccatgcagttaatgatgaaaaccagttggagaaggtgatgagagcactctaagaaaactacttatttgtgcaaaaaagtggggagatgatgcttaatgtggggatgcttcattgcacattgggccacttgttgctatagtctcaaagatcatgatgttaaacatcatcaagatgatacaaaatcaaacctttctctgaacgtttgccatcctgtctcctgtttgggcctggaatattgagctgagattttgtaagtgtgtggcaaaatttataacggggctacaagacactcagagtaatggttccaatgactggaggtgtgtgtgctgatcattactgttggagtcaagatattggggcctcctttgtgaaggcaaggtctgaaagggaatgaaatttcatagatgaaggctacaaagtcacaaaatgtacagtaaagtatgaattcacatctgcaagggagagcttgttgtactctgagtgagccaagtcttgcttccagtgagtgtctggttcattcctcacataggcagcataggtgggaagtataaagaacttggctgtgtttatgaaagagacagctttaacttctcagtggggctggactgtagctcacctttagggttgatgttgggaagacaaataggctgctttgtgccgccttctgtattagcaaggcaaagaacagcttgacagtttctttgctcttctgacatgattctgtccatctagctggaatagggggctcaatttctgaggacaggtagctgagaatattgtggtttggggacctctcaaaaatacggagagtcttgtttgcctggataggagctctattccaaaggtgagggaaggaagtgataatgacttgttaaaagcaaccttttaggtagattgaccaggggcagagtttacaggatgaatgggaaatgagaaagagtgaagttcaaacaggtaagctgttgtaactgaggtgtataagctgttataactgaggtgtatgagctgttgtaactgaggtgtataagctgttgtaactgaggtgtataagctgttgtaactgaggtgtataagctgttgtaactgaggtgtataagctgttgcaactgaggtgtataagctgttgtaactgaggtgtataagctgttgcaactgaggtgtataagctgttgtaactgaggtgtataagctgttgtaactgaggtgtataagctgttgtaactgaggtgtataagctgttgcaactgaggtgtataagctgttgtaactgaggtgtataagctgttgtaactgaggtgtataagctgttataactgaggtgtgtaaatccggctgctgttagttctgatttctggatactttatttctactacttcaggcaatatttagagtagaaaatccactaacttgcattggctggcaaagaaggtgaaatagatccatgtggggttttgggaaaaacactgaacttggcatctggccctggggatagccctgactcttctatgaatatgaactagctctgaaaccgtgggcaaggcccttgaactctcaagacctcaggcatagagtagcttatctctaaagctcatccccagccataagagtgttttctagtgtcttatttattactttcaagtacacatttctaagtactaataacttttacatgctgccaaggagtggtcttttaggggcctattatgatgaagtatgatgaatagataactcatttgtaattaactgtgtgtatgtccatgcaaacaatttctgagctctaagtttctcataataattcccttcccataagtagggttaagcccttgaaattttgtttgcatttttaatttatacggaaaatgaatttttctgagatacctatatctcgtctccctaattagattgtaacctccttgaaagcattttgctttgttttgttgtttgctttttggttttaatccattataatgccttaaatagcactatgtgtattagggacttaatacagtagtagatgagtgaatgagaagttagagcataaactttagttcagaccaaattattgtgaactttgaaatattgtaacagaaattaataaagatgtaagtctatgatcttatattactgtccttaattaaataatgtgtgtgtgtaattattattgccgtggctacatgtaaatgtgacttaaaaggtcaatcacagtgaactgctacagaaaaaatggtaggagtggattcataaccgtgtaactttttttctctatactgaaaggaaatatcattttctccccaagatcagtctttgagtaactttgcggatctagaatagtgccttgcaattggggaagggagaaagggaaagtaaactgaagagttcagaagtgacagtggtcagttacatagagaacaaagtactttgttagttttctggccagatagaaaagaacacttttcttgactggagatgatttctgagatgaaagctttctaagatatggggtgcctggcctccacatctagtttctttgggagccagagacaagaggggataaaaagagaagcttgaaggaggaggaaaaggaggggagggtacatgtagtgggaatgaggggcagagtagcagacattattgcagaaaagtgggggaggaaagaaccaggctggaggggctccatagcctggaaggaagcagccctctccctacaccagtagctccctcaacctttgttctccttccacctagcatattaattgctgttcatgatgataaatctgaccactagttacagggaatggggctttttaacctatattttaggactttgcatcataagccaattaaaagagatgtctagttatttatcagaaatatttctataaatacagaagctgtgtatttttttcctgacaatatcttagttgtttggtcctttaaggaactgagcttagtaggtaaatactctagacagctgtgtaaattttgtaaataaaaatcagaaagctaactattcatttatgtagccagcattcattggctggcaaacgtgtcagaaactttgccagccaatggaaatacaataaagatactatgtagttcctaccctcttgtaggaagctataattctgtctgatggtgcacatcacttataaagcaccatgtctcagagaggctgctttggaaatgaccactctcttcttgggaaattgggatttcagaaggcctcctggaagagatgaaacttgacttctctgctatcttaaattattgactcaaatgtgatctgttagctaaagccacagagactgtgtgtcaacataggtgactgaggacagctcaacttggctggtggctataccattcaatccatctgctcttctcttgccaccctgagtccggctgtatctcaagtgtgatgctggagtgaaatgtaagaggcactctgaaattgacccaggtctctatactctgcagtctctatactgtccttctcataactagttttcactcttgatatcttttccactagaatgtaagcagatttgtgggcaagataaccatagcaatatggtagtggtgatggtgatgataatatgtaaaattcatggagcattactgaacaccagtatgtatgcgtgacctcatctgatgcctataggctctgcagctggtagtggggtggaggggctgtcattctctcctgacttagcagtgatgtcattgagacttaaagaggttagatgaccctcccatatcagtcagcagcaccaggagagagatggttacttgtcctttttttgtggatgtgtccatacaacttccctgccacatgcccagctaatacaggtttttgtttgtggtaagtaataagcgacagattctgctctgtagggtgagtaagttccatggtttctcctcgttgtgattggtataccatcagagtgtccccgatgcccttgggtactaaggcattgaaatacacatcactgtttgtccttctgccttgctcttctcctttcattttaccagcaaagactgttttcttttgtcagagtctacagctcagcactcctgcttagtttctgctcttgggcatcacctctgtcactgtggctcatccccaggccctttcagacactgatggcacctgctgagcccagggttaactactttctttactcctctttattcctctactgtcttatagcgtctccaagtatgtcttagcagccactgcaagaggttggccagctaggtaggcatttgttttgcttgacttgaccagtcactcactgtcagagcatcttcctatttgtggcctttcttctgggcttttccctcggtgggtgtgggagctcaagactgctactttgttctcagaggttgttgtttgtttagttattgtgtacagctgccaagttggagctgtttaagaaccatgatatcagaaagatgcttcattgcaatagtagctgttgattagaaacaaaacaatctattaatttcctaactttattatcatttatgttctatctccttctaaaagaaattatgacaaagttttcttttttaaatgaatcccaactagcagtgatctcatactttattcataataaattttgtttggatacatgtattttatatttttagctctctggttttgacagaatgactttcccctcctttgggcaatttgaatgttcttctattatgtagatacttaacatctgtgagaggttatagattcttgatttttacacgatggtctaagggagacatctcagtatggacaggcagcatagcgtgtttgtcatttgtgtgggctcttgagcaagattttctagattgaagtacaagctctgccatatactagttgtatgatcttaggcaacttacagtcactgtgcttctgttcttatctgtaagatggcgttgcagggttgctgtggaacgctaaatgaggtcacatttctgaactgcttatatggtgctggacacacactaacaatctaagtgtgtcttctgtatcatgtctgtgtttctcaagcagactttgagcaggtccagctatggtatctcttcccagtagctacatggggcccaacacatagtttctactcaggtttgtgagtagatacatgaatgtataaattaacagcatacgctttactaaatttccttagttaattgttttttatttaataagttgttcttccaagttccagttctctactcttcagatgactctgctttagttatgggttttttattgattcattataattactttgctgatgtttttttttctggctgtcatagcaagcagcagtcattagctacaagaagactcagcaatttagtaagaactgtcttggttttgagttgtctaccaaatataacttaacctaagacagtaatatacatggtttcattacaatctgtatattgttaaacatgcataatttctaaatttatgcaaacaaacattcattgctgtgtgtctcctaatgctgtacttgaaatgaatttgcttttggttttaaaggcattcatttaatggttggagtgaacctttaaaatattaattgcatcttgcttttaaaaatttagacattaagccactcccatgaaaactcaagttataaagaacctaagaattatttaaatagttcagaaaatatgatatgtaggcttcttttaattcatagcaatatgtaaattattgaccctctgaaaccccttgatgctaagaaagcagttctcgttttcctcttccattcgttgatacagctgaactggcattttctcttcccttttgtatagaatggacttaggctggaaatgcttttggatgatgtggtacttgcgtgtggtgtcatctctgctagagatgcaggcccctgcctgttctcctcctggctctctctggctgtggggctcaccagtgctgagacagctggagctgactggagtcagcactgtaatacactgttagaggttgaggataggtgtgcttggttgatttaacactttatttacctggtgagttcagcttttgtggtcttggatgattcctgtgctttgttcagtagaatcagtcttcactgtccccttagatataagcccctgtggagttccaaatctgttagtcctgtcctgtgatttggttgctcaggcggttcttgcccttgctatggggagccttgatacatggcttgtaggtcctgccatgttaattgactgttagtctaatatcgtatctctgtattgtaaggttttcaggttacaaacctcttatctcttccttctggggacccacttccccctaatctcccttattttagagttactgaagtagcaactagaaccttgcaataaatagctctctctgccttgacatcatctagcctttggtctgatttttgaatatttgatttggatatttgactctttttaaagttacacagtagcttgagggtgccctaaagagaactgcctctggccagcaggctggggtgctgctatttttgaagacaggccaccctaaccttgctacactagaagtttgtgcgcaagtaccctgggacacaaggtacatttgaatgtgtctctgtaatcaccagcaaaagaaggggagttggatctaagtttacttttcttatggcagtatctgttttgtaaatcaatgaatacccatacattgttgcggcaaagttttttttccagttaaaaatgataactcttctatctggtggttctcaacatgatgacagcatgcatgtgtgtgtgctctttttttcaattaacaataaaataactcctctaatgctgatgcaataggccggtggttctcaacctgacagcaggatgtgtgtgtgtgcacgcatgtaaatgaatatacatgcttgagtgtggttatattatataatggaatcaccagtgagacttttccacaataaacatgtctagtttctacccactcccacacatttggtttcccaggggtggtggcgagtgtttgagtcatctacaagttctcatctgcttccccttatggtgtctttcaggcacactcatgagagggttgtaatcatttgtcatggatcataacaacaatatggaatacaaccataataacatatactgagcaattactgtgaatccactgcacaatcagaaaccgtgccgtgtttttaatggatatttttctcttgcactaagctagggcattgacttcataattctaccatgatagtgtttgaatttgaaataaaacttgaaaaaaattatttttcttggggggggatgggatagttgggtttcgtaaattgatcagagtgtattgtttttaactctaccagagaaatcaaaataacttatttacatatctttgtactgcaggctagagctaacaaatatttataatattgtgtggcactattcatactacatggcagatgaggaaccttgggcatagaaagttaaatgatatgatgataggaatacctagtgtttaatgtgtgcttaatatgtgccaggcactttctaaacactttgcatatgttaatctatttaatcctcacaacaattccaggaaacatttactattatcattattattttgtaggtgggtaaactgagtcttagaggtttagtacctagcccatggtcacccagctggcaatcggcagagcccggttccaagcccagcctgtctggctcatgttgcacaattcccttggaataaaatggggatttgaactgggtcttctgcttcagtactttctcttagagctacattgccccggtttttaaagggttttctcacttttatttggttttaatttttttagagacaaggtcttgctttgtcactcaagctggagtgcaatggtgggatcatagctcaccgtaaccttgaacacctgggttcaaaggatattctcacttcagcctcctaaggagctgggactacagcatgtgccaccacacctggctaattttaaaaattgtttttttttcttttctttatgtttctcatgctggtctcaaactcctggcctcaagcagtcctcccaccttggcctcccaaaatgctgggattatagacatcagccactgtgcccagccagttttctcacttttaaatgatggtttgtaaagagtgatactttatttagatcagtggccctcgttgggggtggctttgtcccctaggacattgtgcaatgtctagagacaattttggttatcacagcaagtgagaaggtacttttggcatctgttagagtgaggccaaggatgccgctaaacatcttacaacgtagtggacagcactacccacagcaaagaagtgtcagcccaaatgtcggtagtacagaggctgagaaaccctgtttttagagtgttttgcatgatgcctttttctctaagaggaatcaatactttagtgtacagttctgcaagatatttttttaggctgaagagtaacaaggaagcagggtagagctgatactaaacttacatagggagcgtcttggctttgagactcttcatccatgactggattagttattttaaaaactctgcttgcgtggactcacaggatcacaaattccaaacttaaggacctttcatcttctggaatatagctgggcttgaggtattatatggagtgtgtgtctatgggcatcggtgtggtgaatacttctttgtatatatatattttttgtgtgtgttgtacaagagtgacttcataaaaggtggctcttgccagaattcagaacacagcaggtaatgtacttactgaagaggtaagagcatgagtaattcttgtctcatgagaaagatgtaaactagtttattataatgatgtaatatttgggtgcctgatttatcatccccatctccaatgatgcaaaaccttaagaactacacaggtgataaaaattcaaatggtgtctttgaagtccggcctattcccctgagcagttaaaagtgtcacctttgtcctgatacgttgctgtttgtggatgtttccggagatcacggttaaaatcttgaactatgcactctactatgggaagttttgggatgtttattccgtgagagaggtcataatctgggaagatgagagtcattcagctaatagggcaggaaaatatcacagtcaagctgtagacttgggatgatgggagtatggaagagatgattcctcctgtgtactgaggggaaccaggagagggagagttgtcaggaagcgtgtggtctttgaactggatctcgttttaggagaaacttgagttgtcccggttgagaaccagcttaggcaaaagtgtggccactttagggcaggctgggggcggggatatgaaaggaaatcatcatcatcatcatcatcatcatcatcatcacaacaacagtaataatcataatcatggccgccattttgtgagtactgctctgggaaggcacactctagaggttttaagatacactcatttaatccttgcagcaatctcatggggttggtattattatagctgttacagacaggaaatccagggtctagtaaggccagggtccggtccctcctgacagtactcttgtgcccctcgagcagcagtcccttctggttcattcttggtggttcccagggagcgcgaggaatgatgtcagcagagccgtgctgtgactggatgaacacaaccctgggaacaatgcctttggcacagctctttaaaaagaagtaagttggggcttcatctaaggaaactggctctgttctactcagtctcgtaggaattcttagaaatgttgtgacctggaaaattggagaggtatgatttgattaatttgcacatttaagtatgacagtgtaactagagagtaaacaaatggtaattatgccacaaagctttcctccaatggagagtcagggtcaaggcaatctggaatctttggcttttcagattagttgtgaacatggaacaacaagctcattcctcccctctacccagggtggacccctgtgtgggggatggggaagtagttttccttgcttggctacaatagcttagattaccatacactcatctctgacttagattttataccttcttttcccccatcctaccctgtgaagacaattgaaggctagggtttggttaggaaagtagcaagttaataatgtatcagaaagttgttggcagttgtgtttccttgaatgactcttctttgaagctacattgttacagtgatgtgtgtaatttgacctactgttcaaaaagaattcatttccatcccttccttgttcgttcattcatcatgcgtttatagaagccagtccttgacccagggggacccatagtctagactctggaggagagcacaaacatgggaaccagtaagtatagctgtggatgtgaaaagtaaagagacagaagtagagagcttccttctaaagagagaggggaaagagtgggaggcagcctttatttctaggggtactttctctctcttgttccatcctccgtcctggactgataccctccctgccctttgcatccatgttttttttccctcttatccagagtgagtctcctgggaaacccaggccttctttctgggagctcctctctcttcttcgtcactcatgcccagggtcacactggagcttcaccacctttttctgatactgataagtttcttcagctttgcattcttgcctcatttttctgtcatctgaccctagccgatcctatcacttgttatggaggtagctagaagcacgtgagatatggaaagtgttgtactggaaaatacacagcagatatacaaataactccacctgggcgagggagcattttcttaggctgggtatcaccttgggtttgaggtgcaccttctccctaggtgtcattttggagtccccgccttcttaaaaatgtgctatataagtattgtccacgtatgacctcattaattcattgaatatggcagaattgattgattgggatttggaagggctctataagagagactgtgatcttgtcaatctctctaataacaatctgcgtgacacatacaattaatcccttccttggaaaggagttgggggagtagaatcataaatttggaagcaaacatatcttttgttaaagtatatttttaaattacagtactcatctggaacacaggtgacatttctatcagcagaatttcaaatttatgcagactcgttattctgctttgaaaagctttatttcctttgctaactaccagatgggatattatagttatgaatccctaattctaatgaaatacaagccaatagatgtatcacactacgtttttcaaaccatagactattacaggcatgaagcacaagaagtctaacccattttaaactgattaatttaattaggagacaggtttggaggaacagaaaattgcttcttgttagttctctgagcactgcagttataagactgtatgctctgctctaacacaggtctgttctctctgaggtcatctaattctcctaaaaggggttttagatgctgagttgcatttgtaagtaaattctttattctttttctaccttctttcttttttattccatagtcattaaagccttgccgtgttcttgttatgaactgataaatgctttgtaattactctgtaactaaaaatgttaaacttgaatggttatatggattttttttttatttttttaaaaactcactggagaaaggaacagtgttgtgggggtataaaaagaattctgacagagaagagcagaaaacagaaactaggtgtggtgggggaggaatggcagaagtgccagggtctcttggtccatgtcttgagcatttactgtttgccagccacctttatgtgggttgaccatatataccataccagggcttgatatccctaaatcctcaaaaaactccatgaaattgctacctgttttcaggatgcaaaagctaaggcacaaaaatgttagttatcttgctcaaggttacacagctagtaaggtggagactaaatttgaatccaggtgggatgattgcatcctacaaagttcttgaccagagaactaatgtggggttggacccacccaagttccagtcctactctgctgcttcccaacaatgtgaccttgggtaaagttattttaacccctttgagacttttccccaatttgtaagtgggtttaaagcacagtataaggttgccgtgacttttaaatactgtgatgtgtattaatggtttggcatgcagaaggagcttggtgaacgttgcctttttgccctttcatgtcatgtcctggggaagtagcagtgacagcctgcagcctctgttcttctcgaatgttcccaaggtatgaggcacctctgagaactcccagagctctgcataggttgcttaaacgtacagcccactcaatgagataatttctaaggtttcttcttgcccttatctttagtgactccaaagtttaattttcataaattcatgtctacctagttacatcttgcaaagtgtaggactgcctttgcagttgatctgtcagtttgtgtgtgtgcacagctggaaaagtgtgttttccatgtagaatgagagaatttgcctggcactgtcatttatttttcttaaggaaagataaaagtttagttctttgatttctttcttgggattagttttttcttgactatcaagaaagaagggaaacaagtttgagtgaaaatagattgaggttcccccccctcatttcacactattaaaagagtgacacccaacttcttaggtttctcttccacagcacgggtgggttttgtagattaatgtatgctactgagatgttgagtcagggttggattagggaggagctcccctccttgcatttctcccactctgtcctttcagtccctcaaccagctaagttcatgcctgtagttggttagaagggaggttttctatacagcttgagagaaacatttaacagggtatcttcatgtttgtgtagatgtcatttgcttcattaaaagcaacagagtgactttttaatgattgccattctaactggtgtgagatggtatctcatagtggttttgatttgcatttctctgatggccagtgatgatgagcattttttcatgtattttttggctgcataaatgtcttcttttgagaagtgtctgttcatgtccttcgcccactttttgaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatctcaagaacaaaaaaccaaacaccgcatattctcactcataggtgggaattgaacaatgagatcacatggtcacaggaaggggaatatcacactgtggggactgtggtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataaaaaaaaaaaaaaaaaaaaaagcaacagagtgtatacctgtgacatttactaatgtgtgaggtgtctgaggaccacctgcgtgagaatcccctcgggttattacataaagagattcctggcccactacagacccacagaatcaaacttgtagtgtcattattttgtgatgtgaaaatattcttttcgtgtattgatcaaacctctgtttgagaagcaaccatgcaaacttatcacatcatttgaccttgttcagatcttggtgcacacattttcagggctaattttctcccactgcagcttgctgctgccagtgagggcctgcttgcccaagttcctggtgacctcactggtaggctgggctgggagtggttggtgacgttgccagggagactgaagttgggggcatgcagcctgtgaagccaggcaaggctggagccaggaatttgtagttcacagaattagatgcaagggtgaggtggtttgtgctcagaggagatgaatttaccaatcttagtgggcagaggagagaaatgggattcaaataactgaaaggagaggtagcaggagactccaatgtgatggggatggagatggggcaatagggccagaccttggatcaggtcttttcctcaaggtatttatggtatgacttgacagtctagctactgggaatttttgcggtaattgaatatttagacattgagtataatgcattatatgggttaagtgtatatattgcttatataagtaaagagtataattgaagatagctagtaacagctaagagtatagctagtaaaaacatactagaactaaaaataagctcatttctgaaaaatgcatcctttactaccctatacctactattttagaacattctagaaaatgtaagaatacacaagcatacgttcttacattctagtgcagtggtccccaaactttgctgcacaaaagggccatctgggtaataattttaaaaacataatgatgtctggcttctactcctagacattcttatttaaattctatgggatatgatgtggacattggggttttaaaagctctccagtccctcattttatagatgagaagattcaggactagcaagattgtgaatttttccaaggccacgtggtttaatagtggagaccggattgaataaagaaaggtcttctgactcttagctcagggcccagaaaccactgggccttccaaacaaagggaatttaagacagggcattgtcgacacaggtgatgcaagagttgaaaaggcaaactccaaatggtgaggaactcagagaccagcaacagcaggaagcaactgcatcatccgtagggttggagaaatgatgggagcaggtggtgtttctggatcccagagactggagcaaccttggagggagctaggaccaagatggtagtggaagactgtgtctgatgggagccaagactctagagggggctagagatgccacctgaagtgcatgtgttgggtggatacccttgcttctccctcttccctcttgttttcttgtcttccaccaatgcttcctattggcccagaccagttgggaagtgtggtttccttcaggacaatggaggcagcagacctgaaaacaacccagcagtaactagccctgtggtctttctaatgtactgaggtcttgtgattagagcagaactccatttggacactgtttctctttctttcttctttttctttcttttcttcagatcttgctctgttgcccaggctggagtgcagtggtgcaatcatagctcactgtaacctcgaactcctgggcctgaagtgatcttcccatctcagcctcctaagtagctgggactacaggtggatgccaccatgcctggctctttttttttttttttttaattttttgtggagacagggttcagctatattgtcctggctggtcccaaactcctggcctcaagtgattttccttccttggcctcccaaagtgctgggattacaggcatgagacaccacaccagtctaatgggcagataatttcttatattccttttcataagtggtgtgattgataggcttctaggttgctataatatacgtctgcacattttcattaataccttctttctgtgacgattcacctctctcccattcaacatgtttacatttttacattttttatacttaaaatatatatagttttaaaaatacgcattgtaatcttatctgtgctaaatcttaaacatttgttcctttgaagactagttacttcctagatatattgcctaaagccagatgatcctatgcatgcatatgagatgacagatcttactttactatatcatttaaaagcatttttaaagaaaaatggaattatagtacactgcattttatttgttctgcctgatgggccaagtgctttgcacccagtggagctgagccttgccagcctgctgttataacagtagctcccctgtagagctcagcattctttagacttggctaatgagtctgatgtcataaagggagctttattaaaataaatatggtaccatattttctttctaatggcattctgattaattccatcataaatgcatacctgacactcttttaattaattgagatagcaaagggattccagctagtgatattgaaagtgtagacggtgttttcaacagcatgttcctaccctgacaccagtatcagtgtttagtattactgtagatcagaatctgaagacctatgtctattttaacatatgtcactgaacggctgtgagagtaattaaagagtaatgcttgcccctgttttgaggatgtagctacttaaacactaagagattaaatgttgccgaaggctaccagcaagggagttgtggaggcagggttagaactggtttctaatttctagccttttgcttaaattgccaaccatgggtcccggtaatgtgttctgactttattttccttcagacttaatctgcggttaatgatagctttcacaatcagaaagaacatgtaggtctcgaatttatgacttccataaatctactactttccaacatacccacaaggatggtttggcagagacacagcttgtggtacacctattatcctttagttaattgggctgtttttactatttgggagatcctatattttaacatagtacgtgaaatattaatagtaaatatgaaatataaatttcaaactttaaacattttgtaccattacctaatttttaaaaatgcttatgactaaacctgctgaacatggcatgttcgaatgattattttacttctgtggtctattcctctcagaaacattgccgtccagaaaaatctaatgatttcttcttgtggaatagtggaatgctagataatggcacaaaaccagatccttcagactgtataaatgcaatgtaaaaatggagtggaaacattcagttttaggaagttagtgactcttcatgtcctgtaaaattgtgtgtatgcatgtatttttttttaaatgccaggaggtttgccaatgggactatagaggatatgccagtgagacagagaagatatgacttatacagacaagccagaatgctcattatcagagggatatttgtaggataaatcttatcttttacaggacgtaagaaagataaagaactattttatggtggttaattcagctcagattgctgcattatttaaaactgtgagggaatctttaaaaaaattcaattttctatttcccatctactttaattactttcagcgggattttattcattgtaggcaatgaattgtccacggataaatggaattgttggtagtcactttcactttggagctcttctataatcgaaatatgaagatatttgcattgctttatgaggacatttaaatacaagaagtaggtttttatatttcagattgaaagcaaagaaagctacctcactgattctaaattcactttgtaaaatctcgaattactgaaattaagttcattcagctcaaataagccaattgttttccctttgctccaagggagaagagcaggctctgtaccatcttgattggttttttatttgctcatcccctgatatgatttggctgtgtccccacccaaatctcatcctgaactatagttcccataatccccacatgtcatgggagggacccagtgggaggtaattgaatcatggcggtagttacctctatgctgtttttgtgatagtgaatgggttcttatgagatctgatggtttaataaggggttttcctcccactttgctctggacttcttgttgccaccatgtgaagaaggcctccccagccgtgctgaactgtgagtcaattaaacctctttcatttataaatgacccagtcttgggtgtgtctttattagcagcatgagaatgggctaatacatcccccttttgtaataccgtgagggagggcgtgcattagaattgtggtattccagtaggaaaatgaatacaccataacaagtcatggtatctgactttagaacacaaaccatttgtttctgatgttgatgtgcagactggcttccgtgacttggacttgcattctcttggtcatgtcagatttaagattcttttatgcagaacaagctaaacaatatcatggagttataggaacctatttattgtacatgtaatgagataaaggtggcctgtaataaaacagtgctttttaatattgaagatgctgaaactcctggagaagcaggtaacctgcgtatttaattcaaggactgaatcataagagctcatctttgggaaggagcttaccatcatttaatgctggatttttaccttgcttcctacagaaactattccccccactttgatatgcaaatatttccattgggcttttggtttcttttacagttttccaaggcactacatcattgtatttggtaatttcactttctttgtgtaattgttcctaatctttattctaaaatcttatcctacaatagttcaatgaaaggtgcttttctttttcttttaatgtttggaatactgcacttaatggagattcccatgtttactttaaaaatattcaaattttcagaaaaatgtattccccactttatccaaatgaagagtagtcactgcagaaatctttttattagaatcatagcattaacattggaaattatctacatcagttcccgttcaatgcagaagtctctaggcttagttttgtagagtacagagagggctaggcatctgtacttcaatctacaaatcctcttttcctcaacatccctcctaaaatgtggtttcaaggtggctatggccttggttttctttctttctcaagctcttcaggatgccacattaaaaaaaaattgacagatgtgataaaaattttgatgttaagacccgataaatatttttatagatgcctcaccagtgtgcttaagggacacccacggaaggtagactggtggaggcttaggacagtactgtctccctcaaggagctgtatatacctggaattatggcacatgctcacatggcatagttaggacagaacataagagatctgtgattaggtggcaaagcatataaaacaactactagaaaatggtcatgggaagggaggggacagtgttgagccttggcaaatagatattggagcaaatgatttgcaaggagactgatctgatggaacagtattcatgtttgaggctggtagtaataagatgggataaatcaaataggacaaagtcactaacaggcctcaaatgtcactgtgccgattttgaacttgacattgaagttactgggagccagtatggactttcgagcactggttgactaaacgaaggcagaacttttatctatttcacttgcttagaatgcctagcaatgtgaaaacagttaaatctagaagaccaaatatagctgttgcacaaggttctagaagaccaaatatagctattgcatgaggttctaggcactgagagcaagtttgacctgaagaggtccagctttggatggatggaccagaaaggaaaaaaatcaaaaggatttttggtaattggcaacgataaagaggttttgaatctaagataaccatgagttttggtgcaaatggcaaggacaatgttggtgccattgacaaaattaggggaattattttgtttcttatttcagcactgaaatatggaaatttaatttgcttttgagcaaatcaactttttggcacagtcccttgtttcaatacttaagaccaggcccagtgagcagatgggagatggggacttgcttctggagaattagagctttgagttctagtctgccattgatcgattacaatcaagcaaatcccttcctcccttgatatttcccacatatgaaatgggaaggataatgggtttctgcttagagggtgattgtattagtctgttctgactgctataacaaatatgccattattatcacaattctgaaggctgaaaagcttaagatcaaggtgggggcagacccagggtctggtgagggcttgcttccaggtttgcagatagccatcatctctctgtcctcacagggtggagagcagacaatgaggaaggtagctctctcctgtctcttttataagggcactaattccattatgagggccccatccttatgacttaattaccttcccaacgccctgcctcctaatacatcccatttgggatttgatttcaacatatgaattctggggaaacacagatgcgcagtttgtaacagtgattgtaaaggatgtgcaaagaaacgttggcaagaatgctgtgcaaatggacctgtctttatgcatactctcctttattgttgatgtgggtgttaaagcccatgaccagtcattaagaacccttactccactctcttctgggcatatggcaagtgagattctgactttaatggctgggatggggagaaaggagctgggaacatatgagaaggacctctttgtcttgtgtctgtttcagcagcaagagagaagacattgcttgcagccagaaggaaagggactgtctccaggaaaatgtagcctttagttagcagaacttactttagaaggactaggactcaggcttttaaataaagtgttgaagtctctgttcatctgcatgtgtgtgttgaaagaattagtcaaaatatctgaccttcactttttaggactgaatcaccattctttgctaaaaaccctgagtatggagtgataataacaagaatcaaaaggtgttttcaagttgtatatacaacatagatagggttttgttttaaagataggcagtgagactttttctgtattgtaattttcattagcattttgtaataaatttagtatctccagttggggttcaataacttaaaatgagaaaaattgcaattttaataataagcacaggttgattgcctactttgtcttttgtattaaaatgaatgttgcaattactgtgtattaatacccagcaaactatgtttctttttcatctggaactagaaagtattacttctaaacaggcacacacaatttatccttgtaaataaaataattctaagtgtgcatgtatatgtttattatgaagccatctttcagaatgcaccaaatggaaggagagaggagctgattgtcttttattgtggggctgacagaatgtttattaatggccatggatttgaaatgagcatcttactaaatggaagtctttggccaacctctgacccttttgtcttaaaggtttgagaacagataatacgaaagaataccagcttttttccagatggctgcatgcctgatgttcctttatgtttagctgtcattcaaatatgaatgcccagtgattataagtgtctctttctcttttctggactgaaatgaaaccttttatgcattgtgtgttaaaacagattaactgtttggctcatcagtagggaaattagaacaatagctgccaattcaatggtatagtagaagaatgtcctttggggccaggggctaaggttcataagcaaatggtatgtacaagtgtcagactggggaaggacagacaagttataaaaataattcgcctgaattttaattttataactgcgttggagtagtaatatcttttagaagcagggaggatttagataaatttttacgaacttttacatattttttagttgctccattaataatttcttggagtgctgttgtacacgatgaatttaaaatgatggatttatagataatgtgtcttatgaagacataatgcagaattactgtatgtttccttaactttttagtgtgctaaagttgtcttttaaatatatgtatttcataaggtagaataatggataatttgaatgtcatttttctaccaatactaacacttttgtaatctgaaatggaagtcaaggtggacagctatcatttaggtatggttgcaatgcagacctgcccggagggcaaggggaaaactggtgacccctcagtgacctttgtaggagatggctggaggccaaaggtctgaggggaccaaccgcatcaatttaggaaactagagtactttacaaaatgctagacaaactcacattgttagctctgagtagtaaggtggctgtcattttccatggaaatccatagaatgaggaaactacagtagtcttatgacctagtggacgaaaaagagcacatgtgagcttatttaacccctatgtaaagagattattttggtaacaagaggtactttttatgtattgtttatagaaaagcacaaaggaaagcctaccatgaaattctgttgttttaataacaattgtgttttctaaaacatccaaagatgaaaataggcttaaataaaataggcagctataccactttgtaaaacttattgtcatagtatatttttgatattttcacattttgttttgtattatactttttaaaatgattttatgcccagctaatttttataacagctttattggtgtataattcacatcctaaacaattcacccattaaaaaatgcagaaatcaatgacttttattatattctcagagtatttgcatccatcactacacagttttggaatgctctcatacattcttccccaaagaaaccccactcttcttaccagttatcccctattcccaccagcccttgacaattactagtctacttttggtacttttggtccctatgaagttgcccactctggacatttcatataaatggaattgtacaatcaatatgtggtcctttgtgattagcttctttcagttgaaatgttttcaaggttcaaccatgttgtagcatgtgtcagtatttattcccttttatggctgaataaattctattgtatggatatgccacattttgtttatgcattcatctattgggggacatttggattgtttccactatatttatacttttgttaattaagtgttttttccagtgaatatttatcttgtacacaatatgacttctattaggttttaagaggttaacatctatgtacgtttcatgtaagattatggtgactaccaaaagacaactgtggagtcaagggctactataacaggtcttgcacaaaatccaatcaaacaccatagacctctaggatctaagcatcctcaacgtagattgaggatctccagaatggaagaaatgcttatggttagcagtagagtggtgggtaggggagggggcttgcgcatggagcaatggcagatgagctacagtatcttgtaatatcctccacagtaccataccctgcctagcatgcagttggcattcagtaaatacttgttgtctgagcccattttgtgtaatgccacaccaatttaccatcttccaaggggcaaattttcgaatagtttgcaggctctcagctctcccaagactaactaatatcctgcaacttaaataagattgttatcttgataatgattatagttgcagagtactcagtagtttatgaatacttttatttggctctatttaattttctaggtaaatactgggtagaacagggagaaatctcatttgccagaaaactcaggagtcagaagtatcatttctattaaccagcaaagtcaaacttcactccaggtcctgcagctgcagaatttgtgcttttcttcaaatatcctgctacttacacacctctctacctctgcctttatcttgcttctcctctttttattaactacgaccagcatccactaagacttttgtggggacctctgagggttttagtgtgaaaacaaccttactgaaaatgtacactaaggagttccacagttgtgtcttgactgtttccttgaataaattctctgtcttacgtaccaatattaatagtgattatggcactccaagatgccacacagtggttccatcaacactcggtccctgaaacagaagtccagaactgaataaatgaaatggagtctatgattaaataattgcagtaaagcagatactgggtaaaaggagttggcaaggttatcttcattgatacttggagatgaggtcgaatgctagtgccaggcgatacaggactggactcctgaaagggcattgtgttgccctttcactcattactgagtgttcctgtgcatttcagtaaatataacatctatctataaaagcatctgttagcatgatgagaaacaggcaatgcctattccttttccacagagtttaccaacatactttctcacaataatagcaaagaattaagataatcatcactctaagtaggatgtgaaagaaatttagagaaggtgactagtgattatgcgtggagaacttgctgtattcaggaatgtacttttatctctatcttaacaggtgggcaagcaagggttaagtaattttgcccaagatcaaacgtctagaaaacagtggagccagactgtatccatgccatgaaactccagcattcttatttggcatcccagtgctcagctgccacctgcagttgaccgtaattgctaatcaccccttcttccctttgtcactgagtcctgtgactatgcttctgaagtgaaagtcatttttcttttttttctcacttcatacctctattggtggttattttattctctgaactataaaagtaatgcatatccactggagaaaaattcagaaaataacgtataacaaagaaattaaaaagtacttgaaattctgcagtgtaaatagcacagaattaaagacatatggaagcctcagctatgttggtgtttgtgaagtcgtttgatcaggtgcttttattcactttctttcacaattgctgtttctaagtgcaaaaatttcagtgatgcctccagtgatctgactagagaaatgtctgttccttagcatcatgggtctactttataaagtagaccctctctgagttgttagcaagtgtgatgttgttttgtagggtactcagatgctgtattagttcagaatatcctgtttgacccttggtgtacctgaattagaccatgaaggtttctttgtttctgtaggaaatttcactcagaatgtctgcttaagaagtcatcaccttcttctatggtctccaaaggagagcaaagtctactccatcctctgtcccatccactgccccttgccccactggctggactcgggcagtggaaacacttctctgtctaaaccattgacagtggacctcatgatgaggccaagcattgaagagattagaaattgagatggagtttggtcagggctttgacaaggatgggcaccataggaaatagtgtgtcccaggcagtggttgatggtttgactcttctccatcctgtttcttattgctgttccatcagtgctggtgacactgctgtctgtgtttgtagaatgctggtgatgaggaatgaggacagcattgaaagacgaagttgagtggggaagaaagaaacagtttaccaaagaatatcaagcattattagttgcttattaagaagtgggacatttctgtatgttagtcaattaaaaacagtcactttgtgaggtctttttatcactttggagctgaggaaatgaaaattcagaaaagtcaagtatgattttgtaaagctgcatgtataaaatgagcatgtactttaaatgtttcatttgttcatgctttgttttacgttttgtaataaattgagccttggtcaaagttgaaactcagaattttatttttaaaaggaaatgagagcatgctatgctattgggctcaatttgaattcttcagtgaaacaaagaagtagaattttattcattcattcagcaaacttctttttttgagcaactgattatttgcaggtgctatgctagatgctgcaagcaaaacatgtgctctgctatcatgcagcttgctgactgctgggtgtaaagacaattaagtaaaaacaatagagcactttaatgagtcttgtgatgattttttttgatagagaataagtttcataaacaattacatttagaattatgaaatcgtgagataaaggaatataatgtcctaggttattgtctaataaccatgatttcctccttttttgctttgaacaaactttttgtgaaaaatttcaaactcatacaaatagaatagattatgagccttccttaccccacaagtatccatcatccagctcttcaaatcattaaccactgatcaatgtggcttcattgtttttctttcatatttttttcctattttgttcctatttgtttttcttttgggagatgctggaagtcttggagcagggctttctgtgtaatagtggagccatactgaaaaattatttttcaaatttttgtatccttttttgaaacctgacttcagggttcaagggtgaatcctgctgctcttagagggaccttcttttgctgcctttagaggattgtttaccttgtagaaaagtatatgaagtgttggtttggaaaaagcaaacacacttgtcaggtgcaaaaacatagaacactcccaataatctttcatgtaagctaaacttggccaggcgcggtggctcatgcctgtaatcccagcactttgggaggccgaggcaggtggatcgcctgaggttgggagttccagaccagcctgaccaacatggagaaaccccgtctctactaaaaatacaaaattagctgggtgtggtggcacatgcatttactcaggaggctgaagcaggagaattgcttgaacccgggaggcagaggttgctgtgaggtgagatggcaccattgcactccagcctgggcaacaagagagaaactcactcactctctctctctctctctctctatctgtctctctctctctctctctatatatatattatatataatttttcatgtaagataaacctaagaaaaataactgcatggaacattcgtatttgtggtctctaaattgtgtaaaggcagcaatttcaggcttttaaggaatcaagctggctgcagaattgggtatgggaaattagcttgtctaactcattggcttgatttttgcggtgcccatgatctttgatgaggactttgtattccattgttctgtgtaatgcttccacaagtcatttctgcgaatggatgaatttttcttatgtggcaggagccgatgcgtgttttttttttggtagcgatcttaatgatgcccataggataaatgagaaattctcacaaatcctcactaataaatatggacacttaaaaagtctccaggtgtggatgctttgtgtttactgctgagagtgcccctgaaaatgctttttaaattttcttgcctgtccaggtaatgtgatgggaactacaggaagccagtttaagtgtcaatgtagcctagaatatggagaaaaggcaattgtttgcataatattctactgctaacatgtgtgaatgtgctttgcaaacttatttcagttcttgaacatctcagaagggctggggagcaggtgatgttgacccttttttactcttaagtaaatgctcttaagtgggccagtcaatagtgagctgggaccagaactcaagtcttctgttattagcatgtgttgctgtccagagtagagcctggtacattataggcacttggtaattgaatgaatgagtgaatgaatggaaatactccaagtcagctttttgcagaggatgcctttatagacccttggtattatgaagagatctttggaaacatgttttatggaaagataatttaggaaatatttgtctctggaagagtcactgaatatgtaaatatatcctgcatcaaagaaatcactgtacctttgtttagtccagtgtttaatgattatggtgccttcctatgtagcacatctattaatgtcccatagaattattgttatgtgtaagagcattttggaaacatagctccaaatgaatagctttctagaggggaatttgatattgaccagttaagactatcaaattaaaagttaaactcagattgtgaccttctgcttttgtctcatttactcctttgtttccatcctgaagttgcaactgtcatctctacgtagattatttggactttaccttttctatcttacctgtttcctgggtagttcttttatttgtgaatttaaaaaaagcaaactttattcttttaagaataatacatgttcaagttggaaaattagaaaatataacctggcaaaattaagagtataattctactcataatcccactatcagagataactgttatttatgtgctgttgtacatatcctttagaactcaagactacaggggtagtttatctgggttcaagtcccagctgtttctcctactggctgtgtaactttgggcaggatatttagcctatagcctcgatttcctcatctgtaatatggggataattatagtgcctatatgatagggccattatggggattaaatgaattaatatttataaaagattagaacaataccagacacatggaatttatatatgctaaattaaatgtgtatgtatgcaagtatgtatgtgtacaatattatattgcatgcatatatcacaaaattaagcagtaccccattgttctatattaacaatttgttttaaatttttcacagtaacaaacactctgtagtaaacattcattctccctgttttttacgtatccatcattatttccttaagtcaatttcttaatgggatctactagatcaatggatgtacatgtttttagaactttgatatagtctttctagagaacttggtaagagatcctgtcaatgctgctaatagctgtgtttgagaatgctgtctttttttcttttcatcaatatggaagataaaacatttttcccatttaaaagacattactaatgaagttaattgttgctctatggatagattttgccacttgtatttcctttttggttgttgctatttacagtttgaaaaaaaaaagacattgttttttctttttgcaagaaccctggtgatctttcgatacatacagtgaaggcacagtgatcagatcagggtaattagtatattcatcatcttaaaagtctatcatttctttttgttggaaacattcaatatcctcttttctagctatttgaaaatatatgttattgttaatcataatcattctacagtactttagaacactaggacttactcttcccatctagctattattttgcatcccttaacaaatttctccctacctcttttccccctacctatccctgcttctagtatcctctgttttactttttacttctatgagatcaccattttttagcttccaaatatgagtgagaacatgtagtgtttgactttctgttcctggcttatttcacttaacctggtatcctccaattcaatctcttttgcctagaatgacaggattttatccttttttatggcttaataatattccattgtgtatatatgccacattttctgtatcagttcatctttcattggactcctaggatgattccatatcttggttgttgtgaatagtgctagaatagacatgggggtgtaatatctctttgatacactgatttccttttctttggtaaatgcccaatagtgagattgctggatcatatggtagttctatttgtagtttctagaggaacctccatactgttctccacagtgactgtattagtttccatttccaccaacagtgtataagtgttcctgtttctctgcatcctcactagcatttttttttaatttttattttttgattatagccattctaactggggtgacatgatatctcattatggctttgatttgcatttccctcatgagtaggatgttaagcattttttcacatattttttggccatttatatgtgttcttttgaaaaatacctgttcagagcatttgctcatttttaaattggatttttttttgctattgagctctttgagttcctatttattttgaatattaatcccctgtcagattgcatgtattttctgccattctgtaggttgccttttttctctgattgtttcctttgctgtgcagaatcattttagtttgtatataatcccatttatttatgcttttgttgcttgtgcttttgaggtgttattcataaaatcctttttcaaaccaatgtcttaaagtgtttccactgtgttttcttctgttagtttcatagtttcatgtcttacattatgtaagacatttaatccattttgagttgatttttgtatagagagatgggagtctgttcttttttccttattgatacctagttttcctagcaccatttattgaagagattgttctttctttaatattctttgcacctttgtcaaacatcaattagctgtacatacataggttaattgctggtttcactattccgttccattggtctgtgtgcctgcttttatgccagtaccacgatgttttggttactatagctttgtagtatattttgaagtctggtactgtgatgcctgcagctttgttctttttgtcatagggaaatttttaaatttttaaatgaagtttgcctagagaggaaaaatgtttttaatttccttttttatcctaaagtagaagtgataaggtttcagtttttaaaagtaacatctcattcacatttcatgcttttgtgatattgacctgtattctttccatcattgactagcctctctttcaactcatttacaaaatgagttatatagaatgtaatatatatacataatattaaatgattgtcatgtgtggacttactgagctagatagttgaatctttctgtccaactgtttagtttaaaataggattttttttttctgagtaaatctattatggatgaacttggggattttgtttgtcaacccattggacaagaatggagtggagaaatttctttcagggactgatcgttaagcacatttcctggatacggaccttaagacctgtattttaaaataatggaagtaaaatatctgatgcatggaatcttctcatgcatataacctcgttttctactccatttatttgataattgtttcatcatttcagattcaatttgtaatagcaatgaacactctttaatatttttctaataaggattagttggagaggttaatatggtcagaaatttaaagaagcccagagtcatcttaatgagtgtcaggtaattaacctacatgaatagattaaagaaatcaagcaggcacgctgatgggttttcctttcaagttcaaatttagaacatcatctttgcagtggttaggtcttacatgttagatggtgattgctatattgttttttaatatataaaaagcttaattgtgaaaccttattagaattcctcatcaaatttgcttaattgaagaatgattatggtatgtgatatgaattttgaatttttatatgcaaatgatatttttaaaataaataggcttcccaaaatgattttcttcatgaatcaagaaccagtgctttaatatgtagatctcttgttacaagaaaaacaatcaatgtagagcttaagcagttcgtgaactgctgaatttaggcgtaggaaacttggtgaaagtgattgtcactgttatcccaggaatgctgttcaaatctaaatgaaaatttatgccagtggtcactgtaagactaaaaggcaagttctggaagtaatcttgagtagttcaaaggcaagatttcatctacattattcaaataggtagtttctcttcttaaggaattctaggcatttatagaaatttctcctttgtttaattacaatgaagttgatataagctgtttgtgtttctggcccctctgaaggtggtgtgcaggtagttgctatcctttcttttataattatggcgactttagacatggaagaggctaaaaccagagatcattgactttgatcctgtcattacagggagttatttctcatctagggtagatagccccatcttgaagaatgagacaaaatacaaatttggacctcagctctgtcacttgccatttactccttgagcctaaatattctgttttgcacaatggagccaaaagtctcatcaaatggacagaataaatgacatattgcttgtgcaaacactttgttgatctgctcaacaatacaagtatcagatgtttcattgttgctttccaaggaacttctctcctctcactcctaggtgtgtctcgtccaagatgtgctcattttatttgaccgtcttttaattttcagtctcttaattgagttctgttttccccaaccctgcccaaggactttcttaaacaatagtacaaagacacagtttaaaaaaaataaaaacagtttaaaaaaaaataaaaacaaaactgttgagttcaagaggaggcaaaatgttattatttctacacacaccattcctaatctgtggttagtaaaatgtcagtttaggtcagagccttgtactttaatctgcattatggcccgttacctttttccattgtcacagactgtatccccaactctcattaatgagggtccctatttaaaagagagatcaaatcaacccttattgtgtaaagggctctgtgttgattgttggtgggggtgggtgagatacaaatataacgtacagaccatccttatacctcttatcatggttagaagatggcatattgtgtaagccagttgttgatactctaagtgtctcccgaccactcatttggtcgtttggattttataaaatgtattctatttctccagctgtgtttgtgatggataaggagctatctttatgccactctatattgccatattgaccaacacaattgtttccttagcagatactcaatgaatgctttgaatcaagctgtagaatcagaataattgaaataaaccccttgttacttttagaaaaacaattcacaagactgatattactgatgctaggtgataatatcctatgaaactctaaagagggtccataaaagagccttcctgctcagcacaggaatgaggaagggtagatagatggaacgttctttaagtctgaaaagttaaaggtactgaatccttatcacataacctgaggcatctaatttaattttcttttatgccttttttactcctattttattaaatttgcagtctgtcaacctctttgagaattttcttaatttttctggatctgacttcctaataacacgttttgtattagaaagactttattttagctgcagttgaagtaatttgtaggtcatgattaattcaccagtattatttcaggaatcctcatacaaactgtttcagtggttattgtttgttcatttctctactggggcaagttaagtactgagaagtaaagtaatccacaaagtcagtggaaattgtttggatctctgaggactatcaggaacagataatgaaaacattgaaaacattctactttaatactacttttttttttaaagatcataacataggacatttttgtcgtccttataatcatttgttacaaaaacataagaccttaatgtctgttaactacaccttgatttaaaaactccactttacagaccacacttgatcactccagcacaattgtatttggcaaaggggactcacagggggcacaaaaagaatatgaaactaggcttgtaaacccaacagaaccattggaagaatgcttcaaagttggaggagtgcttcatgtttgtgtgaaagatctgtgtttattttctggctaaattcccactttaggagacaactttacacctttccaggataatcccgcctgggcacaaactgaagtgatattatctggttcatccagctttctctttctaaatccttgggtaattttgttttatcagattcataactccctggcacatagtaggtcctacctgctgggtgagtaataaatatttgttgaagggttttggtcatttctgttcacacttgaataatatgtgatgaggctgagaagacaactgtggaggcgattacatttgtcattagtgacctcgtttctagtccctgaatgttaactgttttcagagggaatacttctcttataggaaataaaacagtctactctcctgtgcctttgacatcctgagtgcttttcctcaccactgagaattggacagtgaccatgctttgttagagaaggaagggtgaggggttattcatgttctgtacattccattctggaattcttggtatcagaaaaaaggttttattattagctcagtaagaaaatacaatctgcagtctgtgtggtggtaagtgtcctggcataaaagctaagcttttaaaaatttatgtttcccctttaaatgctgttttaacatccagtctttccaatggacatttttagagcacagatatctgctcctgaaagtcatatgttttaaactgtttcctgaaacacgctgagattaaaaaaatttatgtaggttttgaacttctaaaatgactgagtatttaaactttaatgtaagaagcacctgcatggtaggatttgctgaaaatgctggtcttgagccatatgcacagattctaattccttcagggtgagtggaggggctgaggatcctgagtgattttgatatagtagattgatatttagagttcctttaataaacagtgcattccagccttctactccagcatagcaaactatcttaaaatgtattgccttaacatatttattttatgatatctcttgggcttgtgggtcaggaatttggatggggtattcttctgttccacacagtgtcaactggagtcacttagtgatattcatctggtgccttgtctggagggtctacagtggcttaactcacatgcctggccccttggtagggatgactggaaggctgggcccagctgggaccctctttgtgtagtgctgggaatttttgacaaagcctcttagcaaggtatttgtactactttacaaggtaactctgggctcttaggatatggccagacagagtgcttcaagagagccaagcagagctgcaaggcttcttgtgacctggtgtcagaaatgccagtccatcgtttctgccacaatctgttgatcaagtaagtccgaaagaaggccccaattcaaggagaggggaattagactttccatgccaatgagaggagtagcaaagaactcacagccatctttaaactctcacacactaataggcagaaggcacattgctatgaccatgtcataaatttctgaattattgattcatagtcattagttactatcttaatataagggctcattgtctttcacctgattagtttcagtgatttctaaaaggtatatccttctacataccagtctctttttactttgatccgttttatatatggcacaagtaatctttttgaggtgtgaatgctgatcatggaagtctttttcctaaaactgtacatgtgtctcatctcctattatggaagactgtttagacggtctaaggttctgtgatggaagtatagtgtagaggttaatatcatgaactctagagtgagactctctgggttcgtgtcttggttttgcgtgaccttgggcagtgcactctatctgcaccttgcttttgtcatccgtaaaaaagagaattataatgatatccacctcagtgggtgattataagagttaatgaagaggatatacaatgtcattagaatgtgctgggacagtaatggttgttttattattattgctgctaacattttatggcatagcattcaagacctgtcctgttctgttgtaccttgtattttcagtctcatttcctatggctattcttgtaatccatgctgcctcacccagttgtcttctgtgctgtctgcctgttttctgtctttccctttactcgtgctattgcttctcagtgaaaagggatcttctctccctctctccattgggacatgatattaccaagaagtgctttagagggttttcagtagatggaaactggaattttatatctcatttcactgtgacatgtggtcaggttttgtctctccaactccgatatatgcttcttgaggtcaatacctggatcagatttttgtctttgagtttgccacacatgtggcatagtgcagcgccttatgtattggtgtttaaaatcagttgtgttgagggtcaggaagggctagattatgctgcagtaagaatctggaaacctcagtggctttagtactttttagtactaagaggactacttttttagtactttagtttctcagtcatgcttttgtccatggtgagtcaataaggggatctgttgactgtatcagtcagggtccctggctgatgaaggctccatcttaaacatttttccatgatccagaagcatagaaaagagaagtagaaataaatgcactgacttttaaagcttctgcacagagagacccatgttacttctgctcacatttcgttggccacttacatggtcacactgaagttcttgtaggtggaaaagtgtgattctattatgtgctcagaataggagaatcaaccatttatgaagaagctccagtggctaccacagatgacgcactggtctcattacctattccggtaagattcttctaggttaatatgcccaaactgttttaaaggtttgacctgcatgcacctcattaagttaatggaattcaattcagttaagactactgagagtcctttatatctcgtttggaggctgctctgtccagggagagtaaaacaaaatcttaaagtagcagttttgtttgtgtgtgtggtttttctgggaaatattaaagccttgaacaatcccgtatctttttcatatatttacctttaaagaaagacattgttttcttgcacctgtcctccactttgattcttgctttaaagtacatactggttagcaagacttgagattgatacttatttctggcagcataccagaattaccactgagggactgcaaaatagaatccttggcatagtcactagggttctgagttctaccaagttaagcgtgtttaataatttaatgatcttagcaaaatggaaagatatcccataaatatatgataatattcagtgcctcaaagtttaagatggtatcccaaaggaaattataggggcagattatcatatagacgaatgattacatttacttaacaaaaaattgggaggatttctgttttataccgtaatccttatgaaggatcagtatagaactttgctttaaggagttctaagtagtttatacatctaggaaagtgcagtagacatgggctactatgggaatagctattagagaaggcaaatagaggatggcaagtaaaggaccttcgatcataattcactgaatatgttagctgagtaaggcttctgttaaacttgttaagttgccaacattacatggtttgactgggccttgtaaggactagaaagcagtgcacgtgtatctacttttcattttgagaattgtgtcaacaaatatgtagaggttaagaaaaggaagaaaattattttaaaaaaaaggattatacagtgggaacaaaggatttgggaatcaaggaaatgaaggatatgagggggatggctacactaaagatcagctgttctgagtgcccagagaactggagttaagggtgtagcctcacactccttcagggacctgtactaacagacttcgcgagagagggattcactgtaaataggttgcttagagttctgttccttgggagttttacagctgatctagatgactggaagaatagacctgttcatgtaaattgtaatcctgttaaagctatggcatttattaaggacttggacccctttgacaatttggacatttaggaaccctcagtctagaatgatgcccatgtgcacaccctgttgtgtttaaagtgttcaatgggacccttagtttagaatcctggcagcacaggcaaggagaagtttgcaagatggtttgcagccccagcagttagctactgcataaatatctgtgatgataaagagtggatgtattggtggcttcagacaggcaacaggggggaatttgtttttaattttaggcattttaaacagcacaggcttgtggatttaaaaaaatatttgcattaacacaacactaaatattgtaaggggcaaggaaagtttacagcaaagcacatttgcttggggagaaggtttctatggctctccactagctgttacatgtttatatcctccaaaactttcactctggcttttttcccgggaaagaaatatctgccctttcccattcttctacccttagtgtgtgtgggtggctgtgcatctccatggggaggacacggaataaagctgtgcagcatgctcctttgctcccagaatctcaagccaaaaggaattgttctgaattggctgggtcttattttctcagtgctatgcctggaaggagacaggatcagggtgtgatgtgtcctgaaagcataaactctttattagcacagataaatcagttggttggctcagtagatttttgggagtgttggtgacattcatttcacagggatctcaaattatccaggaattacccagacagtagattatgatgccctgactctggcaatatctgctgttactccccctcctccctgctcctgcatatgcatacaagacttctatgcttttgcagtgtgatgatattggggaagctgcaagggttttagtctttaagtttctcagagcaaaagaagaatggatacaatttactgtgttgtgggtgagagagaactgtgaaacctgatttaaaacaaaagtgtgggcctgtgtcttcaataatctgactttgtctccctgtagcataaataattccagttgtataattatggctattcaggtaataccctgttatattgctctggagttatactccttttaagatttgctagttaaaagttgtcactttattcagacttttgtttttaaagttaaattaaaatgttcttaaggtagtttattctccaggaggcaggattagcctttctcagtagatatttggatctatttggaaagttttgatttttaaaattaagtctttgagtgtatcaagttaaagcataatgtattctaacatcaacttattttttatgaatcccaaaatattttgctacatattctgcaattggaaaatggcatctcggaaggattaaagttccatatgctaaaggagacaccaaactctgtaaaatatttcaaaaggcttattctgagccaatatgagtgaccatggcctggggaacagtctcaagaggtcctgggaaggtgtgcccaaggtggtcaggttatagtttggttttatacattttagggagacagaaagtgtaagtaaaataataaattaatatatggaagatgtacattggtttagcctaaagaactgggatatcttgaagtagtcgggagtgggggttacaggtcatgggaggattcaaagcttttctagttgaaaattggttgaaagagttatgctttttctaaatgaagtcagtagtaagaaatgtttgagttaagataaggggagttatatagtccagtgttcttgctgtgtagatgaagcctccaggtagcatccttcagagagaatagatgataaatgtctctttttgaaccttaaaggtgtcagactctcatctaatctcttctagatgcaggaaagacctagaaagggtctttcctttaaataagagattaaatgagagacctggctgtattagcagacattctctacatatgcaaatttcccttaaaagagaaggctttatagggtcatttcaagatatgaaaaaatatatgtcaaataaatatatgttgaagtaagatattttgatttccttcagggtctacatgtgactctataccagagtcaggttggaacttggtgtcttattgccacaaagcgtctgttttttcagtcttatgatgccaatttcaatgttaatgctggccagttatgcctaaactcccagagagaagaggtttaaggaggtttgtcccacctcccttcccatcgtggctggaaattcagtttttcaggtttctctggagtccccttggccatgagggacatccattcagacagttggggggcttaggatttcatttttggtttacaagtagtactaaacaattattaaatctgttcttcttaatgtaatatggcaaatatttacaatgatttgttaagtagtctatcggcattattctgacttattgttcccttgtcctttttatggagtctccctctgttgcctaggctggagggcagtggcacggtcttggcttactgcaacctcgacctcccatgttaaagcgattctcctgcgtcagcctcccgagtggctgggattacagatgcacaccaccatgcccagctaatttttgtatttttagtagagactgggctttgccatcttggccagacatcttggtctcaaactcctgacctcaggtgatccacccgcattggcctcccaaagtgctgggattacaggcaggagccaccgtgcctgccccttgtccttcatagaaccactttgatatgttagtctacttcaggacaggtgcctcttctctctctagatagaaggagaaacatcatctccccacctctgagcaccctaagaacaaatacatggccagtggttccaatccatgttacagctgtccaacaattggaagtatttattatttacataacagtatttctagtatataaaattcagttgatatatgcttgatacaatttactcagatttttgaagattccaaagacattttacaatgtacactgaaaatgattgttcccaaactgcatttcctgcttttcgaaatcatttctctcataccatccctccagcagcggtcagagaattgagtagcacttttttttggcagaataattctatatccaggtcagtgagagttttcttgttcatactttgatgttttgtaaatacaaaacaaaattcttattctgatctcagtcctgttaggggagtggttagctcagcatgagtcctaatgtatcagagatgaagggaaattggttgggagactactcctgggaccaggtgagaagcagctagtgtcattccgaatgtgctacagaggaagaaatccttgtagccctctatggtacttacttagaaacatcctattaaaatttgctacatagttaaaactgacattttgacccctgtctaagaaagtggggaaacccttgtcatgaataatgctatgtacagcagcagattaggacttctaccttttatctcgctttcgactctaaggtagcattccattctctgtcactttggttaaaatgttactttggaaggcagaggtcatttggagattgtctcgtggtatgtaaataaaactaatataaaaagtctgttttaaagttatacgacctctcctgttcttcctcatctcctttataaggtttataacttgcagacttttagcatcagtaagattataatatgtaagatatatataaacaacgaaaggaagaaaatgggaaagcagtcccatattcttaatgttcttactatatacatgtatggactaattcggacaaagtctccaattattttaaaatatactgatccacttttaaaaatccatttgcgtacatcccatatctaaaagttgtgtagggtataggaacaacaacaactatataaatctatatctatatctatatatatgtgcaagcttgcaggatatcgcaaaaatgaattgagtggatctttgatggttaaggttgagtctgttcaaagcctattgacttttaaaccaggagtctcagactcagatcatttcaggagttagacaagtaactggtgaaatatgcatctgttgcattttagacagtgagaatttccttcatttctacacagatgtcatattgattattcttgaaatatgagatcttcttgatctgtcttctgtttcttatttataggagtatgtgcagagaaatacacactatttggtgtgagatgtgagatactaaatgttgtagacactgggatgtcccagctcagcagcagctggttgttgcctcgatgtagaatgcaggccaccagtggcccgacttttgcttttaccagatgagatggcagcctggttcttttgcagtttggcctgatttttaagcaacaggaacaacaacaaaccatatagcccaaggagtatagacctgtaggtggactgcatcagcctgcgggtgcccagtttgtgatctctggtgaaacgttagataggagactgtcttttcttcccagttatgtttagtttagaacaaaaattggatgggaaattctcaaaatttacaaatacatttctttgatcttcttagcttttcatagattggtttgctttgtcaacaaaaatttacaacttccaattttctttgcaattgtctgtgcatgtatatatctgtattttgttaatatgtatttataaagttaagtgtgtattcctcttattgatattttaaatattttaaatttattttaaactcactgaagtaagacatgtaaaactgcatgtattacaaggtttttaacaaatatcagcaatgccatgccccacccacccctccctactctttggaagcaaccactttcaacttgtgtttcttctcatttatcagcaatatgcttgagtgaatatttcttgatttttaatattaagaccttttcaggtgatctatgataaataatagtttagttcttttttattttttcttcccagttcccatccctcattctctcttcctatgcatcctgcttcattaattaaaaatgttggtgagatcagtattcagtttttgtattagtatgatgataaaatattgttgaaagctgagtcacacaggatacttgtacatgtattttttttctctttccctggttttataatggtttcattttgtttgtttagtgatatttctttaaatatatttcagacatgtctggtcaatttctgggaaaggattctcaggagatatattttttttgacatttatgtctgaaaatgtctattctttactcatgctttattacaaaggtttgaaattctaggttgaagtcattctctttcagaattttgaaggcagtatgctattattttcagttttcagtattattgttgagaaggccaccttttacctgccttgtacctccaagcctctgcattttccgcctccagttctttgaaatttcatgatgtctgtgggtttttaaaccatttattgtcctgtgcactttgagcatttattagagcctttcaatctgtagattttcagttttgggaaacattatttctttatccttcgcctattctcaagacacacagtttttcagttgttctctttctggttctgttattgcgttttggaccttctggagcactcttctaattttcttttttttggccacctattttccctttctttgtctttttgttgtattctctgtaacattttctaaggtttatcttaactttctattgactttaaattttgccatcaaaagttttatttttaagagctctttgttgctttatgaactttgttttattccttttaagcatagctattgtatgggtgcaatatttgttcatttctctgagggtataaaagtctttttgaagttttcttctgctgtttgccttattgatctttccttagggttatttattttttctttttatttatgttagtctcctctggcttttatggtacaggattcccacaaatgctgggtgaaccttacattgttcatatttgagtgagtctctagtctgtccttcgtgattggtggtggttttccctgtgaggtaattctgtgtcttgttgggccccttaaatgtctagatttataggtttggattttttttttaactgattcgtgtctctatagagcagcagttccttaaccattagtctcatgacctttttacacacttaaaaattgaggactttatagactagtactgtccaatagaaatataatgcaaatcaaaaatacaagctacatatgcaatttaaaagtttctagtagctacagtaagtttaaaaacgtaaagctgatatttcccaataaatccaaaatatttttaacatgtaactaatataaaaatcgagcaatattacatttttttatactgtctttaaaatccaatatatattttatacttagagtatatctcaattcagactaatcatatttcaagggttcaggggccacatgtgactagtcaccaccatgtggacagcccagctatggagcttctgtttatgtgagttatatctactaatatttactgtattggaaactaaaactgagatattacaaaaatagtcacttcattttaaaataatgccaaaactcacttcatgttaacacagtgatatggtctaggtctgtgtccccacccaaattttatgttgaattgtaatccccattgttggaggtggggcctgttgggggatatttaaatcatgggggcagtttctcatgagtggtttagtaccatcctcttggtgctgtcctggtgatagttctcacaagatctggttgtttaaaagtgtgtggtacctcctcattctctctctcttgctcctgctcctcctcccgcttcaccttctgccatgattggaagcttcctgaggttttcccagaagcagatgcttgtgttatgcttcctctatatcctgcagaaccatgagccaattaaaactctttctttataaattatgcaatctcaggtatttctttatagcaatgcaagaacggcctaatacacgcaaattactcacttttatgtgaggtaaatgtttttccaagacagaatttattaagagtggtgttttacatttttgcagatcttaatgtttgtcttaatgtagaagatagttagatcttcatatctgctttagcgttcaatctttttttaatatgttatttttcttttaagtatagaaagaaattctggccctcacaaacaggtagttggaaaagggatgaatattttcatagtcttttcagataattctggatgttctcctttgatactacaccaaaactcagcaattggtggtttcttaaaggttagttgcaatgcggaatctaaaatcatatcaatgcttttcctattctgtcacattaaaatccatttgtctgtcttgtcctttgaatgcctcttttatacatgaatgagtttgtaacttgttataacacacattggtcatttgaaaaacattggttgactgacttatgctaatcttccaaacgctgacacatctcattgtacagtattaaaatatcatatttgcttatcaccatcagtctcatcagaaaaatcagaaaaattgggaaattgtcaagctcagtgtggtgtatagtttatccaaaccccaacttctgcttgaaagtttgaattttacgttggcaatgagcactgtcagttgttatccttgaagcgacaggcttactgtgtttactttttagacagcgtctgccaaatacccaaatctgaataaccgtggtttctctgtcagtcagtttttgaagtgaaaatgctgttccatgaaaaaactactggttcagtttgacaatgaaaatagtgcatgcattttttttcctgaaggtaactctcatactttggaatgcagcagaagtgctttataggtacacttcattttatcacacagaatattgaaaagacatgtaatcaaaagttgagatttaataaagtaagttttactgcctcatcaagttcttgaagtcagctttttaaactacaggtattgacaaagcctaaaatggatagacctacatgtaccatgcacaactgtaaaactcttaggacataggagaaaacctagatgaccttgagtatggcaatgactttttaggtacaacaccaaaggcacagtacattaaagaaataattgattacctggattttcataaaactaagaatttctgttttgtgaaacacacggtggagagaatgagatgataagccaaagactggaagaacatatttgcaaaaggcacctgataaaaacgtgttatctaaaatatgcaaagaatatttttaactttccaataagaaaatgaaaaacccaattaagaaatgggccaaagacctgaacagacacctcaacaaagaggtacagatggtaaataagcacatgaaaagatgatccacatcatatgtcatcagggaaatgcaaattaaaacaacagtgagttactactgcacatctattagagtggccaagacccaggacactgacaacaccaaatgctattgagaacgtggagcaacaggaactcgttcattactggtgggaacgcaaaatgaaacagccactttggaagacagtttggcagtttttaaagaagctaaacataccctgactgtatgatccagcaattgtgctccctgatatttactcaaaggagttgaaaacttatgttcacacaaaaatctgcacatgtatatttatagcagctttactcataatggccaaaacttggaagcaaccaaggtgttcctcagtaggtgagagactgaataaatgatggtacatccagacaatggaatattattcagtgaatgggaagtcctgcgtgtagtggtgtgtgtctctttggactgagttgtgagggctgaactgaaagtggcaggaacatgccattttagcataatgctaacattacattagatttggccaatatgtcagtgtgcagtatgtgttaagttctttcgtcccttaaacttcattatctctgtccaaactatttttatttggactttatatacttctttccaaaccttttataaaatttctcctttaaaaacccatgccaaagttttttctctccacggccttccagatttctcaaatgttccaaatgttccatctcccttcccagggttcctcttttggaaagctgttgtgatattattcttccttctggaaagcttgcagagttaggggttacattaagtctggggtaaatttatacaggtaaatggtacaacctcaagccttctgtggaaatcagctggcctctcctgatgatactttaatctcatcttgattctttcaagcctcctttagcctgtgactgtagatgaacttaaatcacagaagtgactatgaccctttactttgcctaacaattcttctttcttctagacatagttgaaatgccatcttttttctgttgctttcccaggtaaaaatcagtcttgcagggcagactaggtctttttggggagatggacagacccaatttgcatatccacataagccaagccaaggcaactagcatgaatgtacaagcatgtggaatgctttccaacatttttttttctttttttaaactttccaacttttagtttaggttcaaggggtacatgtgcaggtttgttacatgggtaaattgtgtgttgcaggggtttggtgtacagacaattttgtcacccaagtaaccagtgtaacactcaagaggtaactcccactctccaccctcaaggaggccctgatgtctgctgttcccttctttgtgtccatgtgtactcaatgttcagcttccacttataagtgacagtatgcagtatttggttttctgttcctgtgttaagttgcttaggataatggcctccagctccattcacgttgttgcaaaggacatgatctcattctttttctggctgcacagtattctgtgatgtatatgtaccacatttcctttagccagtccactgttgataggcatctaggttgattccatgtctttgtgattgtgaatagtgctatgatgaacatacacgtgcatgagtctttatggcagagcaatttctatttccaacatttttaaccatgtaattgtgctttctccaaagttatttcttccaatgcccatggacagtggagagaacgttttcttgtttattgtctctttttgcaaaaacatttcttatctgaactgctgctcttcttactgggccatgtttatgtcctagaattttcacccgggatcacaaactagcatatagagggaacagtgtgccctgaatagtgctgtggcatggagtgtgtgcagtggaaagggcacagacccttggatcacaaagacctggattggaaacccatatctgccatgtaccactggagggacctctgactagtaatttcagtctcagcttctacatgtataaaattatattttattgggttatagtgatgatttaggtcaatgagttaatatggataaagtgctattcagagtggttggaacactgtgatcacactcttagtggacatgtccacaactgcaacagtgacagtgtcacctgaaagtttgggttgggaactcttaactcctagaaacatttctttgcattatgaagtcatttataagcaacttcttttacaataataatgcttaggagtaaaatattaagcttctaatttcctaatgtgacttatttattagtgtatttcttgcaattaaggcagccagagttgctagactcttttgacatgagaaaggacttatgaaataagtagcagagaagaaaggaaaagtaggactgaacccctctagttttatctaggaatatcttgtttgacagtcttcatatttgtatgtttaattcctacacttggcttaatggacttgggagtctatttttccttctttattttccttatgatttttctatcttattttgttcatttggtagttacataataaatattttcctgaataaatgattctttttgttttctcttcttccatctgtctttacattagcgtattggtttcttttgctcagtatattgttactgagttagtctctaccctaaatcacttgattttctgtctgactgtgctctttttgctttgagagaaaccttcatcttcacctctttttagtccgttgtgctagagggctggatattgggtttgtggctgttcagcaaggttgcaatgctgagaatgaagaaggtcagcttctggacatcacttcacattctaaatgtgtgccatccagcagcctcactgcatgaccactgctgagctcatgtcttcaagctctctgaaagctgagggatggtttcaggagaattaattggcaggcatttcatcatgggctactagtgacagcatacagagctgttctttcccagttcactcatttcttcttttgcaaaagtaaaaatgtcttgagcatatttcaagtatgttgctagttgtcactagtatcaaacagttttatatatataatatgcttcacagcagcgtgagtgacatgacaaaaataagagcaaaagagcaggttttttttaaggaaccaaggtactctaagttgactcactggtaaggaagaataagccacaattcttgattgcagaggtgttgctttattgccgcattaactgcaagctcccatcagaatatgacttctgggtgtccatttctaagaccacgtgaaccgatcttgttaccacaccaggcgtgccctacacaagcaagagttagaagacaaagatacaacttcagacctgtagcagaaagaagaatgccaacagagtgtaattgtttagaaataagagaagggacggtatcagggtagtccaacttactttctgataataatggcttaacacaggcaggtgtacttcttgagcacactgggtactccgtgtgagtgggaagggtgctctacttattgtaggcactcaggctgacaaagctccatctccacatagcctttccaaaccctgaggcagggagaatacttactgactcatgcacctctctctctctttttttgagatggaatctcgctctgtcacccaggctggagtgcaatggtgtgatctcagcttactgcatcctctgcctcctgggttcaagcaattctcctgccacagcctcccaagtagctgggattacaggtgtgtgccaccatgcccggctaatttttttatttttagtagagatgggggtttcaccatgttgcccagactggtcttgaactcctgacctcagatgatccaccagcttgggccacccaaagtgctggagttacaggcgtgagacacctcacccggctcatgcacctttcttgggttacaggtgttagccacctcacccggcccatgaacctttcttgggttacaggtgtgagccaccttacccggtccatgcacctttcttaaaggctacagcccagaagtggcatacttcatctctgttatgattcactggccaaagtaagtcgcagcactgtactttaacatcagaggggacagggaagtgtgatgctgtcatgtcctgggaggaagaagaactggactacctatgaacagggccgttatctaccataggtggtatgctgaaataatgcctgctgctgaggaagaaatgagaaggtgttagagtcaagtctgaactcacagccacttgtgtaggttaacaataaaaagcatgtatagagggcactaactgtatacgtagtcctgtactgtaggttagctgtgtaggcaagttggagcccagaatgcttgatgggaagtatgtactttcagcaatagtggtggctacctgtgccaagaaatctctgttttgatgatctgagagtgctaggggaatggggcaaggaacagaggagtttgaagaagttgcgtccgttattctgagtgccctttccctatgctgagagactttgatctacacttatagcaagttacagatacagaacagttttaattatttagaaatgtgagtacctgtgtttcactgtaatgtaaagaatacgctagtgtcctggacatcaaaataagaggaatgccaagcttatatgtacctctgtggggtttttcttgagggcttgaaaggaattctaacttcagtagcacacactaggtattcaataaacatcttagtagatggattacaaaagattaaaagaatgttaccatctcatggataattcaaacagtagctaaaaaaactgaaagctgtaggaaggtattaactgtcaaaaggttggggttaggacgacaaaacttctaacgcaatgcaggacatctgtggatgtgtattctttttttcccctttgcactaaactggacactgtgagtagtttattgtttcatttgtgtatttgctcctacctaccctttaaaacctcttgaacgctatgctttaataagttctataaacttagtttagacataatatttctactaaataatgctatcccaagtagccagtttataatatccttgaattaattttgactgtgcttaacatagcttgggaatggagaagttgagtaaaatattctaatatatcagtctgacttttctccattttaaatctataatattgatttgttttggaaatttcttataaataaagcggtatatttaactttgtagctttattctgaacttgacaaaacatttctagaaaccttttatctagtttttcctaaatagctttctgtggtctctgcccattatcttaaacaaagtctgtctttgagtcagggagaaaagagaaaattattcaacagtctatctaaattagccattatttaatttatctgggtctatacaacttgtaaacagtgataaggaagatcttgtggtgttaaggtgtgtctcatattcacctggtggctatcaattactttcctgtttgaaagtatcagtttgtacaatcattgttctaatctcacttagttcatctcttgctactttatcagggagaactggttatttcaactctgacataggtctagtatttctttcaagggggtgaggggcagagggtaaagagtacactatggcttcacatgtacagtgacagtttgtaagagaaatggaaatagtgacagcccagactcggactctgagcaggaacccttcagtttaggttctacctttctaattagatagacaggacaacttgagcatgcctctcattgtgctgtctttccaggatgatgtgcgtgatactcactaactcaaaacacgcaaccagcatttctgttggtggaaatcctgtacctccttggagggagactcaagacctgcttcttccacaaagcccaacatcattctgttgtgcaaaagtgagccctcttctcccaactcccacgataccctcattgtccgtgtatggcatttgctgttgaggatatatagctcattcagtatacaattacatacaactcatttcctcgatgaatcagaaactctttgagattaaaaagagctcacgtgtttgagcctttgtatgttactggcttttaggttaaacatgtcacattaactctattaatcattggagtattagactataatattaattcattttataatctttatttatagaattatatttatatactactattatatagccgtatttatgatgcatattatatttattacattgctattattatttttatggatgataaaacagtcataagagggtaagtaacatgtctaaggtggtatagtaatgacaaggccagctataaattcagatcttccaactctttaaccttttacaccactctaggcttcatccttatattcaacaaattctgttgaatatagtgtattatcagtaaacatttgagctagtgctagaacttctttaatgtataatgagttggtagaaaatctgtagcttcagattaaaatatgcataagttctgttaaagtaagtgaatatagatatttctaagtatgtttgatacgttcccattatgatatatgcctctttcatttgcttaggcagtgctttgtcagagatggcagactataaattggatcttgaattctgaattactagaataaagattagtgagcattctttttgtgtaatagtagtttttggctgtatccttagccagcaatttttattttttaaaactctttgttttgaaataattatagattcacaggaaatttcaaagataccacagggaggtcccacatactattcacccagtttctttcactggttgagtgttaaatagctataggacaatatcaaaaccagcataaaaatcagaatattggcatctgtataaaatgtgagtatagctcgatgttgttacctgtatagattaatgtcaccattacaatcaagataaggaactattctaccatattctaccatcacaaaaacctccctcgtgccacccctttatagtcatacccacacccagcaccctccaccatccctttttccttgcaatcaacaatcttttctatatctctataattttgtcaattagagtgtgttgtgtaactgaaattatgcagtccatgaccttttgagaatgactttttttttctacttggcataatgtcattgagatatatccaagttgttgcatgtatcaataattcattccctttttctttattgtggtaagaacacttaacatgagatctgtcctcttaacacttttgaacacattttaagtatataatacagcagtattaactattggcataatgctccacagcaggtctctagaactgaattatgttgcataaatgaagaatttatacccattgaatagcaactgcttatttctccctgtccccaactaacagccaccattatactctgtgcttctatgtgtttgagtactttatgtaccttgtgtaagtagaatcttgcagcatttgtcctcttgtaactggcttattttgcataccataatgtctacagttctgtccatgtcattggcaggactttctttttagaggctgcataatattccatggtatgtatatactacatttctttattcattcatctgttggtggacatttagagtgaaatgtccatcatttagagtgaaaaggcagcctggggaatgggataatgggttatatccaaaatatgtaagcaaattctataactcaattgaaaagaaaagaaatcccaagcaatctggtttaaaaagttgtcaaaggacttgaatagatatttctccaaagaaggacctatgaatatggccaacaggtatatgaaaagatgttcaaaataaaaatctcaatgaaatataatctcacaccaagaaaacaaaagataggtgttggcagggatgtggaaaaattggaacttttgtacacttgttggttggaatgtaaaatggtacaggctaccgtgcaaaacagtgaaaactactcaaaaaatgaaaaaatagaaatatgtaatgcagcaaatcatacttctgggtacctatacaaaagaatttaaatcagaatcttgaaaaggtatttgcatttccatattcattgcagcatttttcacaatagtcaaaatgtggaaacaaactcttctaattgttgagtagtgttccatggtgtggatatactctagtttgtttaaccattcacctatcgtggacattctgcttgtttccagtttttggttatcataaataaagctgttatgaacaatcacagataggttttgtgtggacaaaggacagaattttcatttctctgagataaaggcccagggatgtgatctctgggccatatgttaagtgtatctttagttatttggtaaactgtcaaacgattttccagagtagctgtactgctttctactgtcaccagtaatgtataagagatccagtgtttctctatcctcaccagcatttgatattgtcactatttaattcttcggtcattctaataattgtgtagtgatatctcattgtgggtttagtttacatttccctaatggctagtgatgttgaacctttttttgtgtactgatttgccttcagctaaatctttcttaatgtctttaacccattttcaattggcttttgttttctacggttgcattttgagaggtatttttatattctagatgagtcctttgtaagatatacggtttggaaatatttttttctctgtagcttgtcttttcatcctcatttttatttatttaaggtagagatgaatcttttacccaggacaattgttgtggattcaaaaataaaaatattgaatggtgccatgcctgcatgccctctgctctgttagagattcatgggcagaggaaagagtgccatctactgaagcttgggcatcggttctccatgacagcaactgacaagggagggcaaggaacatgctcctttaagatgcggctgagagggccatccaccattcatgtagaaagcatcactcttgcaatttagtggaaaaccacaactgatccctgccaggataagggattgttgttgactttgtacactaagtctcttgaagcattgacaatgaagaaattaaataaaatacatgacattggtacccagctgatttcagatctctctcctgcctcagctttcttcgttccaattaattaaattcttctctctaattaaagcaatacattgctattagctctaggtatatttataacacatgccttgaaatgacatttccaaggaagactgatctaacctttgttttcgaacaagttatttaggttatttatagatttttagctttttaaaatctatgaaacgctcatttcataatattccacatataatgaaaattccttcctttttggaagaaataggtgatgatttactgatgtatcacagctgtattaccatccttttctatacttttttagtgttgcagagactaaatatgcttaaaattacaaaatttgagattggttcacttagatgtatagggtatattattttgaattaccatggagtaggaaatcctagttttctgtatgtgagataagtggtagctttaatatttctggcataaagactcatcagtcattttttggaaaatttaaagtattaattttttgactttagttttataggagtacttaaaatttggtaggtgaacaattagaagtagtaatccccatggactgacaatttgggtgagtttggatacatgtctgggtggcagatttttgaaatgccctaataaataactaaagagaaagccaacaccacattacatgtttggcaaatcagttttctgtgtggtactcttttcccctcaaagtatggcagggaatctgatttcaaaaattaaacatactcagctatgaattccttgcctttttccttactttttttcttttcaagagcctattttactgagaagcagtgtagctgctttcacattcatctgctactactgtggcaaatgtttccaccaaaaatgcttgatattgctatttggagtacccatgaatttaaaggaagtagacataattatacattatttgaatacagatagacgataaatatgatttcaagtttttttttttacatatttaaaaaaagtctgggtaaaaacaaacctgttagaaatatgaagctctgaaacaaaattctaaaaatctgtagtaaatgtattttttccctctgtatttttggattcttaaaatcctcttctttcaaacttttgataaatacaattgaacttttcaataatatcagttttgtgatgtgtttgttttattatctagctttcccccactcccagttttgaaagatttattttcccccaacattttctatgatttttttttcaaaagtaaagcaaagttaaaagaatttcacaggaacacccaaatgcccaacacctatgatatggtttggttctgtgtctgcacccaaatctcatcttgaattgtaatccccacatgttgagggagggacctgtaatccccacctgtcaagggagggaggtgattggatcacagcgatggtttcctccatgctgttctcatgatagtgagttctcatgagatgtggtggttttgtaagtgttgacaattcctccttcactggtcgtcttctctctttcctgccaccttgtgaaaaaggcatttggtgcttctttgccttccgccatgattgtaggtttcctgaggcttcccaaggcatgcagaactgtcagtcaattaaacctctttcctttataaattacctagtcttgggtactatctttatggcagtgtgaaaactgactaatacaacctagattctctctgttaatccatcttatattttgattcattctaaagtaaattgcaaatgtttggcatacaagtcagttacagttcaacattatttatattttatttaaaattttcataacaatagaatgtacatatcttatgtgtacattagctaagatttgaaaaaactgtacaacttagtaacccaaactgttatcaagttatagaacattagcatcactctagaaaattcccttataaccccttcagaatcagtttccttctcccaaaaacaagttagcttgttctagaatttcatataaaaagaattatacagcacacactattttgtgcctggcttatttcactaagcttaatgtttttgagatctattcatgttgtcatatttattgatagtttttttccctttttgttcgtaagcattatctcctggtatgaatatactatgtttgtgctaatgatgggaacctggaattcaaggcttttaatcccagaaaaagactttaagattgtgaaatagcatttcattaaaaactactctttcatcatttgtatacagttatctcttaactgcaattttgaaaactctgacatttgtatgtaaattttataatctagatcaagcttgtccaacctgcagccccaggttgcctttgaatgtggcctaacacaaattagtaaacttttttaaaacactatgagtttttttgcgtttttttttttttttagctgattagtgatcattagtagttagtgtatattacatgtggcccaagacaattcttctgcttccagtgttttccagggaagccaaaagattggacacccctgatttagatctttgtgtatatgtttaacttggttttcttgagcaaaatttttggactctaattattaaccacccttttgaagactacaggagtttctccctatcccgctttgcttttaggaagatcatcttggaaaatgccactgcaaagtctgtgtgttaattctaaattcccgttttttttttttaattaactttagaaaaataaagtcagtgttctatggaacaggttctgtaagggaagtttgtgataatatgcatgggcaagtaggattgacaaatatttttgctaaagctgcttaaacaccacaggttgatgtgtaaatgcataaatttaaagagaggggagagaacaggaaaatagctcttttcaatgattttgaaatttttctgcttattttcttttcctgcaacaacatagtgatttaatcagcattgttaagtgatcagttagcaatgacacataagcaattatattcaaaacctatcagtaacttcattttctgaccatctgacactcaaggttagggaaagttgaacatacataaaaacaatgtattagaaaacacagtgacattatgactaactaaaaccttgccagtatacatttttaggctactaagatcattatgtgggagattgcctttgaacattgttctttaaaagtttgtgcattggtaatgttatctgtagatgggaaatgaatgaagcacaatgtcttaacatcctctcagacaaatttatgtggagaaggaagaaattttgtgatttaaaaatcatgtttctttagtttaataggatgaagaaagcaaacattctatagagtatggcagttgtagaatatatatggtaaaggttgtttggcatttgtttcactgtagtgtcagttaatacatgttatttggaagagcttggaggagataaccagtaaatatccatatacagttccaacaggatgtgcatcccattgcctaaactcacttcaaaaagacctcatgaagttggacactgtccaaagctttcacaggggaacaaaagagatgatcaaatttatagctgctcaaggagaagcaagaagaaaagaatacaatgattttgaaatcctatagaaactttaagtggaaagatgacatcctttgaaaatctgcaaataagagcaataaaattagctttccaagaattagagatttgccccttccctactttctgttttacatttttacataccgtgctcctgcagtgatttgcttttctgtatttgtgtgaactttcacgttttctgtcctttgcttgtgttcttgcctctgattggatgcatctcatgaattcagtcatcttcaaaaccgtgttcaggcatcggttgcacaatcacgccacaatgattactgcttccatttcttcagaattatctatcagtagatttattaagttctctacctcctttctgtatctgctgcacatacttttgttctcacgaatcactgatttttccagtagtattacagctatagtaaccatagtagcagcagcaacaacacttgtataatgccacactgggccagacgtagtgctaagatttttacctgaagtatcttattaaatctcaccatatctttataatttcagtgctattattatgcatagtagtatgtttcattgccccagtggcagtgattctgaattatattctattaatatcttattgaaatgtgtctctaaaaaggacaaattattttatccaatatttcttataaaattacataccaaatactatagacttttttctgatctggtcaagaaatatttaacaaatataccgaaaagttattgatgtgtatatgcagcattacataaagtaagatatctccaaacctgagaataaagtcataaatctagagtatatgtgctcctatactctctgtacctgaaattaggaattctgccactgtttactttctatgccttgaaacaagatcttaaattcttgagcttatgatttgtatagatgatataaactatacaaactaggcctcatctagtaccctctattctttatattgatagtgttatactcaatctgatccaaactggtttttattaccatgggtaatgttagcaggtgtgcttgtaaagaaatgcaagggtcagggcaagggtagtggggtttgtgtgtagggtaaccacggtatagggattttatagggtgtgaagcattgttgaaaaaatgttttgaagtgtctgcttagggaactttgaaaaattttggaagcacatgagtgatttgggatggtacagtttcatgaaaaataaggtaatatttgtaaatatttgtggatatttatgtttttgaacatctctatccatctcatcttgcatctagatacttggttttgctgaacaattggatgttattttataatgatttattcttgatattgtagattttctcaaaatttttgtgtatttggatgtatatatctttagcgtatagttgcaatttttgtcttttagtggtaaaatggattctatttaatttttggagcacgataaagagttgtgatgggaagtgtcctattaatgctcacatttacattaatatcttaatgtgttagactttcttttcaagttcagattttatagtttatgtgtatagagataatataatattctctgatggttggttgtatttctgtggggtcagtgataatatcccacttatcatttctgattgtgtttatttgaatcttcttttcttctttattagtctagatagtggtctattttattaattttttcaaaaaaccagctcctagatatgttgatttttttgaagggttttttatgtctctgtcttcttcagtttagctctgatcttggttatttctgctagctttggggtttgtttgctcttggttctctggttcttttagttgtgatgttagcttgtcaactggagatctttgtagttttttgatgttgacattttagtgctagaaatttccctcttaacactgctttagctgaatcccggagattctggtacagctatctttttctcattagtttcaaaaaatttcttgattcctgccttaatttcattatataccccaaagtcattgtaccgatgggtcttagttctttctttcttttttttttttttgttttttagacagagtctcgctctgtcaccaggctgcagtgcagtggcacgatctcagctcactgcaacctctgcctctcgggttcaagcaattctcctgcctcagcctcccaagtagctgagactacaggcatgcaccaccatgcccagctaatttttgtatttttagtagagatggggtttcaccatgttggccaggatagtctcgatctcttgacctcgtgatctgcgtgcttcagcctcccaaagtgcgggattacaggcatgagccactgtgcccagctgggtcttggttcttaatccagcttgccattctgtgtcttttaattgaggcgtttagcccatttacatttaaggttagtattgttatcctatcatcatggtgctagctgctggttattttgcagactttttaatgtggttgcttcatagtgtcattggtctgtgtacttcagtgtttttttgtagtggctggtaacagtttttcctttccatatttaatgcttccttcaggaatcatgtaaggcagatctggtggtaacaaattccctcagcatttgcttttctgaaaaggatcttatttctcctatgtttatgaagtttagtttggctggatatgaaattatgggttgcaatttttttaagaatgttgaattttaagtttttcattttggagatgaaatgataacattttagacagccctcagtgaaagaagtcttatttatttctactaagtttggaggataaattagaaatttatagtagccagagcaatttgttggaggtggagcctgtggggaggtgactggatcatgggggcagatttcccattaaagagcaccatcccctcgttactatcctcgcaatcatgagatgtcatgaaatctagtcattttaaagtgtgtggcacctccctgttcactctctcttgctcctgctcccaccatgtcagacgccttgctccccttttgccttctgccatgattgtaagtttcctaaggcctcctcagccatgtggaattgtcagtcaattaaacctctttcctttataaattacccagtctcaggcagttctttacagcagcatgagaacagactaatacaggggcactctggctttttgagttttcagtgttcttgcgctgattctttcttatctttgtgggcttatctacctctgatctttgaggttgctgacctttggatggggtatttgtggttttttaaattgttgttgtttgcttttttttcttttagtggtctgcccactcttctgtagggctgctgtggtttgccagagggtctgctccataccctaggtgcctgggttttgccagtacctgcagtctccacacagctctatgtgttgtgcccaaggccctggtggccagggctcacgagacgatctcctgttcctacggttgcagagatccatgggagaagcctggcttcccagggttgcacattcactcactgcttctgttggctgggtgtgggggttcccttggctctgtgtcattcctgggtgggccatcaccccaccctgcttttcattctccgtgggtcaaggtgtttctctaatcagtgtcaatgcaagttcctggatatttcagtattcactcgcaccttttgttcccctcggtgagtgccacgtacagcagctgcttctaatctgccatcttggcctcctcccatattttctttatccatgcatgtgctgatggagtcttagactgattctgtactttggctattgtgaataatgctgcagtgaacatgagagtttggatagttctccaaaatactcatgtcattttctttggatatatacctagcagtgagattgccagatcataaggtagttctattttgaatttttttaggaagctttatactacttagcttggggaatttttaataaagagggtgtattttataattatggtaaatttcaaacatacagaaaaacagagaagaggaaaacatatctatgtaccctatatactactacaaaaatatcaattcctgaccttgcttgttttatgaatatgaaatctgtaccccccaacatccctagattattttgaagcaaacctcagatgtcacatttcattcataaatatttctgtatgtatcgctaaaagatgaggattcttctagaaatagcatcatattttcacatctaaaaacagttaatttaatatcatccattggtaggataaggttcaaatttcaccgattgcctctttttttactttttaaaaatttagctgggcacggtggctcacacctgtaatcccagcattttgggaggccgaggcaggtggatcacctgaggtgaggagtttgaccagtctggccaacatgatgaaaccctgtttctactaaaaatacaaaatttagccaggcatggtggtgcacacctgtagccccagctacttgggagtctgaggcaggagaatcacttgaacccaggaggcagaggttgcagtgagctgagatcatgccactcccctccagcctgggcaacagagcgagactgtgtctcaaaaaaacatatatttttaaacttaatttttaaaaggtttgtgggtacatagtaggtatgtatatttatggggtacatgagatgttttgatacaggcaaatgtgtaatgtgaaacaagcacatgatgaagaatggggtatgcatcccttcaggcacttatccattgagctgtaaacaatacaattacactctttaagttatttttaaatgtacagctattattgactataattaccctatttgctatcaaatagtaggccttattcattctttctaactatttttttgtacctattagccattcccacctccctcctgccctagctccccattatccttccaagcctctagtaaccatccttctattctgtatatccctgagttcaattgttttgatttttagatcccacaaataagtgagaacatgcgatgttggtcttcctgtggctggcctatttcacttaacataatgatctccagttccattcatgttgttgcaaataacaggatctcatatttttatggctgaatagtaccccattgtgtatatataccacattttctttatccattcatctgtttatggatacttaaagttgcttccaaatcttagctattgtaaacatcatttttaaaagaatattcagttttcttgaatcaggatttaaacaaggaccatgcattgcaggtgagtcatgtctcttaattctcatttatatatgagtcttccttcccctcctttttgatcttgcaatttatttgttgaagaaacaggatcatttgtcctctcattctccagagtctgtattttgctggttgtattctatggtgttaacattttttttctgttctacatatttattttaattgatatttagatctagaaacttaaatgtatttttgaggtaatatttcacagctgtttttatgtacctccatcaagaattgcataatatagtttttttcccctgcgatattagtggccatagatgatcatcgcttaggtctattatttcattgggggctcacaagatagtcatattcttccattctttcttcattcattagctagaatagttttataaagagagaaattttcatcaatgattttcctatcctgcgagataggttgtagagcaaaggcaaatttaatacttcatcctttcccttttttactggtttccagaaaaatataggttgatttcccagaatcctcagaggtgactattgagcacctttaaaacattattcacaacacatgaatataccatattttgggggcttatcaattattccctttgctcatgtttccaagttttttagccagtggaagcctcttcaagttgacaggatctcaacagtctttgatggcttctttgcttactgctatgacaaaatctttcaggctcattttgtacttttcctcccccggacgaggatcagctgtttctccttggagctttggtttcttagagtgggaaatggtattttgaggaccatgatctaggtagaaggagtaatcattgttactgggttggtcagtgtgtctaggtcttttcaatgaaacacagctaaataaagattacatatgtatgtcttgaattgatatttccagacaaaatttaggattatttggttttacttgattttctatttgcagactcttctctaatgtatcttcgttcctcaggaattaacatggtgcttttggaaatgttatctgttctttcttaagagaggtagagcactgtttcacaagttttgaggctacatatgttgacaggaagcttcaaattaactctcaatgatggacagacacctgggcagtgctccatgtatcatatcactgtatggaggtgttaaagacacatcctgggatatgtggttcgggcctggctctgccaactaatgagtcacttatttccttgtcgtgtaaaatggggataataataatctacctctcaagctttgtatggaagataatatatgtgaaaatgctttgtaaattattaatgtatcataatagaaatcatttccccatcttattaaaaaataatgtgatagtctttgaaccactatacttttgattagctttttcctcaagatttgtttactcttgtaaggcatatttgtcttttttgttaagttgccaggatagccttcctaattaccttctttaatgggtcttcctctctgtagttaaatgtatatgtttgtaagcctctcttgaggtgaatactctttggcttaaatatttgtttggcttaaatattaattaaatattttaatttaaattaatttatgatgttataggtatagaaaggagaatcaaagtaggggtgtgttttgttttttgtccatcaaagcataaaccttgtttttgatgatgctttatttctgtttccagtgtcatggtgtactgtagacccagagctgtacctctggggagatatataactaatctttcctttgatgggacctaatttcagagcgctgtcttcataacctggaatcaaatgaaaagtccaggtcaggttatccagctagatacaagtgtattgtgtgcttggtgttcctaggctctttattatccttatttggctcacaggcctttctgagctaagactttagaggtcaggtgagtgtgtgtgtgtgtgtgtgtgtgtgtgtgtgtgtgtgcagttattctttttaaattctagaagaacagggtccttttctttcttgatgccatgtttatctacctgaaatctcacaaagcagcagccagcatgtacttcctaactttactggtgtttcctttgtcctgccttcaggagaactgttttagttaccctcctgccatcttgtgctcttatggccctgaatttagccttttctttggtttcacagccttagattattccagcctagctttttttatacttaggcttctttctaacttttcttcccatgtgtcaatgatactttccttaaactcaccctgtactgttttacaactgcattctaccccttccagcaattttagccaaactttgcagttgacagtggcctccttcctgcagcctaggcttctgaaacccctttacagtatcttcatatatagacttatggcgctcattttcattcaccaacaattctgtccctgtaaggagttaaaatcattgttattcttaggtatttctagtatgaaataatagaaccatattctaaaactttggaaaataaacacttaatccctttattctttcatactgttttaatgtgtttttttcccttttgtcttatccccaataatttttgtacaattaatctggagtacatttttggttttttaccctcatatcctcagaaactgaagaggctaccaggagcattttgcatgtcctttcataggatttatcattaatactgaaagacaaaatttaatattttatactctgtaaaagtactaatgtaattaataattaatacatggtacaaatactaatagttttccaagaaagatacattggtcaggcttttttgaagtcttcagttattgtcctactgtcctattgttaacagttaatttccttccaggtttaatatacctccagtttcagtatacctgtagatttaatatacacattcatttaaataatacataatgtctgagatagatgtataacatgtttagctgttcctgtatcagaagtgtactaaattctcatatttttactattgtaaatacttatggtgaaaatttttgtgtacacatatttgttcatattttagattatttctttaaaatcccagaagataactaggttaaagtaacagtatttttagtatttttattactcgtgatttacatttctggatagccttctataaaggctataatagtttatgatacctttagcaaattggttacagcttttttttttttccctctgtcccccttgacctcaatgttcatttctttcttgggggttttagcgtgtccttttagcttcacaacagtatctcttttggaaggcactttggcttgtggagagaagaatgcacagtgtactgcagtggggcataggagagagatgcggaagaggtgtggggcagtggaagaccctgacagaaaggtggtggttgtgaggatggcaaagtcgttctgagatggattttctactttcttacggcattatccctggtaagaaactatctctaagctgcaagaattccagtgtccaatgttaaggaatcaacctgtgactaggttttaaaaacaatgatattggactctcagcaatcaaactatgcgttttcttatacaaaaatggaaaaagcaacaagaaatggtctccagatttataaagaatgggttatgacttgtgtactttactgaagatgttgtaacctggtttcatagttaggaacctactgagtattagccacatatgaaagtagaagtttacaattccccagaaattcattaaagagcctgaattgcttagcaacctcacaaatttattaaagcgatttcatagatatcatcttctactttatgtaacagttactaggtatgtcagtgtttgaaagaatatggtcatgtgcagttaaagaactggagaattgtgatctagcactgcaatgtgctgaattgattttcacacattgtgtattactgatcgctatatatttaaacttgctttagccaagtgtaattttgttatttagagtaaactggacttcggaatggtattgctttcagtcattcgagactatagtaggaacattttatagagtactaataaaaagagacatcttgaatgtaacattaaaccatttcattattttatagactatgccatctgtaagcatgccaagattttggggggaggagggggacttcaaatgactatgcattaattgtacctcatgtttagcatgtattgttttaaatgctttatcataggatatcctataacctgatggaaatgatggcatatagttcgtaacagagtgttttgcagaactttagacccctttgaagctgaaagcattatcctttaattctaggacctattctgcctttgtttcttaggcctttagattcctccatggccaagtatccagccctggcatgggtgcttattaactatgtgtccttgggcaattttttttaactctgctgaggctggctttatgatcagtgagttgtaaatctctgtagatcccagcctgctctcactgacaagttggtacctacagtaccctgggaactgcagctagagtggccagggaatattcagggaaaaagctataggacacagggattggggaaaatgaacagcaaaaatcttttatcttgggagtagaagttgaaggacaacattccaaatataatcttataatccaagtctaattcatataagcatttatagtgaaagatggggcagaacataagatcagattttctaggtattcttattagttaaagaccagaatttctggaacaaaatttctaggaaagtatgatttttgtgaggatgaaaataactattactatcattattaataacttttgttcaggtactaaatatgtaccaggagctagtaaatacttctatataaacaggtgaccctcagtatccatgggttccatatctgtggattcaacgaaatgcagatcgaaaatacttggggaataaatggatggttgtgtctgtactgaacagtgcagacttttttcttgtcattattccctaagcaatagagtataacaactgtttacacagaatttaattgtattttgtattataagtaatctagagatgatttaaaactataggggaagatgtgtgtgggttatatgtaaataccgtgtcactttttatcagggacttgagtatctgtggattttagtgtactagtgggatgcccaatctcctgcagatatttagggacaactatataattaattctgtcaatgactttttaaaagatacatcctattattatcttcatttatcagataaagaaaccattactagaaaggcttggtgatgtattccctgagtggtgcatgtgacataggaacacaggctatctgaatccagggcctgcagttgaactcacaccaagttgtgtatcttctacttgcccttataaatatactcgttgctgggcatggtggctcatgcctataatgttaacactttgggaggccgaggtgggtagattgcttgagcccaggagttcgagaccagcctgggcaacatagggagacctcatctctacaaataattaaaaaattagctggatgtggtggtgcatgcctgtcatcccacatacttgggaggctgatataggagaatcacctctgtgtctgggaggttgagggtgcagtgagcagtgatcgcaccactgcattgcaacctgtgcaacagagtgagaccctgtctcaaaaaaacaaaacagatagactccttgctcttctcttcaccacctatgtccaggagcagtggtgacccttcaggaggcatcagcaggttcccttgccccaaattcctgtcctgttcagctcatgagagatgtcatggcaggagaacataggacaatgggggagagcagtcagagtagtcattgtcctggtgccctccctgtggggttggctgccatgtctttacccagggtcacatctgtcaggaaccctcttcagcattctggtaactgttccctttccttgtcccttcaagccaagggcagagggagtgctaagttcttgtggtgactagacctgagatactgcactgtccctttttgattttgtcaaccttgcctacacttgctgtgaataggtccttcattaacttgccttcagtaacccagatggagtgtgccatctcttcttgcccaggtccctgactgatagaccagctctctcatttagagaaatgtgagtgttttcttacttttttgcagtcagtaaatatttattaagtatccagaaagcatgaggcactgttcttggtgtactagggtcactaatggagcaagagccatgagccctgcctgtgggcagaggggaggaaatttataagtatctatattttatatatatatttactatatataatgtatatttactatgtataatatatttactgtatatataatatatatttactatacacacatatttactgtacatatatatgaaagtatgtatatatttactatattatatgttataatagtatattatatagtattatatattgtatattactatattatatgtacatttatatatatttattctgtcaatgacttttttaaagatacttcctgttattatctttatcagatagagaaaccagtacccgaaaggtctggtgatatatggctggagtaaatatatgtaaatgtatatataataagtatatatatattaaacataaatacatatgtggatgagcaggcatttggttggaacttctaaggactcatacaatttagtgaaaatgtaaaaacaactttgtaaaatgtgttttggggataatgaatagaagtgtctagatggggctaagggctcccgtgaaggactagtgggattagatgagataatgtacttatgttgaaaagtacttggtcttttttttttaatcctgctttttgcaaaacttttgcacctaaattagtgttatatttatagttgttcatgcttgttgtaaataaaaactggaatgaagtagtaataatgcctagagtagtcctttcttgaggggaagctgagtttctttggatatctgtttactctctatgtcaggcctgcagttgtgtttggacacaccatggttgtaattcatactcttggttttagcaacactttcatatgtagttgtcactacgttgtaattacagcaataaaatccattctttgggaactattccagtgtttagaatgctgaaaataagtgtgcttagtaccagttgtcacaatgatttttccaatgctagaatttctaagaaatcagtgtctattgtacttcaaaacaaaactgatgtctaataaaattctccttttagagatggcagctctttgtagaacctgaaaaaggaaactttaaatcaaaaggaatattaaaaaagccttatgttattctatttagaaatattgaaagggaagaaggaataatcaagtatctcagaaaaaaaaatagcctggaggcttcaggatatactttgccttatttagaaattaagttggttctaacataaacctgagggaggagtagtttgtatgtgtgggattggggtcagcccatttgaccctctgattctttctgttttatataggaaaagctatatggaattctacctaagcctgtttctgtttaattatctatgggtgcactggtctctgctacagagtccacttaggctcaggcataatagcacagactgaagccattgggccaaatctggagagaagctgtgtcactagagtatcagcagagcaggcgacactgtgcttgggtaggcttttaccatgctgttcttcacactggaaattggtcagagtgttgctgtttattagctatacctaggaatttaatgatgtatcctttttctagtgatttaaatggacataattgcaggaaaggttggtaattcagcaagaagattacttagaaaacttttagaattggtttcatgatgctagggacatttctgatttctgtccatggtggcataggacatccatatgaagttgtagctatcacaacatgcatcttttaatctggagactgagaaaatattctgcctggtgtgacaaaatggctatcccaatatagccattttgatatgtgatatggtttggcactgtgttcccactcaagtttcatgtcgaattgtaatttccagtgttggaggaggggcctggtgggaggtgattgaatcatggagcagacttcccccttgctgttcttgtattctcacaagacctggttgttggaaagtgtttggcacctctcggccgggcgcggtggctcacacctgtaatcccagcactttgggaggccgaggcgggtggatcacaaggtcaggagaccaagaccaccctggctaacacagtgaaatcccgtctctactaaaaatacaaaaaaattagccaggcgtggtggcaggtgcctgtagtcccagctactcgggaggctgaggcaggagaatcatttgaacccggggggcgcagattgcagtgagccgagatcgcaccaccgcactccagcctgggcgacagagggagactctgtctcacaaaaaaaaaaaaaaaaaaaaatgtttggcacctcccactttgctgtctctctcctgctccaccatgtaaagattgtgcctgcttccccttcaccttctgccatgattgtaagtttcctgaggcctccctagccgtgcctcctgtacagtccgtggatctgtgagtcaaacctcttttttccataaattacccagtctgtaatacagcataattacatcctaactccccattgccttccagggagtctgtcctggacttcatccctcctctccaaactcttgataaacattattttttgaatatcttcataccatctcaaacacatgtctacagtagaactgagtgtctttctacgaatttgactccttagcttgaaggtttaaagcaaacttgtccaacctgtgactcatggggccacatgcaacgcaggacggctttgaatgaggcccaacacagattcgtaaactgtcttaaaacattatgagatttttttgtgatttttttaagctcatcagctattgttagtgttagtatattttatgtgtggctacactgggccacactggaagaagacaattcttcttcttccagtgtggtgcagggaagccaaaagattggacacccctcttataaaggatactagcaattgcctatttattcagattaagaactgcaaattcttctggacatattctccagaaaaagttcatatatgcagtgctttgcataaaattcaggcttgatgactagtccctcctgaagctaacctgagtatacaacatttaaaaagtagaagcctgactgcgaggatgacatcaaaggcccactgtccagtatttcatgtctgtacactggtggatcactacccttaactagtcttccccttctcaagcctcttgtaagaattctttcctttagcaacagcaatttatttattcgttctctgaaggaggcttgttttcctttctccactccattggtaacacatctcatcccatcccatttagaattcttgctgtagttctttttgcccagtgaccttttccaccctttaaaacccagccatgttacacctcctctaaagttgaaattatgcttcctgttatgttttcatggggacacatttctctacatagggactgaaagttccttaaggacaaggacagtcatttattttactactcaaagtgcatggtatacatatcaagcaaatacttttggttgattttgtatgggtgtgtgggtgtctatctttgtgtgtgggtgtgtttgtacctcaaccctgccgaggtgcccattttgctttcatgtgtggtcttggaagtcttttttatgtaccaatatagactcttttattaacatattattactatgttagttgaaagtgaaaaataattccactgaatattttaacaataaaagcaaaatatgtggtctctttcaaaattagaatattttccctagttagagagttagaataatttaaattttaaaatattttaattggatattaatgtatactaatttattaataaaagaaaatgtgtgtggggtcccacaggattattcctaggataaatagacagtttttttccttaagaatatgccacttaaaaatattagaatacactgaatcccaaatgaggtttatggtacatgatatcatgatttatgggaagagttggatctgaatatatttactgtatattcttatgatacttttataaaaaaattcctccccagagagctagagaataaacataaatggcaagtatgaaaaaccttttaaatattgggaaccagtaaatttttttttttgttttagttgctgctttcctaagagagatactcgatgaaagttgttgaccaaagtacatttttaaatcttgggtggtttaggcaggatttatgcagaagtgattttgtctttagattcttaaaagggttctggagagattttatttgatattaaagctgtgagattgtaaatggagaaaagtcattctgtgtgtatttgacagtcacccatatcctgtcactgacgctgagatggaagcaaactgagtattactcacttcattggctctatggtatttacttaactatattaaacaaacactggggaaacctcaggccctctgatataaaatatgcaaatccttaagcatgacaatttattagaaaaagagaaaaataaagtgtgtccattgacagttctgtgcagaatttaggcaatgactcatacatattttgctgattgtttttgtaataaaaattattcaagagaaaaattaatacatttttattttcataagcagttcattaattatgtgaagaaaaaaattttgtttcatgggtttcttaggcaacaatctgtactttggcttaatgtgacatattagttaaggcattttcctgcatattccaactttaggcctcttaaacctttgctcataaatgttactgttcatcagcctgtcagttagctgtcaagttgtggtgtcagctctcttagactcatcatagtagcccattcttgtattagtactttctacctaagtatttcttaaatgatgactgaattattttaatacacaaatatgaagtgaccatataacttcttttggttcactagagccaaatgcatctcactaaacttttaaaagaaggcaatttccaattccaaaagcatcttctgtcatgtcttcctttgcttttttgacatggaagtataatatttttaagataaggtatctggataatcaatgtattttcatggcttactcaatgaattttgtcactagatgtgactgctataacgtgtctctcttccttcttgtctaaggatgctttctacttctagctataatgtgtctctcttccttcttgtctaaggatgctttctggttctagccaaagaacattctggatttattgttttatttggttttgacatatgttctttcaattaaacacatttaaaaataggagatatacagacatgcataaagcatatatactttaaatagaagctataaattataaaatacatacctctgcacttgtattaccacttccctggtgaagaaatggaatgttgcttgcaccccagaagttctcacgtgccactgctgaaacacttttcccttactgcagaggaaagcactatcctgaatgttgtgattattattcctttcttttctttcctacctaatgtaggactctaaacattcagtttagtttttcgtgttttttgaactgtatatgaatgtactcatacagtgttgtgtctgaatgctttcattcagtgtttgtgagattcatccatgtcattgcgtgaagctgtaggttgttagttttcagttataatcattccctcatattaatatattaaacgtgaattatccactctcttgatgaccatttgtgttgtttctaacctggggctattgtgaacagggttgtgatgaatattctgagacataccagtgtgtacatacattatcttccttaatttatagatgagtggatcatagggttatattcattttccacttcccagataatgagaatagttttgcaagttagttgtgccagttcatatttctattatcagagttctggttcttccacatcctagagtatgtttagtattacagctgctcctttataatggggtcacatcctgataaaccaatggtaagttgaaaatatagtaagtaaacaatgcatttaatacacctaacctacagaacatcatagcttagcctaccttaaacactctatgaacacttacattatcctacagttggacgaaattatctattacaaattctattttataataaagtgttgaatatctaacttaagagtattgaaacacataagaccaacctgggaaaagacaaaaattcaagatacaatttctactgaatgcttattgcttttacaccatcgtaaagtcgaagagttttaagttaaaccactgtaagttggagatcatctgtattagttactgcttttgctatttcaatgggtgttcagtggtatctcattgtagttttaattagcattttctggataaccaataaggttgagttcctttctagatgtttattggtcgtttattcttttctgtaaagtattttgtttgtctttttctattgggttgtctgttgttcatttttgttttttgaggcattccttatattctgcatatctgtcctttgttggatacagttttgttatacatgtattttttttaattttgtgccttgctgcattttatgattggaagtttagtctaaatttctcaatttttttgtatgtggtttataccttttgtcttatttgcatatttttttgacatttcattatttctaattcactgaaaaaatgttggattcaggttaagttgtatgtaataagactggaagaaaaatggccatattgcactgtctctaaagtaccctggagtggtacactgtgatcatatgcaatatccaatagtaatttgaagacatattttagaagtataatttaaatgtttttaagggctgcagttctgagagttttctttaagaagaacagggatagaatatgcaatgggtaattaaattccatatatacatgtgctaaattaagttttttggaggagataagagtgccacaatatgatttaaaagctgcaaaacattaaaaagtacaaataatgtaacagaaaggcagaacatctgttacttaaaggagatattaaactttgagtgctaacacaaatgctatgacataattctagagtctacacattattttgccttattttgagtattatatattatgaatattataaatattatgagtataattatactttttaaaggttaatttttgtgtatatttggagaaggtgactacgcaatagtaagactgatcttattaaatgtgtagaaaattatatatctgtagcttcaaaggagttatttttgaggttatgcaagtatttagaaagtactgctgcttctcaaattttgaatgcagttttggaattacattcatgaccatataaataggtacttaatacattggtttatcatgagaatttaatctcatttctttgtgaccataatctatattttaaaaataaaacttattgaggtataatttacacataataaaatgcataaattttaataccttttgagctttaaaatatgtatatactttcatatccaccattagatgcccactggtggtattccattgttggatatatcacatttcagttgtttccagtttttttgccggtatgaataaaggtgttatgaacattcatggacaagtgtatttttagacatgttttgtttctcttgggtaaatacttagtaattcattatgagttgtgggcaagcatatatttagctttaatatataaagctttaaaatatataaatataaatatatattatatattatattatatataatatatttatatttatatatactataatttatatataatatatattatatatataatatatttataatatatatcatataaataatatatatttataatatatatcatataaataatatatatttataatagatatcatataaataatatatatttataatagatatcatataaataatatatatttataatagatatcatataaataatatatatttataatagatatcatataaataatatatatttataatatatatcatataaataatatatatttataatatatatcatataaataatatatatttataatatatatcatataaataatatatatttataatagatatcatataaataatatatatttataatagatatcatataaataatatatatttataatagatatcatataaataatatatatttataatatatatcatataaataatatatatttataatatatatcatataaataatatataaagctttaaaataagacaattttaaatcattgtctacagttcttgcaccatttcatattcccaccagcaatgtatgggcattctggttggtccacatccttgccaacacttgtgttgtcaagtgatgttgaacatgttatttaaagtgtgtgcttgtatcttttgtccattgtgttttttggtttatttgtcatattattgagttttaagagtctattttttatgtattttgagtactaaccttttgtcacactgttttccaaggagaaattgaaaattgttttaatgatagtgtcattggatgtgtgtgtctactttcttccctgttttgtatgcatgagttctaaaccacccatccccacaaaggagtttccttacatttttactctgtatgtgggtgtgtttggaaagatgagaaagaaacatcattattatgcatggtactggtaaacaacaccaccaccaccacccagacacacaaaaaaatggaacagaatagagagcccagaaatagggctgcacacctacaattatgtgatctttgacaaagctgacaaaaacaagcaatggggaaaaaactccctattcaataaatgctgcttggataactggctagccatatgcagaaaattgaaattggacaccttccttaaaccatatacaaaaattaactcaagatggattaaagacttaaatgtaaaatccaaaactataaaaagctggaagacaacctaggcaatactgctctggacttaggaatgggcaaagagttcatcttggagatgccggaggcaattccgattaaagcaaaaattgacaagtgagatctaattaaacttaaaagcttctgcacagcaaaagaaactatcaacagagtaaacagataacctactgaacaggagaaaatatttgaaaactatgcatctgacaaagggctaatatccagtatatataaggaacttaaatttacaagaaaaaaaacccattaaaaagtggacaaaggacatgaacagacacttttcaaaagaagatatacatgcagcaaacaagcatattaaagctcaatatcactgatcaatagaaaaatgcagaacaaaaccacaatgagataccacctcaaacccatccaaatggctattattaaaaagccaaaaataagatgctagtgaggttgtggaaaaaagggaacacttacacattattggtgggactgtaaactggttcaaccattgtggaagacagtgtggcaattcctcaaagagttaaaaacagaatgaccattcaacccagcaatctcattactgggtgtacacctaaaggaatataaatcattctgccataaagacccatgcatgcaaatgttcattgcagcactattcacaacagcaaagacatggaatcaacctaaatgcccatcaataatagactggataaagaaaatgtggtacatatacatcatggaatattatgcagccataaaaagaaatgagatcatgttctttttaggaacatggatggagtaggaggccattttccttagcaaactaacacaggaacagaaaaccaaatactgcatgttctcacttgtaagtgggagctaaatgatgacaactgtatcagtccattttcacattgctatgaagaactacctgagattgggtaattgatgaagaaaagaggtttagttgactcactgttctgcattcttaacaggaagcatgcctgggaggcctcaggactcttatgatcatggtggaaaatgaagggaaggcaagcatatcttaccatgggggagtgagagagagagagagagagaaggaggaagtgccacacactttcagacaaccagatctcaggataactcacacactatcatgagaacagcaagtgggaagtccacctctatgattcagtcacctcccaccaggtctctcccctgacatgggattacaatttgagatgagatttgggtgaggacccagagccaaaccatattattctgccgctgacccctgccaaatctcatgtccttctcacatttcaaaacacaatcatgccttcccaatagtcccccaaagtcttaactcattctagcattaacccaaaagcccaagtccaaagtctcatcagagacaagacaagtcccttccatctataagcctgtaaaatcaaaagcaagttaagttagttacttccaatacaatgggggtacaggcattgggtagatgctcccattccaaatgggagaaattgacccaaagaaaggggctgttggccccatgcaagtccaaaacccagcagggcactcattatatcttaaagctccaaaataatctccgttaactctgtgtctcacatccagggcacactggtgcaagaggtgagttcccatggccttgggcagctctgcccctgtggctctgcaggatacagccccttttgctgctttcatgggcttgtgttgagtgtctgtgactttcctagacacatggtataagctgtcagtggatctgtcattctggggtgtggaggatggtggcccttttctcatagctccactatgcagtgccccagtggggactgtgtatgggggctccaatcctacatttcttccccacactaccccagtagagattctccatgaggtttctgtccctgcagcagacttctgccttaacatccaggcatttccttacattatctgaaatctaggcagaggctcccaaagctcaccttttgccctctgcacacccacaggccaaacaccatgtggaagctgttaaggcttggggcttgcaccctctgaagctatggcccaagctgtaccttggcctcgcagccatggctggaactggagtggctgggatgtggggcaccatgtcccaaggcagcacagaacatctaggccctggacctggcccatgaaatcatctttccctcctaggcctcaggacctgtgatgggaggggctgctgtgaagatctctgaaatgctctggagacattttccccattgtcttggctattaacattaggctcttctttacttatgcaaatttctgcagctttgaatcacccccacccccgaaaatcagtttttcttttctcccacatggccaggcgcaaattttccgaacttcttgctctgcttcctttttaaacataagttacagtttcaggccatctctttgtgaatgcacacgactgtatgcattaggagcagccaggtcacattgtaaatgctttgctgcttagaaatttcttccaccagatatcctcaatcatctctctcaagttcaaagtttctagggcaggggcaaaacatcaccaatctcttcactaaagcatagcaagggtgaccattaccccagttcagaccacctcagcctggacttcattgtccatatcactagcagcattttggtcaaaaccattcaacaagtatctaggaagttccagactttcccacatcttcctgtctctttctgagccctccaaactgttccaacctctgcctgttaccaagttccaaagttgctttcacattgttaggtatttttgtagcagtgctccactaataccaattttctatattagtccatttttacactgctataaagaactacctgagactgggtaatttatgagcaaaagaggtttaattgactcacagttctgcaggcttaacaaggaagcatgaatgggaggactcagggaacttacaaccatggtggaaggtgacagggatgcaagcacatattaccattgtggatcatgagagagtacaagtgaaaggggaagtgctacacagtttcgaacaaccagatctcctgagaactcactcactatcatgacaatagcaggggaagtctgcccccattattcaatcacctcccaccaggcccctctcccgacacatggggattacaattcaagatgagatttggatggggacacagagccaaaccatatcaaaaactcatggacacaaaaaactcatggacacaacagacactgggatcttcttgaaggtggaggttgggaggaaggagaggatcagaaagaataactattgagtactaggattagtacctgggtgatgaaataatctgtaaatgaaaccccaatgacaccaatttacctacataacaaacgtacacctgtacccctgaacctaaaataaaagttaaaattaaaaaaaaaaaaacctagctattatggaaaaaagaaagtcattgtaaccccttctgttagatatacttttaaaacgttaaagtaacttttcacttgtaaatacaatgtgtttttgataaacacctgtcagagcactgtgttgctatatgtggcatccagactcttagcataacctctcatgatctatggcagctttaggtcagtcttaaaaaaaatgttgaaagggccaggcacagtggctcatgcctgtaatcccagcactttgggaggccgaggtgggtggatcacctgaggtcaggagtttgagaccagcctgaccaacaaggtgaaaccccatctctactaaaaatacaaaaattagccaggcatggtagcgggcgcctgtagtcccagctactagggaggctgagacaggagaattgcttgaacccaggaggcggaggttgcagtgagccaagatcatgccactccagtctgggtgatggagcaagactctgtctcaaaaaaaaaaaaaaaaaaaagaagttgaaatattcattcagcattcaaggggacctgatgtctgagattagtttaacctaatgaagcactggtccttaaatttgggaggaaagtttgagagtctgatgacaacgtacactatttccccagatacaaatgtacatttatgaacatgcatatacataaataattttgcatgcaatcatatgagagtctccagtttaaaaacttctgcaataaaaattcctcttgtgtgtcttcattggctactgcatcttcacgtcttattgtgtggtcctctttatctgtgtctcagcaaggaggtgatgtgaggataatcttgcaaaatgtagagtcttagaaaggtgagcttttgcctgagaccccacttcttggttaacttatggtgagtgtgcctgtgttcatctaatacctttcatataaggaaggcaagatgatttatccaggctgaggggggaaacgaagaaaggatcgtgacaacctaatgcaggttcttgaataaaaggggttagtttctaattttgatgtggaaccataaacatgaggatttattcctagtatcatgggtgaatagttgcttctattcccgtgtattcctcactgagctttcttgagtatcatcacagataactctgttacctggtaatgaagaactctgctggggaagtaaatggaatgtggtgatgttgggtttttctgccattttagctgatttgaggagatagtctttctacagataggaagttctcatgccatgagtgatagggcagtgttttttatatccatatagtggattttagtttttcactggaacatggataatgagaaactgtctctaaaaagtatctctgaagttgagatttttggagggacttcttgagggaagtgttttaccaggaactggaacttcattattggtgataagctcttttcctttggagtttttattttgaagcataatactcacttgaataggaataaattctttattttttgtttatttctgggcacagtgcccaggtttttgttggggcaagtttatcctctaaagaaactttcttaaacagtagatgtttcatagtctctggtggaccgagcagactatccagtacattgagagcaggactctttgagacctcctaaaacaagaggatcttgaaatctactgctgtggaacagcagctccaagggagcaacacttgtctcccccagaaatacttagatttgttgctttaagtcttggttgcacacactgggtgatatctgagagtagaagagaaagctcatgactttagagacatgtcatcatttcattggctgcaagtacacatctcttcctgttgattctccccttagttctatagctaaattccttgtccagttaccaataagtatctctttttggaaaactctgtccatttttaagcaacactcctgcattcaaggctacagattgctcagtgcttcagtcagctgatactgctccctaaagttatgcaatatcccaatatccctgcttgaatttccacatagtagctacattcctttctcttcctcagaatcttgcttctctctgatttactctgcttgtctgttctatataagatgcccccatttgttgcctgcattcctggatgcgttttcctcactgctgttacgcaagtgccaaagtcattctaccttgcaaaagttttaagtgcccttccctaatttagaatgttttctgaaattatacttcattcattactattcaacatgtattaagcatgtttatagtgtattaggaattggggaagtggtcctggaggagatcatgacccaggacatactatgtttagttgtcctatgatgtgataagcgctagctgtgtgaacatgtacaatggagacatagaaatgtgtttaaatctgttgtggaggattaaaggaggtcagcatatatatctgaataacaaccacaaacccagtagcttaagtgataatcatttattgttgcctgcaagtccgtgggtcagctgtgctattcttccagttttgactgtgtttactcatttgtccacggttagccacaggctggaaatttgtctcagctgatcttgtctgggccctttcaggtattttggggtgagaaggttgtaggctggtttagaatagatgcagctaagtagacttatctttggtggcttcttctccagcaggctagtctgggccttttctcatagcaaaggaaatgttctaagaagcaagcagaagtgctcaaggctttttgagatctaggctcagaactggcacactattatttctgcagcattctattggccactgcaaatcacaaagccagccaacattcagagggaatggaaatagacttcaccttttgatgagaagtgctgcagagttgcatggcaaaggctgtagatacatggtgggaaataacttggaccattttttataatcgatctacgattgcacctttaattgataatcagacttcctgaagtagaaaagtcagtagaaggcattgaatacagatatatggaaggtttacatgatagaaaacaaacaaacaaacaaacaaacaaacatgtatgggcagtatgagcaacttaattccaaagttattcctggtatgataacttgttttagtgtcattttccaatctacttcactgtttacagtcttaaagtttaggggtaaggagactattttaggccaattccttataaattaagaaacacctagaaatgttgagagccacccagtccttaaatcacattcttgacagaagtggaactattactatgaactcagatctcctcttttcatggtactcttcataagcactgtccatgtttccagttttacatttttgaaaggtaggcatgtttcatgtgttatttcttaatgtgacctaccttctacattctaaatattttttcacagtatctgtcactgtgggctcatcagaaagacttgtgcaaatagtgagagcaaatgcctaaaccctcatgtaccaccttgtcctcatgttgagattttaataagctttaaatgatttggaatagaagcagctcctgtgttatttcacttttgtctgtgcctttgtgttctaggcacagttgtaatgttctgaagtcacaatctgagccattaagagtaagatcatgatgtctctggatacccagagtgagtgccttggtcttatttgtaattttagaactgctgcttcttggggacctgggtcaagtgattgtattagactttgaagagttctaggccatactgtttgatgcacagattccatcccactgtcgtatcactttcttctcttcacaggaacatagcaagatctggaggagaaagagaggaaactactccagctgtgttctttatcatctcacacttgttcatacttaaccatacattaagaattgtgagctgggcacagtgactcactcctgtaatcccagcactttgggaagccaaggcaggaggatttttgagctcaacctaggtaacatagtgaaacctcatctctaccaaaagaaaacatagctgggtgtggtgttgtgtacctgtggtcccagctacttgggagactgaggtcaaaggattacttgagcccaagatgttgaggctgcagtgagctatgattgcatcattgcactccagcatggatgacagaggtgagaccctgtctaaaaaaaaaattttttttttgattcatatcttaattcctgctagagaaaccaaggcaagatgaagagaactgggactgaattcttagctttatgaaggctgtgtgcttaattattcttaaagcttggcttatacaagccatacgttttcaggtaatcctataaaacaaatgaaagcacaatcatccacatacctatgaatatttgaatattatatttagaacaaatagcaaaatgaattgaaatacttctttacttaattttaaatagtatgtatgatcataatttttctccattacattattttaatgatgtactttagtaaaccatggttgcatgcaagtgaaacttgagattttcaaaatactccttaattcttaaaaaaagtaagaacttttttagtaatatgtatacacatttgatcttcatatattctatagtttatgggtgttcaagtatttactgacactcttagctgcaaagccctgtgctagaagctgtaaatgagatgattgtgacttagacatgatctaagcctatcaggtcaagaaagacaaatgtgcagctattataaaggctctactatggcagataatttttctaattgctagatgacattaattttccattttgcatttgggatatgctagaattttatattttcacctttattcaaagacactttgaagactaaaagttaaaaaaaaaatctatcttattagatccttcaagtcaaactattgcccaagggaacaggtggagtgagttgctttacatagtaagttaggattgagtactaggcatggagttggtttatacattttcttctgtgttcttatagatataaacttttcaccttattggattcttcagcttaaaaaaatacaaaaggattattaactattgcccttaagtgttaaaaacgtctcttggtcttagtaaataagtagcctgaactaaagatcctaggaaagattgtcttcattgtttgcagccatcatgcaagacatatgcctcttgcaaaaattggtgaccattcactttgtcagttacctcaaagctgaggaatgaccgaaggcaaaaagtgtataacctctagaacaggcattcaacaaattattttttttttcttttccaaaccttgtaggacttaacacaggttatttaccatatagatgttgttttcattgctagatttctagaaaatatgtgaaaagctcaaataacttcatttctattgtgtcagcttctaatattaataaaaattttactctagatccaacaaaagtcctaacttttatttccagggtacaatctgctattaccaatgtgtctgagtatttttactctttcataataacctatgccaataaatagtcaagtgtccaatcaatccccatcatcgttgcagacatttaaaagctcatgtagatattaaaatgcattatctcggttccatttctttggaggtctatacagcaaatatctttgtccttgaaaatgtaagtagccaggccagctatcacattgttccaggtgttttagcattccctagctatagtagcagtctagataggctgatctcagaaaatgctaactcctcaatttgcattcttagatgtgttactgctgtactgaatgttatcagatactcttgacctaaagagtaatcaatagcagagattttagttttctaggttggaagaaccttggtaattttgacataattgaacaattgtgttgttttccctaacgttcatctttggcttccagtgatagccccaaagaagtaatttctttctgtattctgaacctgtattttaggtatctggccccattgagagatgcgccaagatattcttgtgtgacacagctagataggctaggggtttctaactcaaccatcaatggagctggacagggaaatcaaattccctgaatgaggtgggctgaatgaaggcaagaaggaatggtgataggtggccaagtggagggtacacaagtgtgtgagttgtgtatatagcatcgtggctcagatccagttgattaccattacactggaatgcaggcccacttttgaaagattacatgtttcccccacatcatcccaagaggagctagtcagattttgatgcagaatttcccacctttaacatactgtgcaactaaagaaaacacttctgtatgtcaggatgtggttggcactgtgatccaggcttccctatccatgaatggtgacatctgagaccattttatcatcatcttaagtactttcatacattatttaacagcagcattgaaataacattaatctgtctttataaacaatggatgctatttacaaaaattatgatacaactacctaggtcaaagccaaggttccttttgatgctaaacataaagttgcaactattactatttacagtaattctagcattaatgccattctctaagattggaagactttgagccaaacttattttcagtctacatggggacctcagaggaaaacacccctacagataattcacctcaacctcagatgtccaggcaagacgaacagaggtgtgaagtgctggttgatagctctcagtgaggcctccagataatgtatttctttttcatctgcttcccttggggaagaagctattccacaaatgtttattgagtatagaaccttctgaattataaattttcatcccttctgttgtgtcccttgctctgaagtttttctccttcaatcaatagtttccatttcaaccatgtttattattgcaattaaccacctccttctaactgctttttgcaatgttttataaaagcaaccaccagatacttccaagtatcctaaagaaaattgtcctcccgactccagccccagctattaaacatttaaaacaaatgaagttatttattgagtacctatagtttgccagggaatatgctaagttgcggggtgtggtggcctatgaaaatataagacatagaaatgtatgatcttttaaaaagttgctaatatactgttctgtcaatactgtctctggaaggagttcagataatgtataataaatcattagtggaccaggccaacatctagttaagcactaatcttggttccaaaaggttacagaagtatatttctgaagtgactcccatactaaattttgatcctttaaagaagttactactcttcctatttggtgatttatcccccctctgtgaaattatttttttgtttttcatttccttttaggaacagaactcattaattgctactaatagcaattgtgtgatgtttttaattcctaaagaaaggtgctatgaaaatctagttgatcttaacatgagtttaattttaaagtattaatgtatagaacatgcagtgtggctttgtgagttatgccaaaaatgaagccattaattcccaagttgagtttaaacccaaattttctttcattgcagtgcctggatacctgtgtattggatgagcagttgagtactgatgctttccccagggagcactgccagtgacttgccctacaagtcaggcctccttttaagtcaggcctagtagtgagcagtgattcttcctagtaacaactgatagattgagggacatttttgaagcactcaattcctcagtttcttttccattatacttttttgttaaattaggaacaggtagtaacccttcctctttccccatctcaaacccaaaagaatgtccccaggaagattacccagtgacattcacagtaaaggtgaataaatgttagtgtgaatccacaaggctggtgttaacggtttttcccttcccctttgcttgtgtttcccacctgctgaataagaatacctgaagaagtgtcaagaagatgctgctgttgaaggccttggagtccccgagatgcaacttactttcccctttaaaatatctaaacaagacatttaatattgaaaccaagtacctcatgaccagaggcagaatgagccacaatattcaggaaccatttcctcatctccatctggaatacagtactctgctataggggttttcaaacttttgttcacaggacctctttgctgtcttaactccttgagaacccaaatgagcttaagtatatgtggcttatatttatcaatattttggattagatattataactaagggattctaaattatttaacaaatttatttaaaaataaacccattacatgttgatgaaataatatatttttatgagaaaataactatcttctaagaacaaaaatctttactgaaaaaagtattgttttacattttcacagatttctttagtgtctgatttaagggaagacagctggattcttatatctccttctgcattcaatctgttgtgcctattttggtttatgtagaaactgggcctcatacaaatatgtagctggaaaagaaaggatcattttaatactcttttcaggtaattttgggtattcttctctaatactgtactaaaacttgacaaatggtagtttcttaaggatttcttacaagggagaaaatgaaacaatatcaatgaactttctgtactgtaaaatacactggtctatcttgcattttgaatggaactgttatccacacgtgattttgtaacatcatacatttgtcccttggaaaatattcatagattgagttatgcagatcttccaaatagtgacagattttattatttgttatcaaaatcattgcatttattaatattaccactgatcttatcagaaaggttcttcagtactgggaagctgtcaagctcatggtggcaaatacaagttggcaaaaattctaattttcctttgaaagctggaattttattattggcaacagatacagtgagttttcattgaagtaatgggcttactttatatattttcaagaaaatctttgccaaataaccagtctggaaaaccatcatctgcctttcagtcattcattcaaataaaaaaatggtgttccatgaaaacagcaggtggttcagcttgcaacataatcacacaagttctttttctttgcagaaccatcatacatcagaagtgcttcatgtgtacttcctattttgtcacatagaatattaaagatacgtaagttcaagggttgaggtttaataacatttataattgttattgcttggttacagaccttgagtgaaactgcctgttgtttatgttttgaactggtactgggtagtggtaaaaaacaaaatgactattcatatagttgggtgcctctgccattattcatgctaagacaccagcagtttgacccgccatcagtccaaatggcaacacagtaaataaggccaataacatgatagaattattatggaaatagctttgaccttttggacttgagacccccaagagtctgtggaccaactttaaaaactgctgttctattacatattttccaaatgcctggtttgcattatcagatttactctcatactgtaaccccattatacttcatcaagaagtggggctatgctacctttcctcccttatccaaacaccaaaactaaccatataggtatctttacatttgccacattttagtaattccttatcccagttcgccatgacgaacatgtagacatgagcttaatccaagctgtaaccatggttactgttttccccaggctggccctacttgttgggccacagctggctcgtacctgctgtcttgcccattgctgcccaccctgccattctcatgtgagctagcctcggcttcctgaggttccctatgaggtatcctgagctctgcatggacacatccttctactgaattttagtgccatgacagtgagaatatcacccgcatcccttagttgcagtgtcagtgcttaaaggtatttgctgaacttacaatcatattgggaaatgtgagtattaaagtcaaaacacttctggaacctaaactcatacctattgtactgatttttaccagataaaggaaatgatgacacttattagttggcttggattttaaaatataaagatcgtattgaaggtagatggataggaggtgaagtatttgaaatgcggcattggacctgggcttacaaactccaggtgtgattcctcctcttaccagctctttcaccttctgtgaggtgagctacctctttgagccttatttttcttgtctgtaggagagtgttaatatttacccgtaagtgttgtagggaagattaatctcgttttgtagatagcagctaccatactgtgtggacatagtagataactattttaaaaatcataatttataaatttggtaattagacatttacagatctgatttcagctgtcatatacggttgcattattatagtgtgaattcatgcccccatgattttaaaaagtggtgtttttggcatgtgtgcattcgctgaagttgtaaaacacattttttaagtgtacaagtaatggacagcagatgagaaacagattgcaaaaactcttttcagtatccaaacatgacagtaaactcatattgttcaaagaatagggcccttaattgggtgggatttttatttgatttatgacctgaggctaatactgtggcttggatatgttctaaccccatgactgtctaatagcttacatatatgttgggtagtaatgccagtggataggttttattctgagaaccttcattcttaactcaaatctcaaaaatagatgacaaggcagaaaatatttggggtgataagattgaatatggaatagagcatcaattgcttgctctcagatactagtcttttttgtttttcaagtaatggagaaaccatatattattttcatctgggagtgtctgttgtgtttgcatgcaccagatgagctggagaagttgtggcctgcaagtaacataaagcaaataaaatttttgccagacggggcataactaaatgcttaccaccctccctgaaagttagttacgttttgatcattggtctgctatattgaatgctgatttttttttccagtttgacatgatagtaagtgacattgcattgtataaaaaggatatttttatttacacacacttaaaaatggatcctgggttttaaggaaatttccttttaagcacattttggctctggtaaaatctattctgaagaacttataggcaaatagcttttgagaatttggactcattagcagggcttatttctttggctatatttcctgataatagttttctgtaagctatgtgaatgtcagagagcagaaatagtcagaatttttcttctgagctcattagtgaatgcatacaggatgaggtagcctgaaacagtttgaggtataatcagtgtcttctcactctctccttttctttcatctcattctttaccatgtttgttgggcattagtttaaaagcctagcatttaataggaactttggcatatgtaaatattttctaggttcagttttagcaaatccgttgctctcatgaagactgtagagaaaatgtttgtactgatttaggaatgttaagaatgtggtggggagtggctcttcagaatactgcagtgtggtaatcatgtttgtggctatgattttcttgtttttgtttttttttttgtctttgttctttcatctcagcttttcaaaatctttagaaaatataagatattcccattttagggtttagaaaatgactcaaatatatgcatatagttgtgaaaggtgttgagatagcctcaaataataagctatatcttttgaccatattataggtggggtctctgcctgggaatgacccaccctcaagctgtttggctcctgttaaaaggactagaagggctctgccagaggaacaaggatgctcttcctggtgtggctcttctgtggcatctggttcagggctgtggtcccactcccaatggcagattttcttattttagagggagtgagtcacattcctcaaccagtggatgaaaaattccagccattccaattatccacgcctatgatcccttctgttttacacagatcattgagtcccaactcactagaccaagactcagggaaatcatgctatgatcttggctgtgccattggccaattttgtgacctcagggagtgtgtaaaatctgggtctcaatttcctcatctgtaaaatgaagtaattagaagaaaggccctttttgatgacacagtctgtgacctctaactggtaatttttataagtattctcacaagaaagctgtggttgcaagaaactagaaattagtgggataaatgagatctaacataggcatcgattagcgtacttcttaccaagttttagagggctccaaggaatatcttgggctgtatatgtgatatagcaaactttaaagagtttgtgactgtgacattgtcctctcacagagtataaagctgttcagtaactatttatggaatgatgaatgagtttgcctgatgcctactggtatgaattttccttcttgaacttactctggtactaaccattctttgtctgaatatgatgatcttttccatgcagcagtcaccagtagtaatggacttgactgcctgtggagcccaggcaatctttataatgatggattgggctctcaagtgggggagtaaagcattttaagttgatgaagacattgcccctgctcttgagaaagaaacaaataagcaactaatcatagaggcaaaatgaaataatagatgtaatcaaaatgtgaacaaggtaatggtgggtgcgatggaataataaattaattctaattggagaactgaggaaggattcatatgtgagatgaagagtcatgaaggttggacctagagagatactctctaatattaaactagagagggaaaaataaaaggtaatttcagcaaaggagaagggctttttggattaaagcagtagtaggactccaaatatgtcactataggaagggcatggaatatttggagaaaagtgagtcgatgtagagaaaccaataggtggctattgctgtagtgagagcaagagatgatggttaacttggcccagagagtagttgtaagagtgaagggaagtgaacagcttgagatagatttagaagataaagtcaatagaatttgtcgatggatatcataaggggggttatagagaggggtatagatgaatcctagaattttggctcacacaagtgggaaactatcaccatttgctatgaaaaaaaaacacctaaggtgtagaatgccatgcactcagttttgggcatgtaggtttaggcatctatgttgagatgtaaggttggagccctcagtaataagtcatggtagaaatgtgtttgggagccatccaggttaaagtcctagcggtagatgagcttactggagagaaaacagagatatggaaaagtagagtcatgtatctaggactgagtgaacattgagggatttggatgtaaaggctgagcagaagatgctgattgacaaaggaaactgagaactggacatatgcattgaatggtgtgaatataagggagacagcttatgtccggatacccatctgggagagaggatgaggaaatgctgagtaggccatggtaaggcaagagaatggcagaaagacttaatcatgggtgttataaaaattacttaggagtggtcttaaaattactggggatatttctctttgattagagttcactaggctggaatcttcataaaagcaggggctgtgttcccttgttcattactgtaactgcagcaagctcagtgcctctgcatagaaatcacccaatacatgatgttggcaaatgctcaaatatttgttttttttaaactcaatttttttaccttaaatatttttttttacctcaaattcctcagatatcatgtgttttccttgactctgaatattacctccatgcatataacttaccaatgtgtatgtcctaggtctgacctctcttctgagttccagtcccagatttttagctgcctgttagacttctttacctggatcacttggaggcatctcacattcaattaaggcaaatactgaacttgactcacattttccaccttcccattctgtcactcatgctttcttctttgttacagatcttataatggactctcttctagtctaattttttgtgtgcatgtgaatgtgtgtgcttgtgtgtgtgagagcctctgccttccatgggggagtcacaaatagtgaaaaaggcagtcacacatagtgagaaaaggcagcgctttcatagaatctttatattcccactatgccttatgctgtgcctttcatgtagtcacactaaataacagtttggtttaaatcagggtttgttaacaagccatataaatttttggactctgccttttagcatgtgaaagacttgtgaagatttcaaagacaaataagaaaaagtatgcctaacgaggtgtatatataaagagagttaaaacattggtgattcttgtatggacagaagaaagcaggggatcatttgataataaacctacatttctgttgtggaaggaggtgtaaataaatgaaaagccttctttcaagtctatgaagtcttatttactgtggaggcattctaatcatttccccaatctgaaaggactgaataagcaggagagagaggagagagttggtctggaaatattttccccatggtgagcatagctctaaaggtcaatggatggactgatgcagtcagctggtgacacttgaatggccttacccagctggcatctgttctgattgattagcgcttctgtgctttagattagaagttattattgaaatatgtgtttggctcactttgaattcttattgactcagttagtttacgtttcatttcaattctagattttccatctctgtttcatacctctgttgtctcatggactgtttaaaaactaatgctttccttgagtaagattctccagaatgtcaggcccagaagttgaatttgactcaacgtttcctgaagattggacttctaaattaacactaaaagtttccgaagatatgttttttagttacgtcatcagcttaatttgtaacccttttcattccaaatacatctctgaggtaagtcttctagcacactgacttttatttacatttaattcggaatattcttagtgctgttaagacacctttttcataaaaaagacaatacattccgtccttatggttggcagagtaacaccatctgaaagatgtctacttcctagtccctagaacatttgtatatgtgatgttacatgacaaatgagaattaaggtaacatatgaaattaagattggtcagtttactttaagctagagagattaacctggtgggctcagtgtaatcacaggggtctttatttgtggaagagggaagcaggagagaaggtcagacttgactggccatttatggttttgaagttggaagggaccaaagagctaaagaatgtgggcaacctcttcagaaggtagaaaaagcaagttaatgaatcctcccttggagcctccagaaaggaattcaggtccactcacatcttgatgttcacctagtaagatccacgcctgacttcaggcctgcagaattagaagataataaatcagtgttattgcagtccactaagttggtaggtaatttgtaaccggagaaataggaaaccagtagaacccttctttatttcagtttggtgatatgaatgtgttgcttcttacattctagataccaggcatttataatttttcctagaagagttagcctatttttactttataggatcaagggcaaccatgtttactttcataaggagtaattttttttacctatacaaaattggataatttgttttgctattgaatgtgattatatccacttttatcaatatataattattatctaagtacattttggcataactcactatatattttatataaagtcacctcttataacttgcataacagtaacccaacatgcttttgagctgtaaaaaggagaatatgttcgaacattcttgtttgaatggtttagtagttacgacattggcattgttaggaatgacaaatagtcatttcctatttggtttatcagggaacactatttccttggttgcaataaatgtccatactgtctattggttttcaacttttggaatcaaattatagagaaagtatggttatcattacagaaaagaatgtaaatatttgcaacttcagtagcataaaagtaaaggtagagccgacagaaatgggaagggaaggggtggaaggtgaggaaaagagtaagggctgccaagtcctcttttactccgaggaatgaagagatgctgttttagatgacagaataaacatagtcatttattaaagataaaggtaaccactaaagggaataaaaatatttgaataactctattaatggaaaggatggaaaagttgggggactctaaattcactaagttcccatgaatgatttcagaaagtcaaaagatgattctgaagttgaacggttgggacagtcagaaatgcttattatttagagaaaaggtgttaaaattcaaaaagactaaaagatctaaaagagttgcctctggagaatacagaactgggccactcttctgtaccatttaattttttaaaatcaaagtaatgcttacacatggtttaaagaagggttggcaaagttatctgtaaagatctagaaagtaaatattttagcctttgcaagccacatgacctctgttgcagctgctcaactctgagtttggctgtgttcccttttatctttatttacaaaagcagtgataggtaggatttggcccatgggtcacagtttgccaattcgtttatagggtcaaatagtgctaaaaggcccatgacaaaaacagtggtccaatggccccctgccgcccaaaccacttctaagaagcagtcactccaaacccttcactctaaaccccacaggttttttctatttttctccataattctaataatgtatgaatcaagggataccagtgtgcttttatgtctaaatatgaatttactgctattccttggttcatcaattttagacattttctgtttacatctgattaaggtagttgaaaatactagctattttatagctataactcaagctatacgtttttttctccttgtttcctaaaattattgttaggctatttggttaaatgcatattcagtgtttttactgttatgagaatgcagctattgttacttttgagcccataactatggttgccttttgtctcgtgcaaacttttggttttactggagttaatgactttatttgcttagttttcattgaatctcatgctttttttccgttctttttaatagttatgtaaaatgtctcttactgcaatcttccactgagttaaaaccatcaaaaatctattgattttggactttttcctaggaacattgctcctggagcccttcttcattgtcctgatcacatcaggattggtttttctctaagccttgcatggttatgttaattgctgtcaccgtttatctgagaattcccttcccatctcttgtgtgttgggtcctctgttccctgggtccctcattttggtggagcacattcgtctaatcacctgtcaggagtgactgggaggagggttgagtgtaagcctggtttttactttgctggcgttggatagagtagcaaggttggcatgtgacccccagtctttagtctgtagccttttacattcagcccttctctgtgcctgatgtcttagagtctggatcttgctctttttcagtttctccagagataatatctcttgcctctcgatgagtgagatggtggggggcacctacctaggagtgttatccttccttaaagaatttgtcaggcagcttttgttcaccattttcagcccccaccttcgtctacttttcatgatacctggggtctccagaccctgtcgaagtagataggcttgtgtttcatgctagctctcttcattggcaggaacttggatttgaccttcttcccctctgagaagtcattacttccttgtctttccttttcctgtctgcatgttgtgatttgagttacagatatctgctacttccatgaagatagagtttatggttttgtttcttaatttccttgtttggggatgattttcagagaaggaatgagattgtcgtaatgactgtaactgtggatgtgtgttagctgataatttttaaaattaaaatatttctgtatctgcagttttcaaaacaataaagatgaaacttattttctttcaccagctaaaataaagacccacagtcatctcagctttggggttatattaatatgtatgcatgaatgaatatattcaaatatatatgtgcatgtatgcaactgatagtgtaatataatcgtcggaaaacttttcctcaacattttgattatttttctataatttttagcatctttctttataaggtgaatttttagcttaatattgtgttgttgtttacttcttacacaattggcattcctgcttggggcttccctcccactgtatttataacttagtagtgtaataatggtataatgatacatcattgtaggcaatactacattgtttttcatgtcttcatctaccttctcattcgcattcctgaagtagataaggtgttacacccaagggaagctgttagcttttattagcaggctattttctgaaaagttttagctaattgtttttggagtttggcttgccttttcccatgtaaagaatatttaaatgaaaatttgtattgtctgcacaggcttttcatatgtcaacattttgattaatgtcaatgaatgtgtcagttaattatgaatcttagctaaggcactggacatgaagggcagatggccagtgtatccagaaattctcaaactgtttgtgatagaggaccagattgttttgtttgttcatctatggcaaacagatacttttataaaatacaaaatcatgtgcatgaatatagcaataaaaattgctataaattttaaaaaatgcttactcccaatttttgtatttttgttgcaaatgaaaaacaaacagtttcatggaatgcattagcctacagactacattttgatccaggcataggaaaaaaattgggaagagcgtttcttcccaaatttttgacgtgtgaaaaacttgcctaccattctggtgcttctctttctgggccttttgctcacttcctgctgattttattctttcccaagcccagagggtctctttgccctcctaactgctcattagcttctagttttgaagaattatgcagagtagtaataatcacaggcgctgtttattgcacatctattgtaagaagagtgcagtgtcagatgctgggattacagtggcatacacatcagaaatggcgctgcctttggaatgtaagagtctgttgtcaagaaagaaaatatatgtatgtatatgtatgcccgtgtatgtgaatgtatgtgaatatgtaatgaatttctcacaatccagtgagggtagaggatattgttcccatttatgagtggtaaattttgaatttcagcctagtcttactttaaagctcatactttttccacgaagcattttggggagtatgctgaattatcctatttatgtggcacatgcccagccaatcctgctgtgctgtacatcagcagtttggaaaaaccatctgagatgcaaataacatgtaagtcccttcttcttcctttctagaagtattttcttttaaaagaaaaggtacctttaaacatatttaatgctgatgtaaaaagtagtagaattttatttcattttgtagagtggaataaaaaatttactcagtgtggtgcaagatactcttggcaagggtagagaggtggttactaccacttggtgtttttgcatctccaccaagtttattcaacctgacaagcgaactagttttcccactctcatataagggttgcttttctgagctttgacttattttacaaatgactgcaatgagacttgccctggggcacagccatttgttagaagacctggctccccacctccagtctgccactgacttgcctcaagtctgtgctcaaatgccactttttcatggaggccgggcctgaccccttatttaaaaatacaaactgcctgtactccccatcctcctcatcctactgtattttatctctcaaattgcttatcacttactaacatatcattaattcacgtatgtattttgtttgttaattattgtcttctcccttcactaaaatttaagctttattccttccaagagctggatttttattctcttttttcttagatgttgcaagaactcaacacatgttgcagaaaggactgccattgacctgcagtctacagtgtttctgcttctcccatgctgcccttgtctatatcaaaagatctaagtctcaagatttgagcttttactcagtatcaataaaatggctttctctgttataccctgagcccgtccccctactttcttactcctttctgtttctcattgtcttcatttgtatgacaaatgcataatgaatgtcagaagtagtgctggggatatggaagtgagtaagataaatgaggtttctgaatcatggtgcttatgttctagttggggcagactaagccataaaattaacaaataattgaataaaataaggataacatgatattgataatttatgatacttccagggaatcagcgttagttaggtcgagaaatttctctctgagtaggggatacttgaggttagctcttcctgctttcttctctgcattctctgtattctttttagctatacctgtgatccctctgcagcattctggaggaatgaagttgttagagaaacgcagctaacagtagcaggtagtattatccccaatcctttttgaagatcagaggcaaataatcccttactattcctattactgccacactgaaaagaagttttataaacagtgtgggaggggggtgggtgttggcgggaggtaggtggttgcagtaaagtggatgaggtctttatgtttgtcttagagttagtttattaaagttaacttattttataaacacggccgccagtacctcttctgcaataaattaaaattctcctttctgtgtcttaatctcttctttgattgatccataaaactgtgttcaagtgaagagctaagggccattattgttacctgtaaaatgctttaaaccttactcagtcattcatatacacaaagatacacacaactggtagacactatctgtcgaaagtattctttggagttagcatacaaagatgccaacgttatagcaccaagaaagtttgaattggagatattaagtaaactgtgagttgtacaaatttgcattctcaaatttattcttattaaaattcattttgtagcagaatgttttttagggctttataatggaagaattattctaaaaattaatagcttgctcttctctttggagagatggctccttccactttttaggtgtaggctttgaattcctctggaccacacaagtttctaaaaccttggcatccagggctttggactataaaatttcattggaaacaaataatggaaaacaggatttttaaaaaatcagctgttttctttaaaattactttgagtcattgtttttcaatattattaaattagtaatggttcagtgttttacgtctttcatactgagaattgtttttaaatggattaaatccatttaatctgcttaagtatatttgcatcaattatgcattaaatatctttaattttttttaatttcagacttttaacgtttaattttcctgatataacttcagttttgtgattatactgtatataaacctgaagagttacataaggcctatactttcatgcatttaagagtgagcctttaactcactcctagagctgtaggaaaatgaaatttctatattcttataaagtcagtgtcttgagatgatgtagacagtacatttggaaataattaaaatttgttctttattaaaaaaaagctctatctagatctggaccttttcttctcaaataaatttagattaatcctaaaatgaaaaatgaacctctaaagccctttatataaagaaaaccgctgagattatagttacttcacaaagctgaatgaaagtgacatgggttaattaacattcctttaaatatttagctgatatatgaactaggaagtgaaatatatgtctcaatacttaaatatttttctatttgaaaaagggaataagtaatattattaaaacttagattatgagatactgtagaaacaaattccctggaattgttggtgcttttatattgcaattattttgtttagaattatacatcagaagaaaacaactattaataccttttctatggcttaacctttgttaagccatactggtttatacataatggtttatactggttccctgtctttaaaataagaggcctattctcggtggtctctgagccaatgaattccttccagtctttgaacttataaatttactagtcaaggcttgaaaattccaagtattttttttggggcggggggtggtaatgaggggaaggtgggaggagaactattttagagtgagaaaacagcctattcaaaaataatgttcaaatcaatataaaattctcaggcttttttttcccccctaccaagagtatttcttttaccttggagatgaaagacctttttcttaaatttgttcataaattaatgaattttcaggctacatggcaagacattggaataacgggtagattggggaattcaaaatatgatgttttgttgaatagactttctgcttggggatgcacagtaacaggggaatcctgcagaattgccgaatctattattcctaccctacagcagagatttcctctttcaagagctcaaagccctaaggatctttgaggttctaggtgctgtaggtctgagagttggaagggatcttcaggatcacagaagttccacgtcttatcctgtagcatccttgagatacggctatctagcctttgcttcactcttgaaagatgtagagagctcatgtttttaccatacatcccattctactctatgattgttttttttttttttttttttggagacagagtcttgctctgtcacccaggctggagtgcagtggtgcaatctcggctcactgcaacctccacctcctggattcaagcaattctcctgcctcagcctcctgagtagctgggattacaggcacgtgccaccacgcccagctaatttttatatttttagtagagacagggtttcaccatgttggtcagggtggtctcaaactcctgacgtcgtgatccacccacctcggcctcccaaagtgctgggattacaggcgtgagccaccgcacccggccaagattgttctttttgaaggatctttcttacgctgagtttctacctctctatcgtctatgtatcatttctagaacagcacagaaaaagccaaatctctcttttatgtggaaggcttttagttggattggagatctcctatggtcatttaactctctgctgttacctctgttgtctcagttctcatgtacttatttacggaggtctaagtgtttaaggtaaaacttttacataaaatatagtctccagtgtaatccagatacttcctctggtgctcaactgaaaagacaatgaatactccaagtctagattaaaaacaggtagcattggccttattcagaggacgtatgttcacttccattgtggtgtctccctaagggatttttaggactaattttaataagtaatttttaccttacctgataactttaagagctcagtgccctgtaaactgtagttctgtctttgaaatagcaaagtgttttcctttttgttctccaatttagacaagcctcaattaattcagctcactcatcataagatgtatttccatctccttaacctttgtggttactgtcacatgggtcatctccagttagttaatgatggtctcttcaaatctgacaaaatactctaaatgtagtgggaccactttggcacagagtgaaacgattccttgttctgttctcacacagtccttgtattatcatagcctaagatggtaataataatatttttagcagactcatcactgttgacttgttaaagcctgtggtcaactaagcatctcctgggcttcttagaaatgttgaataactggtagtcagttagctacatgttctattggtaggataacctggccttcccatcttctgggacttctacactccttttgttttaggatttgtccttattcttctgaggaaactagacttactctgaacagctttttggtggtcttcatttgtttagctgtagagatggcatgtgcaaaaggaacaattaggtatttcagtttgaaaaagtcacatttttggaagcaaagatattattttcatttttatgtaaataccttggaagtatatcacacgtgcagaaaagtacacaagttaagtatagctggtgagacaggagagtccctgactccctcgcaggacttgcgatgaggggtggctcctttgcagccgagctcaaaccgcttgtgggagggggagcacgcaggtgagcaggtgcaggacctggggcaagtgcctttaggtgctggcaggaccaaacccagtaaccgggcccgtggtagcaatcagtggttgcccgcaacttctggagccccagaggttgtgtattacaaacaatgcccttttggttgttgccttcaacagagagctaagccttaaccagctcagtggagagtcagggtgacatataccctgccctcttggtacccgggttcttgtctggcatccaggaagaatcaggtcacacggacttgaaggatgttgaatgcagaggttttattgactgatggaggtggctgtcagtggaaaaggagctagagcggggatggtgcgggaagaaagtagtctttccttgaagcctggctgactccagccgggtcgtctccgaagtcgtgtggtctgacattaagccgcgtctagccttagtctctgatgcgcagttgcttctagtctctgatgcgcagttgcttctcctctcgatgttcagccgcttgtctctctgccagctgagctctgaggtttataggagcacgagatacggaggctgggtgggccaaaaagtagcatttgagctggaaaacggataactgttttcatttagggctgcagattccaggctcgagggtgggttctttgccagggagctgccctcttctatccagtatttccctgcctcctgtcggtatcgctaacatacagatcaagaaatagaacattgccctagaagccgcttcatgcctctttctactcaccacccttccccctcacaaggagtaaccagtctcgtgacttctacattgtgaattaattatgcctctttttgaacttgttatgcatgtaatcatacaaaaggtgcttgttttgtatttggctctttttatgcaatttcatgttgcgagatttactcatgttgtcgcataaacttgtagttttgttcattcttgctgtatagtattccattgcatggacatactgtagtttatacattctactggttacgaatatttgagctatttccagatttttaggtattaaaaataatcctgctatgaatattctgtgtgtcgtttggttaggtatatattcatagcaggatttgatatatacccagatttctgttagatgtatacccagaagtggaattgctgagttatgtgtgatgttcattcagctttatggcatgtttatgttcagttactgccagttttccaaagtgattgtatacatttacacttttacccttagtgtactagaattctagttgctttgtattctcacaatccttaccctaaccccagtcaatttggacaagatcaatatcttcacaatagtgagcttttcaatctatgatagtcttctttaatttttcctaatattttataattttaaatcataaatgttttgcatattttcattagactcattcataagtatttgattttatgctattgtaaatgttacaatttttttttaattttttttaatctttaactggttttctttgtttagttattggtttgccttatttactaagatacttctatactgtgatttggtggtgcctattctcaaatgctttttctgcatccattgtggtgatcatttgatctttatcattttttctatattaatttatgaataacttaggttgatttttgacttttaaataactcttgcatgactgtaataatttccacttggttatcatgtattattccttatagacatcactgaatttgatttacaaatgtttaagatttttacctacatatgtagatttttacctacatatccatgagaaagagagagactgggatattattttcttgtaatatccttgtaaggatattggtatcaaatttatgctatcttttttaaaaaaagctgagagaatttttctctttttctagtctctagaagtatttatataaaagattggcattatttgttccttaaatattaggaagattttacctgtgatgtcatctgagcttggaattttccttttgaagaaacatttggaaggttttgaaacaataaattcaatttaattcttgttgtttttgtattaatcatattttgtatttttactgtccattttgttgtatttttcgaagaattcgttcattttataaaaattgttaaatttataggtccaaggtttttagaatattctcttcagtatctgtaggatctataatggttttgcttgcctttgttccttcctgatattggaaatttattttatttttcttgattggttctgctatgaatttactagttttgtcaagcttttcataaaaccaactttgatttttatttgttgtttttttatttcattgttctttgctctttattttcttcactgtgtctttggatttcattagctgttttttttctagctttttgatcaattttttttacttgttaatatgtgcattaaagaccataactgacacatttggcactgatttacctgcattccacacatttttgctattttaattactagaagtattttctcattgcctttatttttcatctatggatttttcagtactgtatttcctaatttccaaacagctgggcatttttgagatatttttctgtggttgattctactgtgataagagaacatattttaaatgatttcagacctttgaaatttggtacacgttccatgtacacttataaagtatgttctaatcttttcggttacactatttgtgtgtgtgtgtgcaaatataatacaaataagttaggctacatttgttacttgtgtcagtcagatgatttatatcttcttcaattttttgtttcctatcaagtctcccaattcatgtttttaaaatattttttaaagatctgttcattttgacagtatatgtattaaagttatattattgggtacgtacacatttaacattgttatctttctgttagattgagccttttatcatgattgaatatcccactttatctttattaatacttctttccttgaagtctcctttatctgatattaggattagtatggccataccaactttcttttgatagaatcatagatttttagatctggaagtaaatatatgtatggactaattctccctcattttatatgtaattaaaggtttataattctattggacttgctaggtgttactttcaacccagcataaaaactccgggtcccattctagttctgctgaattctttggaaacatactgtagttaattcaaacagcctcagcccatgttcttctactaggcttttctcctgaagtttacacttggttgatctattttaggaaggtgaaggcgtgttctgaagccagttagggctggttcataataaactgtatattcatcactgccttttctggcttgattctttcctttcacgtgtcagtgctgctctgctaggctttgtttgggtgtcattttccaaaactcttgtttttccctgcactgctctgtggctggctactcagaggctcctgttctctgtctgccccaaacagtctgcagacatgctctgtcaccttctccttcctgggtgcattgtggggcatctgattctcatttggtcttgggtagaggggagaatgcccccaggagattattataaaagtaattaagtgttatgtgcaagtacatttttgtaattctctatctaatttctggtgcttcaaactccctctctattcttggcagtaagatctttttccactgtttccaaaacccttaagtctatgattatgaagattatattttgaaggtttccccacttaattctcatttgtgaagcatgggacagacccacttaagcaaagaatttggggccttccattgtcaccccccatgtctctgcattttgacctctatgaggtgcatcatacaaaaggccatccagtctccaggctcactaatgatgatgcacccgaggcccagaataatggcaacttgcctgggtacgtatgcttatgtagggatagaaatggacctgattccctgcctgattccttggtaattgtgctttgtattaagttatttaataacaaaatattttctgtgtttaaaaaaaaatcccaccttggctttgctgcttattcagtgtctgaacttcggaaagttaattcacctaccttggttttctcatctgtaagatggattaactgttttatgaggcattttgaggataaatgagttaatcatacaaaacacatagtacctatagtacctgacctataggtaaaatctcattttgtggatatgtgccaccaaattcatgaagttaaattctataaagaaaattccgttttgtttttaccttccatttgaccattgctgttgtgttccagtaggtaagattcttctagtaaaaacattaagccaccaggaaaccagttgcatggctgagaactgtaattcatgtagcccctctccaaaaatcggcttttcctttgcagcactctccccactttgggacctcgctgccattgcaggctgttttttcttcttggactacaggcatcttgcttgggcccctccaagttttccctttcttgtgtttattggcataatcccagttcatggtagtcacagcattatagtatgtgggttgccagtctactcctttaggtattacaagtggaaaattattgtacttcaaacatggttaatgtaaattttctaatgcataaggtaaaatttcatgtcatctacccatagtgaaggtcttttggtgctattagtattaaagcctatttggaaccatttttacatttgatcattaaaaataactcttcttcctgtaatgcctgtgtttttgttttgctttccttttgcaattcattctcataggctagttttagttttaaaattttagtagcatttaaattaactcttttattttaaaaacagatacaataatgtcaaaagtggagaaaacataattataacattatttttcaataatgatcctaggagtataagtaataagacattgcatagcaaaatgaacacatatattagagatattttcaaaataatttaaaagctatgtgtaccacagttacttgtgcaatataaaggcaagttaagtgtcataatcataaaaatatagtaattttttcccagtgacagtatgaaccagaacacatatgtgaacaccttttcatatctgatcagttttattcctgatggcaataaaaccatgtaaatgaaatgcaaaatgttgactgcaatgtaatggttgaaatttttacatgcattaaagagtcaggataaatttatggtcttacgatggctgtaggttgcatattttgtatgtacatttttgagtgatcaatagcaccatggccaaaataccatggggacaaaaatcacagttggtatgtactgtggtttattgacattttgccccctctcagatgtgtaaaatattaaccctgagactgatttcctatggcttgtctgtttttgttcagggttaggtgtagatatatgcccatcattagcctactcttttcttctttggaatgtataaaatggcaatatcaatgtggaatagggagttcaaattgtagtctttccatattctgacaccatgtttttcacttaaaatttttgggtcaaatacatgtttccaaaatgtatcaagatacttttttacttcatttagttctgagctcttttgaatcaaattagagaacagtgtcttagtttcaactccgtgtcttattttccacaatgtcttggatcccagtgtgcgtgagggaggaatggatgtgatgcggcaaccccatcttgctgccatttgtttgatattccctttgccactgatcaaatcctatctttggctattttttgagttactttattttaaattaggactctttggttttcttctctctgtgtttccacctctaggcaggaaggtgtactttaacttactgcagttgtgaaggatgattatttacctccatcgtaggtgataaaatctgcttttacaaactgaacttgagaaaaaagcagataactgatagatgcctgcttttaagtacaaatatactataaagaaaactctttagaatacattactttttataaacatggttaaaatcaacagatttcatctacagagctaggtaatatatcaaaaaactcaatggaagtttatagaaattaattaaattgaactctttttataagcagactttttacaaggaataaataatacttaatatttccgtcagaagtcctgggtagatttgaagaaatatgttgcttgcggcatggccataacaaaaaagatttaattcccaaatattgctgggggagagctgtattgtccagtggccattacatagttttctctatgctaggatcctccctttttgaaatctggcctattatacttagctcatcttttacagcacaattacttcgggttggcaaagacctctggttaaagaaactgaataatgagagttgtgtgtctttcttacctgattatactcccactgcttatatctttgagatctctatctgtgccacagagtcaggcatttaaagtttcctagtaaatcattggtgtttgcacctataaactcagtattagaagtaaacaaaactccttttattttacttgaaattcaatactgtatggagaacttaattttgaaatgtctaaagcctaactaaggagaattcctttagatttttaaagcctatcactttaccaagttgtattactggaaagctatgtacttgggtcacattttagtagctctccaaatagatgccttaaaaaagtattgtttaatagtatgcccttactgtttattgggggtcagctaaaaagaagactgtatgacaaccatttctattagcttttatgaaattgaaattgaattccgtgggttatattagttcttatccctaataaagatttgtatgggaaaggcttagagctgtatcctagaagaatttccatctttcttttttaacaaactggtatctgttcgtttattggataccaagtgtattatagctcaaaagtttcccactttgaggggctttctaagactcacagaaccaaattgattatagcttggggattatggtaaaaccttactcatgtttttcttcacttcattcattggttcatgttcttgtcccatcgctataatggttcactttcatagctatcctggaaataggcagtacgtaagtaactgaatgagctagattatttaattctaaattctagaatcagagtaagcggtttttaaaagtaagcagttttttaaaaagcgatagttgaacatctctttaattactaccccaactcagtgaattccccattcaactctgaacacagtttgagttgctgccatgctgcaggaaatggcaagcgaggctggagctcctgctctgtgcatcattgcatatctcagagtgaggctgcatgctgaacatggagatttaaacaggtgaagatgttggtggctacccattccatttatatattttgtagtgatagctattaccatcacagattctgcctttagggttttttccctacagctttggaatctgtttggacttttattcctagtttcagaaagtaccctcaagaagatctttcttttccagagtattcttggaattacctgagttgtaggttataaaaattccctgagtatgtttttcaaacagtttatttttgcattgcaatttaccttccaggaaaattgatgaaatatgtataccttgattctccgatttaagttaaacaggataaaaatgccaagtatttttttccaaataaatagataacatttgttttcagtgtttaaaaatttgattactagaacatatttttaacaagttaacttatgtctcttaacattaaaatgtgtttaactttttaacatagattaggtcattaaacttgtgtttgttctactatagggtcctggttactgggtgaagattcatcacttagaatatacagatggaggaatcctggatccagatgatgtcttggcagatgttgttgaagataaagacaaggtagataactctaaaaatgtgcctctttgttttcctctacagagctgcatgttttcaagagactgaaatccttaacaaactcatgtgtcaattattattaaaagataccatctgttcaggtttcacctggacagcccataaatcaaagttcttcatcagatgtttggaaaaactgtgttaaggtttgggaatctgtttgtgttggcctaattagcagacacttcattcccaagagtttctgatatgtcttaataaattagtttcatatgtgaggctgttggaatcatcattgtcgttgctggctctgtagtttattcctggcccttgctaactattcaactaaatgcctgaggcgtgaatgtgtttcaaagtagagaatacaatggggcagcaagttttatgaagaattacagtgaagatttttctgaaagtagctggcaaacaactatcttgagtgatagtcttattttcactgctacagtaaaaggcactaaattgaatactccaaaaagtttgagcgtgttctgccacttatttgggaataatctcgttgcaaatatcttgttttaatgagatttttcttctgagactatacagaggaaggtgtgaaagtatactatttcattgcaatacacacgattattgctgttgagacaggtttaatactacaggtttggctcctgtcatcaatggctaatgtgttttccaaaaccgaactctgtcagagagatctagctttcaaagtttcttctattatacatctttagtgctgtttgtacaaggctaatttatatttggaaacatgtttctctatattttttccctgtaatctcaggggtgtgtatgtgtacatttttgtgttttacctaactggactggaatataaataagtgatttattaaactcaggtgaagtttatatttttctttttccataagatctcttcagactgttcaaacttacattaatctttgcagacatcttatacatttacttttcatattttattttgtaattaaaacctgttttgctttatgttgttattagcgattttatagtctatttagggagataactaactaagttttatagtctatctagggaaataactagctatctagataaacctagttatctccctaaatagattgtaagctcctagtggacatggacttgggagatttttatttgtgtgtttttgttagtagtatctggtataatatcttacacaaacttgattcccaaaaatacttactgaattaatgagtgaaaaagacagctttactttctacacttgactcttgctgtatgtaattttgatatatacttcctgtttatttagttggtctcagggtaaataaaagggtaactaatgtattattaaccttcagaaccctgaagaagggtttttagttctttcaccctgtttcactttctgcttcttccctagggatcatcttcttcctttgaaataatccagatattttaattgtttattaatgtagaaggcagttcctgtcttaaatttcactgatgtccagaacattaaaatgaagggccaaaaaatggcaagtttaggaaggacgagaagaaaatgtcttaccccagcttcatccaatacctcattactagaaggataagtccatgaacagtgcccagggagataatttgtcccatagagctctcacatttagagcattcttttaaactatctcagcaatgcagtttataaccataatccacttactacacacagaaacagctttattatatgtaatctctgttttaatgggactctaccaccattactaaataaggtaaaaaagtgagataatcagttaaaatcctagctgaggattagtactgcttgggttcggctttaacaattctgttaatgtacttcaatatttctacatgatgcctaattggtattgttctgcagagtttatgacaatttatacttttgatgttgctagaaaaaattgtgttgccatttcttcttcttaaaaaatacgtaagtggcacggtggctcatgcctgtaatcctagcactttgggaggctaaggtgggtggatcacgaggtcaggagatcaggatcatcctggctaacacagtgaaaccccatctctactaaaaatacaaaaaaattacacaggagtggtggcatgcacctgtaatcccagctactcaggaggctgaggcacgagaatcaattcaacccaggaggcagaggttgcagtgagccaagatcacaccagtgcaggccagcctgggtgacagagcaagactccatctaaaaaaaaaaaaaaaaaaaggtgaaaaaaagaatttcttatttttctgacaaccttggtaatcttaagatttctttatagtccatatgtctattgtggaaagaaggccctgccaaatttcattttaccttactttttggcagtttagattaagaagtaactataagtgatgctttgtggatgcttaatgacatatcagtctcactcaggatcctttgaggcggtattgagcttagacaaaataacagttcacctgtttgcaaattggctacctaataatctttggcatttaaaatgtggatagagaacaagtccaaagaggcacggatagatgcacataatcattgtgctaaccccaaaatatctcacctcctaggaaagactctcactccaggtgagaagtggcattaaggaactgttggtctattgcagcatatcaggcaggaaaaacagaaacttagaaagcaggggaggctgggccatttagtgtatggtaacaccatcccatacacttcagtaaaggtagaaactagaggttaaatgatattgtacttcaaattagagaaggctctaacaaagttcagccagtgttcttaagaaatgacttttaaaacttgtgcctaaagtggtttgtctgtggtcttacttctattattcctttggccaacatagtgcttggcgcatacatggtatctgcttgggagctttggttttttaaacttgctttcctagtacagcttccacggggaccaagtctccactgtgttacactacttctagcctatatgtgtcaaaatattattggaacagctttggaatattgcatcttatgataactatttgtataaaatgttgtgctgaaacttaataattatctggttgtgacagttattctcaagattcttcagtttgtctatcagtctgatgattcgagttctttgggataaatatctaagaattgtaattttacactcatgtctcctctctggttgctaaaggctaccaacttagttcacccaatagtaacaacctaatcattgatgactagcaatggcccagaatgtctttggcccttatttattctacgttattttaaagcaatcctgaagacaagagctagtgttatccctatttttaatttccagaataatcacagaaattgtaagtaacttgcccaagatcacacaggtagtaaatggcacaatcagactctggaacctagaatttaaatttctgtaatcttatttcttttcttctctgatgtgtcaagcagtttggcgcttgtatctataatttctattacgaaaattcatcagtcataaattaacatgaattttgcttttacgtagtcaccaccattgctaagaaaaggttggtaatagaccaaactgttgagtataacaaaacagttgagtatacaatttatttataaattaattcagaattaatatgccatacatatttaatatatttcaaccctgtttgcctatagcctgcatctagtttattgtaaaggcttgtcagctctacctctgttgctttcttttgcatcctcttttctctaggacccagattatttgatttagatacagtttaatttcagttggacgctttagactgcacttgaagtctaaccaccatatgcaattacaaagaaaaacaagtttgtattacagtaactacttttttgcaccaactatagactgtgctgttttcagtaggcagagtaatggcgcctcaaaaatgtctactccctaatctctacaacctgtgaatatgaatgttacatgacacagcgtctttgcagatgtgcttaaggatcttaaaatggagagattattctggattatttggatggacccaatgtagtcacaagcatccttataaatgaaagaagaaggcaggagagtattagagagataaatgtgagaaagacacacccagccaatgccagctgtgaagatggagaaggtgccaccagcgaagaatgtagctggcctctgacattggaatcagtaagggaatggattctcccctaaagcctccagagagaacacagtcctgctgataccttgattttagcccagtgagacttgtttcagatttcttaactgtcagataataaatttgtgatgttttaagccattgcatttgtggtgacttgctacagcagcaataggacactaatacatacactgcctcttttcccattttaacttttaaagtgatgttagtcttctcaaatttcatattgactgggcattgagatcctgcaggatgagataaatgctttgtacttcagatgggttccttgttctttgccttcctcccaaagtccatcacaaatgatcctcagtttattgggtgagccttcactctttgagacttgatctttaaatatctaattatgctgttatcgtctatagtgtagaaattatttcaaagtcacagacaaacagccttgttcacttatcagtttctcgctgcagtatgtaaaggccctaagaagtctgaagactgatgcttagtaaaccactgcaaagcttaatgcttccttccttttaagtgagcatgagagcttctgagtattaagctttttaaaatgattattttctttggtaattgccattattaatttttggctgggttgaagaagacaactgcaatataacatgaaaacatggcagtctatcacatctattatataaagtcaattactgccatggtttcattaactgtacaaaagtaatactgtattatgtagtaaagtaacatggaaagatgcctctgttcttgactaaattttgcctatcctagggggctagtttggagagatgccagtggttttcagggcttccaagtgaattgcccactggatcacatgtgatatctggtattcaaatgttataatttcagttcagttttatctcctattagttatcagtccttgggcaagcttcttcatctctctggtcttggtttccccatttgtaaaatgaatataatgttcttacagggttggtgtaggaaaactaggtaggtaaactatataaaattttaagtatagtatagcatatactgagaactcaaatgctgttatattaatgatactatggtagtgctattacagtatttttaatgtaggtgttttgatgttaccattagatgtttttaggtatttaaacatcaaataaactattttactgtatattttaactgctttttaaacaaaactgatatgaatgaagttattaaattggtaaaatagttttataagaagatattgaatatgacagaacatttggattaatatattgttattatttgcgaaatgaaaatgccagtatgattaaactggaaatgagaatccttttatcagaacatattatttggtaacataaggagcatttggagatgtaacatgattttaaaatggagactggtttgcgcaatgctgcatgaactagtgacctaaagccaggctctttattcttaagccaaattgctttctgaacactctgttgccctctagtgggtccacagttacctagaaaccagctcacaggagctacttcctgaacaggatgaagtattttgttctactttatttgaaaataatttttgctatgttttttgttacaactcacagactcaggcatggagaataaagccagagtttgcatatatttccctgtgcttttgtgcatcttctagtaagggctaaaggaaattccttgcatttataaaaactcctcttttaaatttatttttaaatttagacttcttcccgcctacctgtttgctggctgaaagattaatggctggtggtgatgaagtgtgtaacttattcagtctgtagttggacaatctatgaagtatattgtgttttctggagaaggagaatgctaaattaagttaaacagcttttttttttttaaaggtcctgatttatttcatttcttagccctcattttatcagtaagatttccatcgcaagctaaagtacctattttaaagccacaattaaaagaaaaacaaatcaggatatgatgtgtttttgtttttccttcaaaaagtcttactttggttcatgggagttgatgttataaaagcacaaaagcacatagaagaagtttggagaaggtttcagaaataaatgcagaagctcctgaagaacaaatgaattaccttggtcatgaaattttagctcagaattttcaagattactctccgcttatagaattacaaaattgtagaatcatggatccaaacaagacctcaacagtcatgtggattaaactcatcatctttcaaaagaggaaatatcctacccaggaagaggttatagaacacgatgtctgtagctgatttagttcctgagtccatttctgcatttcctccctaggatgctgataacatctcatgcagatcaaaactactcagtttgaagttggcttcctccattgacatccttgtttttgttggttagtttcaagttggcttcttccattgacatccttgtttttgttggttaggagcaccttctcctagtctcccagacttgaacttgcagttattttaaaaatttagttatttaataaagccaatttattctttcctttatcctttcccatatgtttgtttttgtctttgaatttccacagctaccaaatttatatccataatatttcaggccaaggttactgtaattgacaagaaattggtcgtcttgtttttagtctcttccttacctgtcagctgtttttgtgcctcgtatgtaggcagaatggttaagatcttggattctggacaaaaaagtcagttcatttcttggccctgttatttgtctagttttgtccaagttgctaaacctctttgtgccttagtttcatcatggataagtggaactaaaaatagtactaattatgtaagttaacacgaagtgttcaggagagcacctggcctgtagtaagtcatcaattgttattgtaattaacacactattaataatgtaaattacattatttaaaaagtattgcttaaatcatattgttccttttagtgtatactgcatcaagtccaaactttgtagccatttagaggcctcacaatgcctccaaactttctctaaacccacttcaaccgcagtggtggcgaaactactgtacgatttattatgtatcatggactttctagctccaaagctttttttcttaatgttccggttgtctgctatatccttgtccctatttcctgcccatcgaagattcagtttatgttgtattttgtattattcaatattagctccatgaggagggggtctttgctttattcactgctgtattcccagtgcctgcagcagtgcctggcatttcctagctgttcaaataattacagtcaatgaatgaacgtatgctttgaggttttgaataagccattcaaccacttgtaactccagtttttccattggtaaaatgagagtgataaatgatatcgttcacatcgtattattgggaaggttgaaaaagtgtgcaggaaaatacaatggaaattacaaagcactatatacgtgtaaaaaatgtatctattcctgctgttcagttcttatgaatttttcaagatcaaggtgaaattgtattttatcccagtcaacatttgtaaatcatctcaatctaaagtaaatcctctgtgctctgaaattttatagaaacgattaagtggtctttttttctttttcaaatgttattggctagtaacatttaccacttaccatctcgaagttcttaagaattttattgtttaactttttaagtcttggtttgtctgtccaggtgtcttgtgtgctgttttaggactgggatgattgtttaaaatattttttagcccatagacttcttacctgtagttcagtgtttcataaacatgtttaattttagttagtgatagagtgggaactagaattgaagatttctaattgactacctttttcttccaccaaactacgttgtctctttgaaatattttattaggagacagtttgtgggcatgtttcaacctcagagaagaattttggaatcaatgcctttgtgaccttactatagctaaggcaaatagtgtcaagagatagtaacttaaactacagtaatcttgatgatggccatgtcagatatgtgccttccgcaatttagttggttgacaactatagtgtgtatgggtgtatgtgtgtatgtacgtatgatgagagaatctgtgcacagatgtatgtatgtggaggagtgtgtacacttgccctgaatttgtttgcttgttgtgtacaattgtgacacacaggtttcatcagaggttggaatgacatgatcaagctctatggtattattaatttagctaagcatttgagtacagtgaagagtaaaccataagaaaatgtttgatatgtgtgtaaaattttaagtttggttggagggaaaaacccaataaaatttgagatcacaataatgctttacttagagctaaaaatgtaattcaaaataagagtcaatgaacactttcatctttacagtatgcctttcaccatatgttacattactggacccagttctaccaattttctctctcacattagcttcttttgaagctatttgtataggcatatctttggcctaggggtatgggaccattatttttttttaatatacatctgtttttttacttatgtaacttacgaattacaatctcattgtaatacctaaaattataccaaatggaagactacttaagctataaaacatcttcttttaaaaatgcaaatgcctgtgagtactagtgtcagtcaccagtacctgtgtgtattgattcagatcgtgctccactaatacctagctgaaatcagcttcactaaagcagtattgtagagtgtcatgtggcagagcacagggcattgacagtttgaatgtaggtttttcttattttaagctgtctcaacctcagttctcatgtttataaagtcagcttttaggaggaggatcaaatgaaatgaaagagtgtgtggtaacattttgaactgtgatgtatcacacaaatatatcacttttattctttcctcgtgtagcagcagccctgaggtatttaagcaaacatttctgcatagcccagaaagggcttgtggtggtatgagaacactgagccaggaacagaggaatgtcagagaggtttggaagggaggaggatggttatgtcaaaaggccactcttctcttcttgccatctagtgaggtgttcaggaaagagttagtgctgagagtatagggagaagtagttttctgaaacaaaaattgcatttttctttaataagtgaatgtgggtggtaagaagggatatcagaacttccaggtacagaccatcaaggaaggtgaaaactaaagtacaaggatagttgttcagaatcttcccaagattccagaaccttgataacgtctgcataggttatcaggtatcatgtttgctgcctatttcttaatgagtaacagcgggttctataaaatgggaggtgggtgctttgaaacaatagggagtatcgggggaggtatctctatcttaggttaggaaaaatctcaagaaataaaatggaaagttgtgagaaaaacagctgaccttccgttaaatcatgacctgaggtctcatgatttaacggaagaaaaaaacggaaacaaaaaacaggtcaacaggacactgctcagtatgggcaaataaccactgaaccttaaacaagcaactatttagttacttgatagtttcaccaagagatatttgctattgagcaatttaatgggagtaaccatataccagactcttaatttactatgctggttctcctatttccaggacctaaactcactttatattattaattagccatattgtgaatccaacaagacgtttttgacttctcttggaatcaaactgatgtttgtcacacttttatgaggtacctgttccaaattctatataaaccgcttgtacttatagatacatttttagtaaataagaatattcagtttccttaagcttaggcttttaagttgtagcgtttgaaagtcctataagtatttaatatcacatttagaaagaaagtgtgttttccctgtcatgtgaatatggaaacttcacttacagaattgcggcaggattactaaacttaatgtttactcttttaactttttaagttatctttttagctttacttcgatgttatgaatcagttttgaaggatcaagtgacattttcttaacaataaagaagaaagcctccttgtgcagactttaaatcaggagtgaaatagcatagaaacatgttcagaaataatgtcttcattaatctcaaccaaaaccatgttacaattgaaatacacatgtttatacaatacttaactacaaacagaccagaaagactacaaaataatatgatttgagattattctaatagcctaacaatcttaaatatgcatatacttgtgtaaaagttgaagaatctcatagttcttaattgataacagggatagaagttgattttctagactgctggctaagtgtggccactgtataccagttcaaaatgaacccattgtggtaaaatgacgtgttctaaatagttcgccttttaaatgggaattttacagagctcttggttgacttacttggaaatggaagtacctagtgttaagactgaggaacctgggactacaattgagaagagagggttcagagggagcctgctaactgtcctcaactatttgagtgatcatagaaaaggtataaattcattccctattgctctaagaaatcgggccagtggtgtttcaagaaaatctttttcagctgaatataatgaacagcttctcaatgaagcacatgctgctttctaacacaggagctcatcttagtcactgagaccgagtatataagcaagagtggggcagacatctgccaggaattcctcttttagttttgcagtttgattagagacttctaaaggccaactgtcagcctctgaggcatgcatttcagtctggaaatacaggattggcctacatagtccgttgtgatacagtgttgtttgctgacctcacatccgttgtcccctttctccctccggttgtgttcagattctctctcccttcaacttgaagcccatatggttcagtgcatgtgactactcacctgcaagggtgaccctgggtggcccttcgtctgttactaatatttggttccctgtgacagtgattactttgggaatggtcgtgtgattcagtttgtgccaaatatgttcaaagagagatttgctgagtccttctgggaaagatcgtttcatcttgtgggagaaattttctccgaattttattttgttgttatgaagtttagatccatggctgccatctagcttccaacaagagaagaaattcaggttccggtaatctaaggaacatggcgtcagagccaatgggttgagtcaactctcaagaccctcctaacttggaacctccaattacacgggccatgtattgccttacatttacgcctgtttccattgcgtttttctgtgactcacagattacggattgtcgttggttaccctgttagagaagcttaggctctattttttgggctcctctttatttccatttgattaggacatatttgtcctaacctctttcagttctatacgtcattaattggaaagttttcagattgttgttcacatttctgccaaattatttagctcctttctttcagaagtttttgaattgtcaatgaaagaattacacatcttaaaatctggaggggtaaaaatgcatattccagttgtttggtttgcatggcttagatttactaggcaagattaacttggaatttttccatttggtgcgaattatatctttttattttaaagtctttgttatccttgattgttgattgggttttttttttctggaagaaataattaatgctatttaacacatctattaagatgtgtttgtcataaacgctcattatttctattattcattacttcaaaaattatgtattgagagccaatattctagtgactgggaaatcagaaggagttctgtctttagcctttttagatacttaaagtataagtggttacgtcaatgcgtggtcttacagagtaacatagaggccatttttccaatggatttctttaaaattgtagcgttcctcctttttattttaagaacttggaagaaacatttgacactaacctcaaaatgtcgcttcaactgggtgcaatcctatttacatcaagaaactggagactatatttaaagcaaacaaatataaaaaagaaaaaccttgggcagtttaagaagtttctcagaactcagagtgaagtataataatcttttaagttattatccaatggcatgagatcataatgtggttaatactccagcttccccttagctgtgaagaagttttgcaattatcagttttcccaaaattatctcaaaaaataatgaagcccttgacctgacatatgactcttttcttctgactctttacccaagttataaagaagtgtctaggtgcccctggtgtagcaagtaaagcctggagactcccagggagccctgggcccctaaatggggcagactggggatatttcttgttcaccgaggaagtggggttgcttacgcttggacactgaaaacacatctgtgatatattcaatgtacttcatgtccaagcaatataaagacagtggtcctttacattgtgacattgaaatcacaatcactcctttctgaagtggctacatggctgtcaaaatcagggttctttaaacaagcttcagaacatgccactcttccctaacaagacagaataatttggtatatttaggaagattggaggttaagcgagtgagattcccggaggatttgtaagaacactgtagaagtgttgggggtgggggagataaatgtgatgagttagaaaaataagtaatttgcagatttagtgtgctgatgatttaaaaagtgctgtaatgaatgttacaataagacaagcaacaaagaataatgtgatagacaatgatacaataatgtttggggaggctccatgtcaaaggcatcaacactcaaactatttacatgactctttcccaaatggaaacttatttcccaaatggaaataaggaagttaagtagttacaatgatttagcataaaaatggatgaaatattttgcatttaacagagaccaatctgagatgaatcttgtattcttatatataatgcatcaaaatatggaatgcagcttctgactggccaagttaattttaaaccttagtattttttatatgtatatacactaacagaaaatgtatcaagttggtctgttccaagaaagtctaggttgaaaacttgtgtatttcctgccacattgatacttgaaataaatattcaaataaaggtggaatattaaaaatcctgcagtactgttctttaaatctttgctgtttgttagaaatcagaagctaaaattgaaaattagatttattgagatgaatacttcaaaggctgttccctggtatcttaattcaatatattgctttcctctttttccaaaacaaatattttcctcttatttaaacaatgttttcttttattcagctatagcatctgatagcctcatgttactgaaagttaacataataatttgggacttagaaactttattttactcctagttataactttattggaaaatttaattttgtacagtgaaaataattatgtctggaatactctgagcaccatttggtcagtagcacaccttatatgaaataaatagatttttaaaaatttgatagtgtcttcatataaggagaggaatatagctctggattgaatttttgacacgcaatcttttattatgacatctagttgattaatacttcagccaaatcagtgttttatagtatctcttcactgtccattggatctggagctacaagcatgcataaaacctgaaatctgctttgtacttcccatcatttactttggggcaatgccagtgtcttgattatagtgtttgaagtctaaatgctttaagaattcatctaaggcaggacaatttttatacatgattttcttattgtatttgagtgacagtgtttaagaatttcttaaggttaaaaggtggtaggacagaatttttgaataagaggcacttttgtttgttttttcctttgttttaaaattgttaaactgttaactgttaaacccaacactactaaaaaagttagtacttgttaaatgtcaaaaaattttaaatatggtaaaataccaagatgaataccaaaatcatctgcaatcacatcaagcaggagtagtcattattaaaagttgggcatataaatttcttttgtatatgtattgaagcataaatatttacatttatactttttcatacaaaattgttttagtaacatacttttctttgacttaacacatttttctatgtatttattctttgaaagatgattttcaatatgtatttggcccatccttgtttgaatggggatttttagctttagcttccttcctttgctttttccttgaacattttgctataattctgataaatactctatttactgtaattaaaatgtaaaagcaagatgtgttttcagtgtaaaaatcctgggatattttaggaaaaggacttttaaccctataaatacagcatagaattcttgtctagagaactaagtaaatgtctatactcatgggacttattgggctggttgcttacctaggtagctgaatattctgatttctggtgtttggaagaaaaatttccatttgttttataggtgattattggtaagttattagctgtagtttgcttttaaaatgtatgtaccttgaaatacacatatgaaaggtttaaaggcaaatctaactttttttaaatctgaaactctattttaagttgagtgttgttttcttctggatttaactgattttcagcattttattaatgccgtagaattctggaagtattcaccaattgaaaagaatgaaaagaaagtatttaacgatgacttctactgaggaagcaattttattttattattttttttttctttttcaacttttagcttcagggggtacatgtacgggtttgttacccgagtatattgcataatgctgagattggagtaccagtgatcctgtcatccaggtactgagcaaggtacccaagagttagcgtttgaaccctttccctttttgctaccttccccctctagaagtccccaatgtctattgttgccatctttatgtccatgagtacgtgttgtttagctcccacttacaagtgaaaacatgccatatttggttttctgttcctgagttaattcacttaggataatggcctccagctgcattcatgttgctgcgaaggacatgattttattcttttttatggctgcgtagtaattctatgggatatatgtaccacattttctttagccaatccaccattgatggacacctgggttgattccatgtctttgctactgtgaatagtgctgctgtgaacatgtgagtttatgtgtctttttggtagaggatttgttttcttttggctatgtacccaatagtgggattgctgggttgaatgttagttctatttgtagttctttgagaaatttccagagtgctttccaaggtggctgaactaatttgcatttccacctacagtgtttaagtgtgctcttttctttgcagcctcaccagcatctgttgctttttgactttttaagccattctgactggtataagatggtatttcattgtggttttaatttgcggttctccagtgattaataatgatgagcattttaaaagtatatttgttggccacttgtatgccttcatttgaaaagtgttcgtgtcttttgcctatttttattttatttttttctttttttgaaggagtattgctctgtcacccaggctggaatacagtggcaggatctcggctcattgcaacctctacctcctgggttcaaatgtttctcctgcctcagcctcacaagtagctgggattacaggcactggccaccatacttggctaattttttgtatttttagtagagatggggttttgccatgttggccaggctggtttcaaactcatgacctcaggtgatctgcctgccttggcctcccaatgtgttaggattacaggcgtgagccaccatgcctggccaatagagttatttgttttttttcttgttcaattgtttaagtgaagaagcacttttaaatgtgaaaactgttattgttgaattataagattgtaattggaatattcttcatgattccaattagaatttactttattgatactttattaattttaggcatagtgctaaaaacattgcttatattatctcatcgattatttaaaattacccagtgagatagacctattatccccattttacaaattggtaaactaaggctcagagaacaggattaagtggtttgcacacttctaaagagccagtacctgattaagccaggactcaaactcagatctgtcagtctccaaagccagagttcttaaccaccatgcttagacacaaaatttggttttccattttcatggtatttttctggaactctactgtccctgcacttgctcatttatgagatgtttgtcccatgaggctgtatccattatgaagtttatgtaaagataaataagatgcttcttgttaaagagatgggaatgggagaggttggatggggcagtcaaaggaagtgacagctagtttatttctgttactttatgctcttgtaaaaatacagaaaagattgtgaatttctttacttttatgaaatgttttaatttctgtagagttgccatgcattattcaagattataaaatgatttgaatttcaggagcagacagattttctgatgaggatttcaagctgtgtaattatgaaacccatataggttaaaagttcagaactcgttagcttaatcattaaaaaataaccaattcataagcatggcatttcattttagaggggtacagttacaatatcatttactaaatgacccttggattctgcttcatgtcccaccacacactgagaatgtacaccacatagtttattctatgttattgtataatttataaagaaaattcatattttatggtagtaaattagatgccacaatgtagggcacatttctataatttttttttaaagttttcttggcaccttaaaaattcaaggaagttaatgagtgccaaatatcaaaaaggttaattagaacctgttacatagtgttgaagtatacatttaggaaatgatttgtcaaatttttccagatatggcataaatgtttcagaataaaatataagaaaatgagtgctcaggtatgaaggaaaatttgtattgtgctaaagtacacctaaaatgtaccatcttcatcatttctaagtatgcagttctgtggcattaagtgcattcacattgttgtataaccagcaccactattcatctccagaacttttcatcataacagtattttttattttgaataaaatcatgcagatattattgagaatatgtttggattcatacagatgcttggaatctttaaaggttttaatgtatcagtatatgtaaagatgaacgttgaaactgtagctcttgttacttcaggtaagacacatgacatccattgatgcaactgaaatctttaccagcttttgaaatactgtcagagtcatgcatattttcttcaggatgaaaggatattgagaggaaaactatattcaaatataaacaatcttcataaagaaccatctgaggtgattaaagataccatgatcatcaaacagttaaaggtggaaaataaaatatggtatttatgagaattttgactggcatgaagattttaatgcatattatcttgctttgctaatcaaggtgattgagatgcacttgcctgttaaatagaacttgctcgtggcttttagttatcagagattttacatttatcttttcttcatttgaatgctacataaaccctcccctttgaatctgagggggccactaatttttttcctagagtgctactcttatatattgagaatattttttcccctaatgcttggagaatgataacaaaaaagaattttttattggttcatttcatgcttggtaagattccaactgtcaaaacattataaaattttgaacctagaggcacatttcatcaccagagtactaattgctgcagagaactggagcgaggcattatgtagtagtatttattagagctgcccaattttaatgttttttggaccagagacacttaaataaaaggttaagctgtttgggcacaaaagaaggaagaaaaactgctcagtgcttgcaacacatcaaatatagtacaggaagggtagaattaattgaaaactgtgcacctactttcactgacactcagcatcttattttcagtgatgagcatggcagatgtaattcttggtttattttcactatgtttagtattgggagccgattatgtgctagggcactggtgatatgagggaaacgtgaaagacaagggtctcccttcatgaagcccatattcttgtggggaaaggagacagtaagcaaagcatcattaataatatagcaagtaatgcttggtaatggctataaagacacacatagtggagtaaaagaacagagagtgagtggttggaggcaaaggcattttaaatcaatcagttaaaggaggctcttctaaggaagtgacatttgagaatagcagtgaatgagggccattcaaaaaattagtcatgtaagaatttaagcatacaaatatctctcacataatttccatagcatgaagtactagaaaataacaaaaataaggacaaaatgaaataaaatgctctattaaacaaatatattaacttctatttaatagatgtctgttaaatatcatctgtcaagccactgactgactagatagtaagctggggaggagaaaagataaaaatgtgtctctgtacttgggaaaactacagttttagtgagtcattgtggtttgcttaagagtaggtgaacaagcagtccaaagcagtgaagtgtgtggaggcagcagcaggtacttaagtttgaccgaacgctagccaagtgcattataaggtgattgttgatgaattgttccttaatctccatccttcttccatctgcaactgatactatgcggtcctttagtgctgatcatatttctgttctaaatacttggtgcacaataggtactcagtaacagttctttgattgggtgaatggatgagtgaatgaagacagaagacaggctttaaacttttttaaagtatggtttagaagaaaaaggagtgtagttttgcatgtctttgcaagggtaaaatttatttcatttttacataagagtaaggagaattgggaggccgaggtgagaggatcatgaggtcaggagatcgagaccatgctggctaacacagtgaaacgctgtctctactaaaaatacaaaaaattagccgggcatggtggcaggtgcctgtagtcccagccactcgggaggctgaggcaggagaatcgcttgaacctaggaggcagaggttgcagtgagctaagatcgcaccactgcactccagcctgggcgacagagtgagactctgtctcaaaaaaaaaaaaagaaaaagaaaaagaaaagggtaaggagaaatccatccagatttgagaagaaaataagggacagtggggagaaaaaagtcaaaatgccagtgacaactgatagaagaagactccagaaaattggatggggtgtggtgaccagcctaggtaggggtttactttgaaaaatatgaaatagcgtttttcttcaaagacaggagaaaaataagtcgagttggacatgaggaaagattttaaggtatagaggagaaaagtctagggtgatgatctcggtcacattttagtggaggtaaaagaaaggccatctgaaataaagagggactggaagtccttgaaaacaaatgagtttcagaattggaaatttttttgatttttaggtaagtagtagatgcatctactacatactaagtaacactcctcatatggtctttggcagtaccctgtaatcatagacattaatatttttctagcaaaacactaatatttatatctggtgaaataatgatgataaatagtttccagtcaatatagtttgtgccaaatgtacaaaaagataagaaaacacgcttggatattggaataatggataagggattgtggacctgtgcaatttgcatggcctgtttttgtttgcaggaatgactgagatgaatgaaattgtttaagatttgaaaagtagcaggatttttttgagcaggggagccaagcagctgctgtgatgtctgatatggcagagtggtttctcagtgaactgcatcagcacattcctgtgtgtttctgtgcactctcctacacatgcatatgtgtgctctaatgcccagcaacctgaatggaaatccagaccacatgaagcccgagtgggactgcaaatttattatggtggtggtactattgtcaggaatttgttccagaggcactgagaagcttaaatggtgagattagcatatgctttaagatccaagggttaagcaagatatggagttgctgatgtttttaggacagttttttgacgaaatcactgttacaactttttggcttctattttatatggatttttttctacataagttgacatagtattgaaacttttcttggtattttatatttttatcacaaaggccaagcagtgtgcctagatatatctagtagatgatggataactaaataaattattgtaactatgaattatagcttgttataaatgatctttcatgactaaataaatgaattattgtgtgtttgtgcatacacacaaacctttgtactgtattttccacacaggattgcaataagccctttttcaatattgttgtggaaattctgtatatgttaaattatgtctgtggagatttgtgttcgttgacttcatacagtctcagtagaatatggtagaagtgctaagcaatgattccttaatattaaaattttaaaaaatagtaatgcagaaaataaaaccatcctatgagtttcatgttttaagcttttaattttaccttgaaaatattccctactgaagattgtggagctctacccagaggcggccacggggagaccctggcatgggagtctggaggggtgaggaggagaccaagagacccctttggagacttcatctcttggtcagtatctccctcatcaaaactcccgacccacagcaggatgaggatagaactcaagggtcaatgtctcagaactgggaggagcaagtactcttctgtgactgagggaacctgtctgactatgtataaataaaatattctaattatagagacagatttttttaattgatttgttttgttttttaatttttttgtagagacagagtctcaccatgttgcccaggctggtctcaactcctagcctccagcgatcctcctgcctcagcctgtcaaagtgcagggattacattgtgcccagctggagacatatttttaatgtgtgtacttgtgtttatgacacacatgatttgtgattatggaagaattaaatatatttcatatagaagaactaatatatgtagcatgaaagcttgcttttgacattacaaattataaacataaacattttggttattagatttcagaaacgatctcctagtattagaaagtagacatagatattcgggttttagaattctttgatcaaatcctgataatagtgaaataatgtaattatatcactttcacctgtacaaaattctcctaaatagtctcagtacttgtaagaactttatatattagtcacatcagataatttaatttccatttttgtttctagggatttacatcctaagtctcatgtaaaattcttctcatagaattgtaccagagtaattttttatgttaaaatgtatcctcaagggcatagtatgttcttttactttttcaatattgtttaaggccagaaaccacaaagtcttttcctggtggcatttttttcaaagctatgatcaagtgtcacctacatagacagtcatttgtatagaaattttaaaatgcctttcttaacagctttaaattgtccacctggactgtggaatgctaaaagatattgttctcagtattttttgggagccaagaacaaattaaaaatcttattctggtggatgggattttctaatttagcatagtacatctcaaatataaaaggctaaaactcagttgaaatataaatgatgtttgggagcaagctacttagggaatgcatgaataatgcttgttgcattccttttattatagtttattcctagattatcttacccttttgaaaaaaaaattccgtttccagaattgtaaggtaaaaatgcttgtatagtcccattaatttgatacaaagttctgatagaagagttcaagaatgtttaggtttgcctttacatcatgtcagtacccaataaaacattctccgcatgatgcagaacgtactgcagtattttatgtgagagaaaacagtaccaagagagaaaacataaatgaaattctgccagactgctgtggaatttctgtgagtttcaggtcaatgtatgtggttccagaattaaattaactcatgtggaaagaaccagccttaagaactttagtatgagcatatgtgtcttttattattctactttattattctcttctcttttatgacctctaggttacaatatcccagtacatactacctttggctctctttgaatgtcagctgctgttgaacacagtggaccatctacctagtaccttgtgaagcagatgacttctccatgatagtgtcatacgtttgatgtgttcagttggggaaatacatgtctatataggttaggccccaattttctggggttcaacactgaggcatcttaaggtaaccaaaatcaggccaacaacaatttccagaccaggaatactgtggtgttataggctacagctttaagggtcatcacactttgcatgctcagaattttaaatttgcctcaggatcaagcatttgctaatagccaaaggattattaactttaaaggactttaaatgtttaagtgattgtgaaataatggttagtgcatttttaaaagttttgtctatttttcacaggctaaagaaatcataattaaatattgtttaaccttctgaggaaaacagggccttttccaaaaacagagaaatataaaattttattagtttcattgactcgtagagttacctgtctatttaatacttctatttcttacgttaaaataagatttcagaaaaattctgtgagaaaagtgatcaggtcttcttccttcttttcttaaattgaccttaaatggttaggttaaggtagcatatatttgggaagacattgtcctgctggaaagacatttaattcaagctcttgcaggtcaagccttaggataatagaaatctgtcatctaagcccctggttgactggcacatactgcctaagaaatgccgtttccatatattctgaatggagggaaaaaaggttacgaaacagatctccagaacatgcagtgatcccttgatgtctgttaaagtacgtttaaattctttgccctgggaggaaattgttagactaatatgtatgttgagatatttgataggtttttaagagctggacttgcagtcatttgaagaaatgtgaggcatgctcatgtggtagaagtttagacaggggctcaaagtcttgggcactcattggggctgtgtccaccgattactgactggctgatttggatgggggttctctgtctccctggttctcccttttctccttcatattctctaaagagttgcacctgcttcattgattctcaattactgatttgaagagtgattccattagaagagtctaggaaacttacatagattcttgtcctatcctctgtgttggggtcctggaatctgtatggcgtcctgtgctgttttatttatttactgttatgtagtttttgtcttctctctaattgctgtcactgacacaagtgaaagctcttaagctgaaaagtaatagcagtccttcaagctctgaactgctggtctaaaaattctagcccagaggatgttgaaaccagacctaatagtgatattgatgatgaagaaggtgagtaaaggagttttgtttggaagtccctttaatcagtgcctttgtagaattaagcaaatcatttctctaaatttttaaatttaatattgatgttgtggccattattaccttgttatagcttaaccagtttaatgtattcatagttctcaagatttcctttaagactaaaaattaaattatagcatattttgtatgttctgataactggacttaaacaattacttgttttatagtattgagacagccacttaagacctttgattttcctcttctccccatatttctagaatactgacactgcttgttttacaacaaactttatgaagaaaaatgaaatgactgagagctttaaacaagactctagattgatttttattgcctttttaatagttcattgtgtatatgtaaattacatattaaatgtatgaacagataataaagtttttctaatgaaggtgatattaatatctaacagctactaataggtaggtaataggtatatgtgatctctgtgttatgtcttacaactgcatattgtctcaattatccaaaaataaaaaattaagttatatatcttttttcttttttctttttttttcagacagagtcttgctctgtcacccagactggagcacagtggcacgatcttggctcactgcaacctctgcctcccaggttcaagtgtttctcctgcctcagcctcctgagtagctgggaccacaggcatgcaccaccatgcccagctaatatttttctattttcagtagagatggggtttcgccatgttgaccaggctggtctcgaactcctgacttcaattgatctacccacctcggcctcccaaagtgctgggattacagacgtgagccattgtaccccgccaactattcttacctccattttacaagtgggaaaacaaatgtgcagaaaggtgaagtaacttccatgtttctgtagttggaaatggaagaattgggatttaatccaaggcagtctgactttggaatccaggcatgtagcactagtgttttgaaaatgtagaccaaatctctaaacttttgtttggtaggaaaatcaatactccttgatccctgatatatgatgaatttacactgtataacaaatagtctttatcatttcacagagggcatttatatcataccatttatgaagggagtttatatcatatattcccaagttatgttatgaaagaaaatgattaacaaaaatctttaatggtttgtgtactctgcgaagaaagtttgaacattatggtttaaaaattgtgttaggactttactgcttcatcagagcttaccatttccaggaacaggttagacattctgacattgttaaaattaaataggctggccgcagtggctcacacctgtaatcccagcactttaggagactgagacaggtggatcacaagattaggagtttgagaccagcctggccagtatggtgaaaccccatctctactaaaaatacaaaaattatccgggtgtggtggcaggccaggcctataatcccagctactcgggtagctgaggcaggagaatagcttgaacccgggaggcagaggttgcaatgagcggagatcacgccactgcactttagcctgggtgacagagcaagaccccatctcaaaaaaaaaaaaacaaaaaaaaaagtgaacaacaaaaaattgtttttcctttttattagcaatataatccatgtaaaagagtaactaatatgattgatagataaagcaatcaaagaaaaatcatgtatcatgtacttactacccagcttaaaaaatagagtaataccttttaaatttctatgtgctgccctccagtcatagtaatcttcctcccaccccaataagtttatcattacaccaattggtattatagaatattccatatgtatatatccctaaataatgaattgtcgagttttatatggtttaggcccctgtgtgttgtgttattgtatgcattcttctgtgatttgcttttttcagtcaatttatttttggattcatccacattcatgcacgtaagtttggcttattaatttcactgctgtagagtgtttctaatgtgactgtatttgaacttattaatcctgatttttgcttcttcctgttgaaggacattgggctgtatatgattttttctgttgctttattcttcaacacgcatgttttgccccttgcaacacatgggcaagaatgtatatctaggctagaagcataggaggctatttactggaataaatactttttgagataagtatttttataatttacaagatgatgccaacttgttttccaaatccagtgtgccagtgtgaatgttcttaatgccgcaaaaccgtatactgaaaaaatggtaaattttatggtatgtccatttcatcccaataaaaaaataggtttattgggataaaatagacgtaccataaaatttaccattttttaagtatgcagttttgtggcattaagaacattcacattgttatgtaaccgtcgccaccatttatctccagaacttttttcattttctccaactcaagctctgtgcccattaaacactagtttcctgtttcccctcttcccatcagaccctggaaaccaccattctcctttttgtgtctttgaatttggctattctaagtacctcatataagtggaattatatgatgttcacctttgtggatctggcttattttacttagtatgtcaaggtttatccatgttgtagcatgtgccaggattctccacccccctttatataaggctgaataatagtcctctctctatatatacacattttgtctacccattcatttatcaatgttgttcaagggttgccttgtgttttttttctgcccagccctggaatcagtcagttccccaagaagttcttgttcctttgattggagaatggtatttggaaaggtctagatggtagttgtgctctgaactgctggtttattattgttgataggctctgtcagtgtacagaggtaggaaatatatgtatgtttattaacacatatatgtatgcacatttatatttatttttaaacccacccttctgtatatctgttaaaatccataggtcatacctgtatctgtgattcttgtcctgtactacagggttaatcttagctttccttctctccttatttatagctctgtatttctgagaatggaaatgaggctgtcattatccacaatagatattttcccatttgtatatgtatataatacagtttcagatttgctaacctgtaaccctgcaaaataacatttactaactacagcatttgtgtacattagtactctttttcacacataacccttttccttattagaccaaaaaatccaaactctcttaaatatcatgaatttcatgttcttgtttccttgtttattttttctgtgtttttttaaatcacagatttaagatctgcccattcagagatttagttattatatatgagccaatgaatactttactttgcctacattagtttcagtttctgtcacttgtaaccagactgtcctgacacaaaagcacagtgtgactggtcagtcgtttcttcctttccacaaagaaagaaggaggaacatcttctgccttaaggaaattatttccaaagaggaaaaccagatacagcgagaatatgcacataagtactccagattatttgagaacaccttattctaatgtctacttatctctatgatatcaaatcatatgaaattaaagctctgataacttcattcctcactataatttacaaacacacccagaatgaacccatggcaagtcatcagtatctactacctaatcactttgcttgtggattcactattcactttccaatttgacaatatgttatagtgaggtgctataattttcattttaagctatacaacagaaatgatattacatttaatggctgaatggctttcatgttacaattagaggtatcctaagcaataagagttgacaaattatcctttaaaaacaaattgcaggacactcacaaagatagcttttgaaaggcttaccaataaggcatccttgaagtgaatatagagtatactttactaatctctatgaaactgtttgtattgaggttgtagttgcttttgaaaggggagtgttctttagaaatccttgtgttcagaagtcaaaggtgaagaagtatttctaagaaaataaaatgattaaaatagtagttattacccaatcacttttaaaatttaatatgggatccctgtgcctaatgaagactgtatttaatctcagtaaagtttacttccctgtgattctgacaaattttaagagcaaaattctttttaaaatgtattcttgaaaaccattcatttttgtagtgggtggattctttttcctgtagatttcaccagacaagaatttgtattttcattagaaaagtctgctcttcaggctatttcagtttattcaacttttttctaaagcagatgctgtttttctttttttttttttttctgctgctgttgactatgcaactgagtgtttctggcacttgatcagttaaaacgtaaatcgtaagccaaactactttcttttgtgaccaaacttatgtgtaaaacatatgagaaggctttagtcatattcctctgtttgaaatttgcaaggagtcttagagaagatcttctatagaagagaaaagtttgggggctgcttggctctttgcagcctaattgaggcatctgcttactgctgacctttcacatatgcttctttctccctttactgccagttatactcccgtacatcttctgtgaatctgccctggtcaacgtcccatcctttgagctgccattctacattgctttttcttaaattcaatgtgtcatctagttttttaattatctctctgctccgtgaaaccagcactcctcagtttgaactgtcactcgcctggcacacagattcataggcctcaaccctgatgtactcaaataagaccatgggtttacattattgacaaatgctgcagaaaactcttacgcatgctgttatttgaacagtactcagccaatgagtactttaaatgtaggaactaattattaattgcatttgtatctcagcagagcatttattagaagttcaataaatgcttattgaataaatatcaagatattgagctctttactatccctaagagatagtaatagtctccagtctggttgctattggtccacttacatctggtatggagttaacagtgtagtgccttgctactcagagtgtgggccacagatcagcaacatgagcatcacccagaaatgaagagtcttgggccccactctggacctaccaaatcagaatctgcattgtaacaataaccctagcgatttgtatatacatgaaaatttgaaaaacactggcttagggggccagagttatactgccatcttggaatgtagtgagggagattttaatccgttagacaaggagtgactcttcaatgagaacatggatctttgagcactaaaggatgtacttggggaagacagtggaaatggactgtatgtaaaattattgagttgatgcaaaagcagttgctgtttttgctattaaaagtaatggcaaaaacagcaactgctttttttttttttttttgagacggagtcttgctctgtcgcccaggctggagtacagtggcgcgatctcggctcactgcaagttccgcctcctgggttcacgccattctcctgcctcatcctcctgagtagctgggaccacaggcgcccgccaccacgcctggctaattttttgtatttttagtagagatggggtttcaccatgttagccaggatggtttcaatctcctgacctcgtgatctgcctgcgtcggcctcccaaattggtgggattacaggcgtgagccaccgcacccggcccagcaactgcttttgcactaacctaataacgtgctgtggaagaagcgtgtatgggtaaggttttctgatgtctttaggttgatgtagtttggagtggggtacttgggagaaatttcatccattcatatttcccttcaggatttgctgcaatggactgtgcacctcattcccttaattatcgcagaatgaaccagttagtcgtgatgataggctaaataaagtgatctaagatttagaagcatgaagcataagtacctttgtgtaaaacccaaatattatttaactctttaggaaatagatttagagaaacctgagacttgggtactcagatctaagaattttggcttaatattaaaatatttttaactcttttaagtccaagaatatgcttttatgaataattaattaaaaattgttaatgaccctcataggctttttctcctaattgaatccacttgcaaatgctaggtaagaaaatgccatttgagtctttccattttcccacctttttaaaactctcatcctgtttttccccatgttatccctgtcacgtgaacaagtgacagtttttttccttttgatggtatttcagctagtttaggtgtctggtggagttggtggtggcctggagagaagattggaattgtttaggggctagagaatgagcagttggacagaaatccaaaggaatgatgaacattatagaatgagcagtgagaactgcagtgagagccacggtcatctctatgtcaaataaaggcaggtggctgggtagtcacagagccaaattgggaactagacaaagaacctgagggtgatggaagtatctggagagatggccaggatgtgacgtggaagaggtggcatctgtgccttggatgactggcacagcagtagcacagatgtggctgcttgtcagtcactgacaaccagggaagggatagcttcagctcaataggttcgttctcagtttgtatgctccatggccatagtgattgacatttgtgatgacagttctgctgaatcacctcagaccaaatttacatatattacatgtcttttaaggttatgtgaatgttccaattatggctcttttggtttcaaggaacagagtctcacacactagttttattttagagaacccgaggggagaaaggcacgtatcatgagaaatgaaagcaggaagggaaaaattgtcaggacctgaagaaattaatgtctcagcatttgtgttatctttttttttctatttctttggtcgtgggggatgggaggagtgtctatatgctttctctctctcattttgtgtctcttccctcctccccatgatgcattttttcttactgcattagtctgttctcacatggctataaataatacttgagactgggtaatttataaagaaaggaggtttaattcactcacagttctgcatggctggggaggcctcatgaatcttacaatcatggcggaaggggaagcaggtaccttcttcacaaggtggcaggagagaggagacagcaggggaaaccaccgcttacaaaaccatcagattttgtgagaactcattatcgtgagaacagcataggggaaaccacccccatgatccagtcacctcctgtcagggcccttccttgacatgtggggattacaatttgagatgaggtttgggtggggacacagagccaaaccatgtcactgactttgcatgtgacctccatcctcaacattgttatgacttattagattcaacatcaaccattgcctagcagtagtctcttgggtcttgggtcagattcgcagggagcaagagtaccagctttctttagtttatctctgtaagccaagccaaacaagcccttggctgcctttgagatatgtgtatccctgagcaatcagttgtgttgagtttgaggccagtcacatgacatgtaaccctggttccttcagaaactgaaaatgagtcaggtaataacacatatatgtatcgttgcattttaatcatgattactcctgacatatttaatcaaatttgtacagttctgcctcgtttcaggacacattggtgggatttacaaccaggaataaaatacacattgggagaagttatgatccagtggagagataacagttaattaaccaaaacagataattttctaatagttttgaaaagagtatgttcatagttgtttttcatactattgaacttcattcttaatatatggcttcattttgttaaagacggggcttctaacaaaacttttcgaaagcacatcttgtggattactttaatggaaagtattttgttataatagtcttaatggaataattatttcacagccagcaaggctaacggagactatttgtagattgaggtatgttttcaaagcctagtggattagcaaacagttgaggaattagggccaaatgccttcaaatgcttgtctcttcatttttaaaattaaagttgatatttgaatagacagaaaatttaagtaatgaaaatctttgatcatcttaatagcagatatctttaaactataaattaactgctaatttaattcactgtaatgctatgtgaagtgagtgtctttatttaaaaacttgtaattttgctgaaaatatgctgattcttaaccacatgtaaccttctggttatttcattttgccttttcacatagttcttgcatgttaccaaactttggttttccttgaaatattttaatgtattatgttacattacactataacaataactgaaaagaaacaagaagtattattactgatttaattgtctttttttataaccttgaatttcatcatgatatgtaaattaatttttaatgtgccactgaattaggtaaataatacctttcacagaagataagttaaattataggaaataaataatcatttgaaactttgaatacttaaaaacaacaggtaaatcgaactatttaaatactattctatagttgtgagtaaatctcaggaagaatgtatccattcatatcctctctccctgaattttgtgttgagtaagagttttgcttaagcttttgcctcttgaaattactcctttttttgaggtttctttgtatgtgtctgtaaagaggcacatgacattgctgtctttatggcatttttttgtgaaggtctaatgagaatatagtcaactctgttatttagcagtagattagttggtgtttggattaattatactaaaataataatagacattttactcttacagttttaaatactgcgagccagcagaaatgatccatatactgaataacatctcgtttggagttgcttggtaacggatagaagctacattaggtctgttgccacgtgagaatccttggtgcttttgccagtccatgatgtagcttttgtagtcatggccatgaactgcgtttttgtgtgtggtctgtacaaatttaaacagtaacatggtttgggtcttttaaaatgtaaatgtgataaaatagacccaacttaaaatattggaatctaagtgaaaactgcatattgcttaacattcaaagaagttatcagtcaactgggaaaagtataccattaaacaatttccattgtaatatgaaaaagaaatcagatggctgatggttgaaaaagaaaggataaattgatgtcttttgtatctcattgagatcttgaagcagaagacaaaagcaaaagggaaaagttaaacttgaaaaaaacattgtctacttttgatcagacaatgcaggtttggtactgtcagcaggtgattggtgtaagaaccttagttgccatccggtacctgttatatcaggttatgtgtccagctgctttaacagaggccaaataatagtggcttcaacaagatggaatgtttatttctttctcatgcggaagtttcagctgaaggtagtttgggggtggaaaccaagcatcttgcgctcagatgttcttttcatcactctaccatgctttagcagtaaccctgtctatatactagattaatataagaagtgtcaaatgagattcatataaggaacataaaaaaaagactcttgggtgccaccccagattaaattataatctgagaatgagtactactccagacctactgaatcagaatctgtggtcataacttagtcatgagatctcacctcgctgcaaagcagggtggggaaaggtagtctgtaagctgcaggcaagtatacagctaaaacttggttggttttattaccaaaaagaagttagaataaatattgagggagacaataagtagttttctacctgtgaattagagtttaagacactcagcagtaataattatttacggcacttggtagtgaagagaggacagtggtggaatatgaagctggttaacatacataaaatgggaactacctacaggaggcacatactcccccctgtaagagtctaggaggtgactcaggctagtgaaaaagggccagtcgtttcagaggctggaggggctcttttaaagtggcatctctagtagttgttgccatgtaggaaagtggactaaagttttatagattcagttagaaatctacatttttatgaaaatgtgagcccaatttaacatatctttaaattagatatagattaagagccatttatttctcatttttgacctgaatgttatggcacaatatttcgatggcaaagacagcatttttcgtggtgtcaaactatttttcatgcaaattcattatatttaaaaatatttttgaaaagaaacttgataaaaatggcaaaggtattttagtagtcagtatccttttggccatttctagtaaattatgtgattcctttgtattcctaagttattatatttgaattgattttacatttttgggtgatacttgtagaactctaattttgaatgaacttttaattcaataagtatgcatttcttgaccacttttaacagtgattttgtgttctttgtgaccctctatctccagtttattaagaactacctctgcatgcagaggcactttgtaaactgtaagaaactctaatgatattttagtgccttgccactgtgtctggcacaaaaacacccaatgaataagtggtgaaaaaatgatacctctgttagataatcattaatgtttacatcctatgacaaggtgtctatagatttcaattatactaaaatcagtaggataccacaaatcaaaaatattttcttcatcattcttttctccattttacaaacaaaagagattgaaataaactttgtatctattgacaaataattggatcctgtagattgagttaattacttgttagaaaattacctcttctgcttcattggtcaagatgttctatgaagtagaatttgttttgactttctaatggcataacaataaatgtctaacaatgtctttcttgtatcttgggactagtttatctcatcatatctggctgacaaatgctttggcagtgacagtgtcttggatgacagtgctgttggattagattggctaacttctacagtttaaattaaaaccaggaccctgaaatgcttctcggaataatcatgttggttaccatgcccattgctcaatttttttccttttgttgaaggcagctctattagcatcttgtctatacatttcttgactagcgagaagagatacgaggctttagggctgacgtaaactctcatcggttggacaggtatcatgctctttttcatttatcaattccaggaaatactgggtttggtccttgttaataaggaaggagaaataccaagactttcgtgagtacttaaaattcacaagttatgaagtttacaatgcgttagttctgtggagctctggtgggggcatcttctgaatatgggcaggacactgtcctgcagctccctggttatttgaaaagggatgaaggctatgctgtctggctctcacttccaccttctgactcccactctttccctctgctgaaaatggtgagtcaaggccagctggcaaaaattagcatagaatggggtattgtttcatcaaaatttggcaattggggagtaatttttataaatattgacacttttgttatctctgggaggtgattggttgatattctatgtatagccatttggccacttcttaatatagaagaaaatatttcctgagtcacctttcttaattttctcaaaataattaccttgaattgttatagatccatcttttcatgccaacacaaacttttagatgctgttgagtatgtttttaacaaagtataagtagattggttttaagttgacttagccattgttaatgattcagttgattttttaaaattaagaatgcattaaaaatgaaattgatacatttatggagaattcataaacgattcaaatcaattactttatagacataatacatatattttgtatgtttttgtaatttttgggaaaaaattagcttaattatgtttctgagtaagctaaagacattcaactgtattctttcaaatttgccaaagaacaaaaagtaagattttgtcatttggtttattggatttttcattattcactatgataacagtccaaaaacaagaatcaatttcttaatgctttattatatgttttgaagggagttcctttgttctgtgtttaccttacagaacctcagagtttaaagccacattctgtttttaagggaaagcaagtcttgtcagtttttataattgcaaataggataggaaatcatgaatggatgaaaagtgtagtgtgataagtcattcactagaaggggagttgaggcagtgaggggcaggatgatggagtgataaagttcatagtaattataggagaaagtgagtataatggcaataaattgaaaattgaccaagtaagatatttgaggaaagccagcatattgtgatcaacatgctggtgtaacctaattacttatataacctgaaagtaaattccaaatttcttctggcaagaaatagtgattttttttcctatgcaagtaataaatttgctgatttgagttcttatacaccttctgggcataacacaagaacatgaaaaatgttattcttcaaattactgaccttatggctaatgcctttccttaatgctagtctcattatattctattcttggtcagaaattccatatgcacagctttcattggaatccttagcattacttttgatattccaaagcacttttcttaatattctcttgccattcaccttaaaaaagcagtagatatagttggttttgttaagaaaagtttcattggcaatcatttatatttctcaagtattgttgctaatcaaaatcctaatatttagcctctctttagcattttagtttgcctttttcttagaagatactagcaaataatatagtgtttcaaagtcacaatgtcttcaaatcttacggttgattcagactgaaatcttttatggattttatgccccacctggagcagtactcagtaatgtattcacagcaaggatgtactctaaaattaattatttgtgtcattcatctaggtattccctcactaataaattattgctttcttattcagtataaatttgcttttcactgttttgggtgacctcggtcatcagtgggtagttaaaaattctcttccaggaattccctctgattatctacaacattttgggctgaataataggtgtgctgcataacttggagaggtgaccctttgatattcagtttattaattatttatggagtgactatggaagtggagtagtaggagataccaaatagtagaaaatactgtccttgctttcaaggagttcatgatcgtattatagagacaaggtatacttgaaagtctaattatgttgctgaaaaagtaatagaggccatatatgtcatcgaatagtggggggcgggggtgggtagggggaagacaggatggctgtgggttagcatgagaggagaagaagtgatagagaactagaactgatccagtctatttgcagttgttagaatttgactgggccgctaggcagggcaagaagtggaaaatagggaagcggcttaatgtcatgaataaaaacagagtaagagactcactggtgtgatagaaatttctactttgaattatagtggagaacaagtttaaaaatagtagaggagattgaatttgaggaaagacaaatctagattttttttccaggagattttcctcttttgtttgaattatggttatttgaataatccatttcaaaataccacttaatcagacagtagagggaactatttatatgacgtaaaaggtagtttggcagacatgattaaggagaatgttagagaataagatatcaacatggaaagagatgtgatcttttttaatctggaaaaagcaagacaaattgctttgaacatgtaggtgaaaacgtaccttaatgtttccaatttaaccagaaaatatgattaatgtaaaaactatagcaaacacagtaattttactttgtaattctgctataatttgtttcatttgccatattttatttttcttgttgtcatttgaatttatacctgggaatgccataaaacttaataccttagaactataatcaagtcagaagagcttcttttccataatggtgtcatatggtttgacatccactcgtcatcttcaggatgttaaagtctaagatatctactttacatattttatgtattcaaacaataaggttttatgcatgagtgagtttgaggctttggaatatgtgcacccactatttagtaaactgttgccttccattgttagggtatccttgtgagacttaaaaaacaaacaaacaaaaaacaaccagaaaaccaaagcaatgcccctgaggccaactctgtaaacttatgggaggtaacagtaaatgtttcaaggacaattctgatatgattcctaccaatgtcacatagctgctgacatctgggaagtgacagtagctgacagaccatgttggcacagcagaaatcagagatggactagctcagttggaagaaaaatgtcatgctgattgggaagctaagaagcagaacgccacagtggcaacctgtgcaaacagtggctattaacattaactaacagacagattgagtccagctagggctgcggaccacccatcagtggatctgccatgcctgtacatataggaagttctttgctgtcagcatagcttcgctcagtaaaagagaagtgatgtttatgttcattattatgcttatgttgggtggtgacagataaaggaatgtaccttttcttatgaagagtaatgcaattttaatgagaatttgaccttgaaggtaaagaattgctgaagcatcactaattgagtattcatttaaaatgtattcccagtttagctgctggttcatcctcactcatccctgatctcaacattttcaagatggcaccctagaagttggagtatgttttagggcaatggagtcaaggcctttggactgaaaaataaaagcatggaaatagcatttgcttttactgttttatcatctaccctttggctgcctccctcaatgttggcgtcaagggtgattctgaaacctcaaagccccagtgaagccccaaccgcatctctaaccttttacctcttagtccatgatcttcctagctgccttacagaacaaaaacaatgaccttgagatgggattcaactttctcagttccttaccttattgtatacaaaatgtattaatttctgcactggagacttgggattgcttctcctacccaaggctaattttcatacttgccttttcaattgcatttcctcccttcttgctggaaacttttctttttaacttcacatgtcccttctttctcctgtcttcagcctctctgctgcgtggactcatctgagcctgtaaacatgaaggctctgttttcttaaaaccaagttgggaaaacaaacaagctgcctttatttcctccttgcattcatttttctacaattctttaatcgttttcctttctcagacaagttgcttaaatgagttgtttaaaggagaacatgatccttcccttccccgccctgcacgttctgctgttcacatttctgacctttgattcattgaaactctttgaacagtttgagaagtttatcaaggaataacttaagaaaaatactgcatgcaatgagaaggtcattaggacagaatgagaagcttggtgtcagagctgatgggccctgacttagcctgctaggtaacacagctcttgtttgtttgtttgttttatttgtttattccttgtatatttgtgtacacatgtttcattctctttgaatagccacagatgaggattcattaagagcctagactttttaatagacttacactcctttagaaatactttaaattcaataaactaaaaatatccagaatcctgcagtcagctatataggagactacatgtcgatgtctagtttctaagcatggataggtccagtattttcagtcatggtttttctataattttaccatagcaaatatgtgaattgtctgtggaatgtttgttctgtcaactgaagaatgacaaggctcatagatttggaaggaagacttttatttctcataaagagttgtggcctgcaggtggccatcctggcaggctggaaagggtagcttcctgccagaagccagaaacaggcactccgagggagaggtaaaagaaacaggaatttatgctgggcagggtggctgaatacacgtatttaataagctgtagcaggggtcatgaatacttgtgaaaggagaaacagacccaagtgcaattgagcttcatgcttccagatgggtcatgtgttcaaaaaatggcattggcatgatcagtgggtggagattttggccctctgatgtcgaaaagtgaagcagaggccaaatccctctgtgtgcagcctctgtagactggccagaccactcagtggtcagtggtctcttaccaggaaggaatgctggtgggttgttgtgtcaaaattgcaaaagggagaggcagcagtcagggggctgggtgaaatcagcggtgcagcaagtcttctgaaagggctggtttctgtttagcccttagggaagaaagcctaaaggcacttagcgcgggaggatgcatattaaattgtcctacctcactttcactcacagccgggaactcagtttttaaaatttgcctgggttctccatcgtgaagaggcagtttgttcaatgagttcggaagacgggcagttaggatttcatttttatttctcaatccatttatttacagtttatactcagcctggttctagaaagttgttgggtaagtgactgccccacaactttactaccatagtgaacaatggtcaaggagaaggaaattcagaagatcttaaggaagacaagggcttcaggatggtgtggatcatgctcaatgacatgagatgcaggaagaagaaatcctacacaagttcatgtgtaatgggccagctgggctgtgtggagcttaagagagtaaaaggtgttgaggctgaggcagtaagtgtagacagtatgaaatgtaaaggagaaggtggagatttgttggaatgagattgatcctataatggattcattacatgatacctatttgtgtaatactctagcagttgcaaagcatgctcacttgatttttttccttttaacctcctgaagattctagttaggtgggacagtaaaattgttactgtcttccctatttttcaaatgggaaaatcattttaaaacagtgagttgcataaatcacatagagagtagctgagctaggatttaacagaagtttatcttaatccactcctgtgatctttctgctttttcagttgtcttttcttctaatttaaggctattagataacaaaagcagaaagaaaggaacttctgaagatgctcagagagacattgggaaggacagactccctcagaacccaggaggagccaggctctagaacatggtggatgagagaggacattactcttaaagagaaagaaagattttcattctccattatttcagaacaagctgacaggtagaatttagggtctggaatttggaatatgttaagtaaagaaagaatcttggtgagttctcatgagatgggggtccctgggtgaagcctgatgcaaagcctttgaatattctctgttgataatgcaaaagagcacatttgattgcaagttttaattggtctcacatagtcatgcaactgtgtgtttgtgactgctgttcgccaatcttcatggattattgaaataaagaaagcaagcacttggctcctttcattgccaaatcttttctacattgatactgatgtctctttcagaactggctcttgcagaataaagactttaagagattttaaaactctcaccgtattccttgggttcttgcctacccccttaaggagaagaggccaattgtgcttttgtaggtgttaactggctcattccccagcctctgtttccataaagctaaaggtcagtctgatcaaaccatcaatgacagtccatctcacagatgcttaaaatgtgtttttcagtataatcttgaaatgtgataccgagcagacatctcgtgtctcaaagtgttaatatatcaataacatattacaactttgtttcttaaattatcctcttcagataatattaaattctaagtccccagataatgaaaggtgcattgttccatcttgtggcagagaaccatttagaaaacattttgatctcattttttaaatcattagaatacgctgttgtattttttattgttttcatagcttaagaatgacccctattttttattgtacccctgttttggacaatttaacccttttgataacccatattttaaaaaaaaattttttgtttatctattttaactctgaaaaagtgaataaattgaaaaacaaaattagtatttatatggttccgactcccaggattattgattcctccttttttgtatctttatgtaaagcattattctttctactttctagttacagatacacacacacacaaacacacacacacacacacacacacacacacacacacagtgactattccttgggttttgcatagttaatttctttctttctttcttttttgagacggacagagttttgctcttgtcacccaggctggagtgcaatggcacaatcttggctcactgcaaccttcacctcccaggttcaagcgattttcctgcatcagcctcccgagtagctgggattacagtcacccaccaccatgctaattttgtatttttagtggagatggggctttgccatgttggccaggctggtctcaaactcctgacctcagatgatctgcccatcttggcctcccaaagtgctgggattacagatgtgagccaccttgcccagccttacatagttaatttctatagcataattatactgctctgtaagcagatttcctgtgtgactgcattttgtcatatatagcaaaattagtatgtagttttgtaaggttcaaattgatgttagaactaaaggtggaagagtacttagctttgtttcttaaacttataccatcctcctaaaagcaatcttgcagacagatgcaggggtaaaaaaaaaaagaaaaaaaaaaaaagtagtgggaaggcctttgtcttttgaaagaaaaaatcacatagtgatactctgaaaagctctcatcggagaataaaggatgcaatcgctgtattaaacacagatggaatatttcagtctcagctgtcattgaagaatctccacattagtttggattgcgcacctttggggcatgtataaattgacagtgataaaactacctcgttgctgagctggagtgtacaacatccctttatctgtgccatctggtgctacagaggatggcaaattcttctctgccatgatttttctttctgggggatttctagacttccttagcatagaatgtgttggaccaaaatcactctttgcccagatttcagtgacagtagcctgaaaagagaaacagaattctaagagattgtaagtgtagcaggaggcagagaaattatttgatgcactgtaagatattttggagggtagtggttgattacaatgtgatgctttataatccctgaccatatctcactccctagtgatggcaagctgttcctagttttgtttttgccatttttactattgcttgtagcataataatattaaacaattaatgctttggttcttacccactgaagcaatgaatggttgttattctgccttagggctcttatttattgtggattcccaaacaagtttacaatgctttatcatcacttactcaatttatctaatttaagaccaataacaagatttactggctgttgagtcttgcaacaacctgtgttcctttattatctaccactgcctgtgattaaaatgaaaacaaagttggattgcattttattaacaaaaggatatttccaagaattatgaattagtgatagaaggtttataaatgattaagttttaatttttccccccaaattgtacttagcttatgtaaaacagtctagacccgtttaggagtttatttgttgtcataaaatatcaaggtgagagttgacttttctctggatttgttcagtagagaactatgctgggaaggactatggagaccttattaatagaatcacacctgaattgactgaagccaggttacaatcatgaaaaatatgaatgaaaattttaaccaaataaaaattggggctgtttgggttaaaattgaataaaactaagttaaatatacaactgtttgtggcctagaggaaagttacattggttttttttagttcttaggtagtgtagtgtggttagaaccttttctgaccagacgaggttgtattcacctctactaatttcttagctctgagcacttccagtgaattacctgaactctctaacacccgttttagctcatcaaaattgttcatatttcccttttcattagggaagggaggtttaacaagtaagttctttcagtcttaatttgcagtgaggttgtttcctgtttgtctacgaatttagccataactcaccattcctctttccatgtagaaaataattgtggtttttttttttttgtataaaaaagtgaaagtgtgtccagcaaggaataacttggggaaaagccaggaaagcactatcttattagatataaagcattccagtgtcaccacaagcagttgtacaaagaagaaagattggattatgaaactggactgtaattcttagacgcagtaccactcctagaacacgcttgggaaaaagtcagcaagaagattggacctggagggagtgctagaaaggcaagttggtggcaggagggcaaacagcacactttttttctagctatggttttctctggacattctcagtgccttgatattccagtgctggatgggaaaccactgatagaacattaatttcttactttgctcattagtttaagattacagtgttaattattcacaagagaagaaagtaaggatatctttttttttttttttgagacggagtctcgctctgtcgcccaggctggagtgcagtggtgcaatctcagctcactgcaagctctgcctcccaggttcatgccattctcctgcctcagcctaaaagtaaggatttcttacttcttcttcacatctccccctttagagactgtaccagatttaagcctgagaactcattggttccttctggtctaattctagagacatgtgtaccttacttatggatacttggcaaggtaggcattagtatttggatgcttatcttcacaaacctgagtgaggttcattgtgagggtagaattttggagaaaaatgcctgatttgataaaaaagagtttttcagtaaaggaccacctaatttctgccttctggacagacttcacaattggggatacaagtggtattctaattgtgagcatcatcctggtttccattccacccctagcagagtgcctgccatgatggtgctttttttttacttgataaagggattcacacaagggagatacaaggtgagcctgatgaatcttgttccccaacctagaagatgctcagcctaatgaaatcacctcaaaaggaaacaggagccgactggatggcacttgcactggtaaaattttggaattttgagcatcaaaaaagaataacgactgtaatagattgcaatatattgaataaataaaagccattgagtaagtgatacacttagtgatatacaataataccacttagataacatcataaaacatgaaatacttagggataaatttgacaaaatatgtgaaagatctgtacattacaaactacccagcattgttgagagaagtgaaaaaagactgatgtaagtaaatgagagatacagtttttatgagtcagtttttatgtcattaaaaatgctaatcttcaaattgtttatatataaatttagtgtaatcccaacaaaccttgacaggcttttttttttttttttttggtagaaattgtctggaattgatagaatcaggtataagctgattctaactttatttggaaatgtaaagaacctagaatagtaaaaacatttctggaacaagaaaacctgaaatgaagagaacttacagtactgaatttccagacttcctataaagctacttaagtcaaaattgtggtattgacgttaggttagaagatagatcaataacttgaatagaatccccaaatagaccacagttatacagtcaattactttttggcaaagatgtctagataattaagtggagggaaaggacagtctgatcagcaagtggtattactaaacacacccatctccattcaatacaaaattcacttgaaatggatcatagaaccataaaatttctggagaaaaagaattggagaatttttttgttattgcaattgtagcttaggcaaatacttcttacatacagcatacctgaactgcagaagaaaatgataaattgtcaagccaaagactgggagaaaatatttgcaaagcgtatgcttaataaaggactagtgtctaacatacacagataactcttataatttaatattaagaaggtaccctgattaaaactggggtccaatatttaaatagacatatttccaaaaaagatagacacataaatatatgaaaaagtacacaatgtttctagtcatcagagaaaagcaaatcaaaattacagtgataacattatatacactgaaatcactaaaattaaaaggactgaaaatagcaagtattggctggcaaagggcaaagcagcttgaactctcatacattgctgggcaattcagaatttagaatagtctaatcattttgaaaaagtttgacattttcataagttaaacctgtgcttagccattgtgttcttaagtatctacttaaaagaaatgaaacttatggtcccacaaatagcagtaagtgaatgttcacagcaactttgttcataataacctcaaactgcaaccaacccaaatatccgtcacctggtaagcagatgagcaaattgtgctatatctatacagtggaattctactcaatacagtggaacaactacttttacatgcaaaaacatggatgagtctcaaaagtgtttcacaaagtgaaagaagccagacaccagagactgtatactataatatgattccattaaatgaaattcttaaagagcaaaactgtaatgatacaaattagatcagtggttcctaggggtgaagtgaggaaattaactgcaaagagcaggagggaaattttgggtagtggaagtgtttctgtatcttcatcgtggtgatggtcacacaactctatgcatctatcaaaactcaaactttaccactgaaatgggtgcattttactgtactcaaattagtcctcagtataattgtttaaaaataggaccatagtggtatttgaggggaaaagaggtaggggtgatgggtgttaaaataatgaaaaaaggaaaaaaggaaaaccttcagcagtctgcctgctaataaatgtaggagaaattatagaattggcaagatttcatttttaaaatcgttacagtagcaattgatccagtcaagtggttgtcagtgacaaccacttgagaaagttgttgaataacaagatagtcacaaatactgcgctacaaattactgactaccttaattggataaagtgcacctttctaatacccatcatttccatcaaaactcacattgctagcaatgaacaacctgacaccactctgaaaatacccatccttgtcatcaaaattcacattctagcagtggaccacctgatatcacgtgtttgttaatgtgcacccccatgaaatgttcttgttcatattgtttaatttgaatctaaaccaaactaaaaccctaattttcaatgtacaggaaatacaagggatagagaaatgagtttaacaatgtcataagtaaatgattggccaaatcctgaatgtagaacattctacaaggcaattgactggactcttcaaaaagttatgtcaaaaacaaacaataagaaaacaggaaagaaaggggaacttttccagatttagagttgaaaaagtcacagccaaacgtaatatatgcagcttgattggattcttgtaggtggaaaaagttgtaaaagacactttagagcaagtggaaaaattttaaaatatggatgggccgttagacatagtggaatttggttaattgttttggtgtgataatggcattttggttttgacgagactgtttttattcataggggaagcatggtgtgttgcatcatgttgttggcaccttgctttgatgcggaaataaaagaaaggaataattcacatccgcataaggcaacaataacagaatataaattattaaatctgggtgaagggtgtatgagcatttatttactcattaacttttctacgtgcttaaaatgttatgacaaaaagctgaaatataaatatacccttctctgggaaagatagctctgaagagtagtttacccccggaaactctttgagacttttgattcttaagtgatgtgaccatttaagaaggcacatccctcttactccctcttttctatcaagtcctcagttctactaaaaaattatgtttctatacaggaggagaaatctatgagtactattttttttttttggtcagaaactaaagattaactgatttttaaatttagattaattcagaaagaaaatgcattagttaaaacaaagatgtaaaacgtttttattttttaaattcatattttcatttccatagcatttggggtacagtgcttttttttgttacatagatgaatcctatagtgatgaattttgagattttagtgtacccatcaaactgtgtgtacattgcacctaatgcgtagtttttatcgctagccccccctttcatcctcctcctcctgagtctctaatgtctattatatcactctgcatgcctttgcgtactcatagcttaacttccactagtgaggacatacagtttttggttttaggttttctactcctgtgttactttttttagaatactgtcctctagctccatccaagttgctgcaaaacatattatcttgttctttttaatagctgagtagtattccatagtgtatatgtaccacattttctttatccacttggaagttgatggcatttagattggttctacatctttgcaaatgtgaattgtgctgctgtaaacatacgtgtgcaagtgtcttttcatagaatgacttcttttcctttgggtagatactcaatagtaggattgccggattaaatggtagatctacttttatctctttaaggattctccatactgtttttcatagaggttgtactaatttacattcccaccagcagtgtataaccattcccttttccccacatccacaccattatctattgttttttgactatttatttattgagatggagttttgcccttgttgcccaggctggagtgcaatggcccaatctcagctcactggacctctgcctcttgggtttaagtgattctcctgcttcagcctccctagtagctggaattacagctatggaattacagctggaattacagcacatgccaccatgcccagctaatttttgtatttttagtagtgatggggtttctccatgttggtcaggctggtctcgacctcaggtgatccgcctgcctgggcctcccaaagtgctgggattacaggcatgagccactgcgtcccactgactttttaatcgtggccattcttgcaggagtagggtgataactcattgtggttttaatttgcatttccctgatggttagtgatgttgagcattttttcatgcctttgaccattcgtatgtcttcttttgagaaatgtctatgtcttttgccccctttttaatgagattatttgttttgctgatttgtttgtgttccttgtaaattctggatactagtccttagtcagatgtgaactttgcaaatattttctcccattctgggtgttgtctgtttactctgcttattgtttcttttgctgtgtggaagctttttagcttaatttggttccatttatttgtttttgttgcatttgcttttgggatcttagtcatgaattctttgcctaggccagtgtctagaagagtttttccaacattgtctgctagaatttttatagtttcagatcttatatttaagtctttggtctatcttgagttgatttttgtatgaagtgagatataggtatccagtttattcttttatatgtggtttgccggttttcccatttaatacataggatgtccattccccaattcatgtttttgtatgctttgttgaaaatcagttggctgtacatatttggctttatttctgggttctctgttcttttccatagatctatgtgcctacttttataccagtaccatgctgttttggtaactgtagtcttgtagtataattcaaagtccagtcatgtgatacctccagatttgttcaaaaacttttgcttaggatagctttggctattcgggctcttttttgattccatattaattttaggatttttttttctaattctgtgaaaaatgatgttggtattttgatggaaattgcattgaatctgtagatttctttaggcagtatggtcattttcacaatattgatccttctaatccatgagcatgggatgcatttccatttgtgtcatctgtgatttcttttagcagtgttttgtagttctccttgtggagatcttttacctcccgcattacatatgttcttaggtattttattttttttcctgatgttgtaaaagggattgagatcttgatttgattctcagctaggtcactgttggtatataacagtgctacatttttgtgtatattgtaaatctaactttctaatgtggaactaatgagattggaatctgaggctagagtattagctttatatttttgcgtaataaattaccacatagcttcttaaaacaagtctagtttattaggtaggagttctgaaggccagaaatctggacagactgagctgagttctctaattagggtctcacaaggccaaaatcgtggtatcagccaggctgggctcttttatggaggctttgggatgctctgttgcagagtttgacctcctagacaggcaggtctgaggtccccacatcctttctggctgttcattatggtcactccctgctcctagagggtgccccaattctctcttgcatttccctttcatcggcaaatgagcaacatctgattttttttcttccctaacttccccttctgctaacatcaggagaaaactgtttttaaatggctgatgtaattagatgagacctactaaatagtctctctggtttaaggccaactgtatcatataacataaaataattccagggatgatgtctcatcatatgcacaggttctagctatactcagtgggaggattatgcaagggtgagtatcactgggaattcttaggattctgcctaagagtttctactttggtttttgggagacaattttttaaatctactttttaatctacttactggcatgtgtatgttagttctctgtgctttatcacctgcctatttattgaattgtatgtgttacttcactgtacctcagcatctgtcaacttatttaaatgtgtgtgttggttttctgtgccttgggatctactcattcattggaatgtgtgttttggttgattgtgccccagtatctatgtattgaaatgtgtgtgttggttcactcagcctttccatttatctatgtattgaaatgtgtgtgttggttcattgtgccatggcatctgtctatttattgaaatgagtatgttggttttctggacctgggtatctgtctatttattgaaatgtgtgtgggggtttcatcatctctattattatattattattattttgagagacagtattttgctctgttgcctaggctggagcgcagtggtacaatcatagctcactacagcctcaaactcctgggctcatgcaaacctccagcctcagcctcctgagtagctaggactacaggtgtgtgccaccacacctggctaatgtttttgttttattttattgtaatggatataaggtcttggaatgttacccaggctggtctcaaatccctggcctcaagtgatgctcccaaactgcagggattacaggtgtgagccaaccatgcctggcctcattatgtctattttatctgtgtattttctcaatgtaagataaacagttatttttatcggaaaaaaatttttggttttaatattatttaagagggcaggcatttcctttttaagaataaagcttctcagctttattttgtaatcataacacagtaatgacatttttaaaagaaatatacaatgccccttttttttttgtattagtttcaaagatattccctaaactttaattctgttttctttctttctttttcttttgttttttcttttttgtgatggagtctcagtcactctctcatcacccaggctggagtgcagtgatgccatctcggctcactgcaacctctacctcccaggttcgagtgattctactgcctcaacatcccaggtaactgggattacaggtgtgctatcatgcctggctaatctttttttttttttagtttttagtagagacagggtttttgccatgttggccaggctgatcgcgatctcctgacctccagtgatctgcctgccttggcctcccaaagggctggaattacaagtgtgagccactatgcccggccaactttaattctttacatcttcggcacatttattttctgattgctctgtatgaaatcaaatccagccataactttattgctagcatgcttcagttatctatttctgtaaacaagccagcttagccgcagtagtataaaacaaaaactgttttattatgcttctggattctgcagtttaggaatttaggcagggtatggcagggatgcctggtctctgcatcatgatgtctggggcctcagctagaatggccaaggcttcaatagccagggagactcaaaagattgaaatctaaaatcctctgaaggcttctttactcttatgtctgtatctgggctgagatgactaaaaggctgagctcagctggggctgtccaccagagtgcctacatgtagcctcctcatgtatcttgggcttcctcagagcatggtgacaccagggtgcacagatttcatacatgacagctctaggctcccagtgcaactgaaaagttaatctaaaaatcttatatcacatttgaaatagaacatgtcccaatattgtttctcatatttgatagtggatgtttttgtgtatcttaaagtgtgttcatgtgttttaagttatggttttatctctagagaaaaagcaatgatgacttctaaatcataaaattgagactcttagatggatggaaaaataatatattacctatatattattcatagataagtagcatttttatttcatttcaaaataattggcatcaatttgaataacgcatagtttaagaagcttgtagcataattaaaaatggcaggttttgctttgttcctgtatcactaatgaactgttagaattttgtagagagctaacaacttttggaaataggaaggcagaaaacattactgatatagtgatataaaagaaaggagaaaaagatacaattagtatttataaaatgaaattatatttgccttgttcctggctttctcaaaggaaagaaataactttttcttgtgttacttaaaatgagatctgatgctgctgagttctttgtttttttctatgataggcctgaggaaattaggacttcatttccccaaatcttcatgggtcttgaaccaacagaaatgtgttatagtagccacctgcgacactaactctcctcacagaacccatcatgatatggtcttagttcataattcagtatttccttagatttatagtgttgtgtttaatcttagagccctccatgttattttccaagtagtctttagtttattaagactatgtttattcttactagtttgagaagaaaatcttgaaaagtcctggcttcaccttccttttctaccacctttatagaaaatacacctcttatacctgtaatttagcaaattatacccgtaatttggcactttgtagacataaggtaaagtcattttagggggctgtcccagtggggacacaagccatctggcccagggatattatgtgcttctcaactgtgacagttcttcctactcattatataatgggcttttctaaaagcaattttttttttcttaaaggattcagcaaacccctgagctgtaacaataggattaagtgatgctgacattcaaagtccggaggttctcagtgtggtccctgggccaatagtatcagtattacctgggaacttactatgaatgcatgttcttacacttcacccaggatctacttactcagaagctctggggctgggatccagcagtcttttaataagctatgcaggggatactgatgcaggctaagttttagaaccactgtctaaggatttgcaattgttcttagtatttaacatgcattgtaccttcttatccttctgaataagtatttcttattatttatgtaaggtagctttatatgtataaaatagtcatacattttaacattatacgtatatgtatatgtacatagtcacatatatttttcttgatttttacattaatttaaaaatggggaatgcactgtctctgccattgtcctctccagattttgagatagaaatgaagaaaaccatgtaaaaatgaagataagtagaccagggtgggactctgtggagctggagatcgatgggcaagagatgtgaagaaggtgaggagaaagggatagagtaagggggcaggaccttggcctgtaacttgtgctgggagctcagctgagagcatcactggggcagctgagtgagaatagagcaaaagctgttgctctgtctatatggttttaaccagggttgttttattccagggataatgggaaggttggatcaacacccttttctcagttgattcttctcattgatacctttgcctttagcactgtgtaaactcattcctgcagtaaaatgactttttaaatgattgctcacttgtcactaacttgatctgcattgtcacagacttaattataaaacttttaattctacttagtactgtaacataggatagtgttttaataggtagaataggattgttttgctatgttagattaaatatggagggggtgttcatatacaaagaaccatcagttgctttttccaggaacattatatcattgttttaacaagtaaaagagatttcatttacattgtttccatttacaaagctttttctcagagtttgtcttttggaagtccacactctttgttttgtaataggttgggaagcaacatggctctaagcaagttaaccctgttttaaatttattcctttattaattttttggaatagtaatttagttatgattcacaatttcaatgttatctttaatgtgttaacttctagttttagtgtatgtacccagagtagatacttactaaatgttggttaaatgaatgaagattggctttgttaagatttttggagagagctccttctgtgttgtaaaggtgctcagaagggtgattttttttctgctgctctggtttgatttttgcattatatttttgtagttaaatattaatctctcttttgaaatccttaattgcatatagatttttaaagttgatctttattttatggttctttgctttaaatgttccacttaattttaaatgggaaggatttaaaacaagctctaaactagtatagaggacatgtacatatcttgaaaaatgacctgttataagcctgtacactgtggcatttactggtaaggtttctcatcatgtgcatgtgaagagaaaagaaacaaacttattttattgctttaatggcgttgtaaaaaatggcaagaacttcagcaggggtttatatcagccagctcatttgggtttctaacttccttcttattgcttttccttcccatagcttcctgagtggcctttcaagtttttttttccacttacatatactcatatttttcttttccatgtaactctgacacatagttactctcacaggtctgtcactactcagatatcctctctatggtgatctcagaccgtagccaagtttcatccccctaatgctactcagccagtggatgctgacatttcagaagggaagtgtggatgggccacaaagtaaggacttctcatttctttcactgagaagtattttggctctttggttggttctaataacaactaggactaccttggagtaggaaaacctgatttcagagtctaacaaaacccaaaggtaggcattcagaaacctggacctcacaaagggaaatgaaaagtgatcaagaagctagatctggccccttttttctatctgtattagatatctgctctgttcttttctcaactctcaattgatttggtaaagatggttaaatgagaacaactgaattgtaaaattatctacatttcatgattaagcctgactgaattaagatctttgtaccagagagtcattcagattggtccaacttggaccatatattctcctgtatccgacagactgtggacaaaagatggggttcacagtaaaacagaatgtggaccctcaggaaccttgtcccatggcaaggtcagatctattctgattcaaacgaggccaaagcaaacaaaacccaaaatttggggttttaattgatataaaaacattttgaattttgtagcacatttttctaattcttaggtgccaatttggagctgacagttcttatttttcaagatggaacagacaaatgtttttaatctgtgtggaatgagaaactggggaggatgcagctgaatgtatgttttaaaagagagagagggtttaatggctgaaacaagatctaagaggagtcagaaagagatccagggccagtcagatgaaactggtggccttgggcagaagaaaaattgttctctaagacaagggatatcaatgtgcctgtgtatcaggatttggagagttgaacttaattcctgagtgggagtcaaggctgtcagctaagattgatagggttgagtagggaccaggcggaaaacagtgaagtttgtggaatagaaccatgaggaaattaaagaatttctgacggtgagactaaagtttaaaatttaaaatctagaccaagaggtaccactctaacccattcccctccagtaaaagcaagtgattgattaattgagtggggctgtccagtcagatgcaacagaaggactgagggaaaagaaattgaaaaaagatagttgacaagtgagagagtagaagtgcttcattgtggggtcctatctgagtagggaaggaaataaagacaggaagagacacagttgttgaagaagaggaatgctttaaagttgaggtctcaatgttctaggctcacacttagtgatagaaagatggaggatagaagatggaattccagaatcgatgatgttggaggaaatcctgttctggtgatgccagggtctgtgctatggccactggcttttcccgtggtagcatttccttggagaaggtcaaggaacttgtgttttgcggctcttcaatcggcctcccatatggacattgataataatagctaactttctaggactacctattctctgccaaacagtgtaacagatttttgcatacgttacttccaaccattataataatcctttgtaaggtaaatactacctttttttttttttgttacggagttttgctctgtcacctgggctggagtgcaactgtgcgatctcggctcactgcaacctctacctcccggattcaagtgattctcctgcctcagcctcctgagtagctgggattacaggcacctaccaccacacctggctaatctttgtatttttagtagagatgaggtttcaccatattggccaggctggtctcaaactcctggcttcaagtggtctgcctgtcttagcctcccaaagtgcttggattacaggcatgagccaccatgcctggccgatactaccattttcattacacccagaaggttgagccaatctaataatctgtccaagattgtatcgctattaatagtaaattctggagatggaattgatattcaggtatgtctgtctctaaggcctagcactattcacttgctgaattccgccatggactcccaaagccccatcctcccagtttctgtttttcctcttcattcctttgtttttgccttccttaatttaaaaaaagggcgtaaaacgaacaaaaacatgtaatatagcaggattttttttctttttttttttattatactttaagttctagggtacatgtgtacaacgtgcaggtttgttacatatgtatacatgtgccatgttggtgtgctgcacccattaactcatcatttagcattaggtatatctcctaatgctatccctcccccctccccccaccctacaagaggccccagtgtgtgatgttccctttcctgtgaccaagtgttctcattgttcaattcccacctatgagtgagaacatgcagtgtttgtttttttgtgcttgcggtagtttgctgagaatgatggtttccagcttcatccatgtccctacaaaggacatgaactcatcattttttatggctgcatagtattccacggtgtatacgtgccacattttcttaatccagtctatcactgatggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccttgaagaattgccacactgtcttccacaatggttgaactagtttacctcccaccaacggtgtaaaagtgttcctatttctccacatcctctccagcacctgttgtttcctgactttttaatgatcgccattctaactggtgtgagatggtatctcattgtggttttgatttgcatttctctgatggccagtgatgacgagcgttttttcatgtgtctgttggctgcataaatgtcttcttttgagaagtgtctgttcatatcctttgcccactttgtgatggggttgtttttttcttgtaaatttgtttgagttctttgtagattctggatattagccctttgtcagatgagtagattgcaaaagttttctctcattctgtaggttgcctgttcattctgatggtagtttcttttgctgtgcagaagctctttagtttaattagatcccatttgtcaattttggcttttgttgccattgcttttggtgttttagacatgaagtccttgcccctgcctatgtcctgaatggtattgcctaggttttcttctagggtttttatggttttaggtctaacgtttaagtctttaatccatctttaattgatttttgtataaagtgtaaggaagggatccagtttcagctttctccacatggctggccagttttcccagcaccatttattaaatagggaatcctttccccatttcttgtttttgtcaggtttgtcaaagatcagatggttgtagatgtgtggtagagccaaatcatgagtgaactcccattcacaattgcttcaaagagaataaaatacctaggaatccaacttacaagggatgtgaaggacctcttcaaggggaactataaaccactgctcaacgaaataaaagaggacacaaacaaatggaagaacattccatgctcatggataggaagaatcagtatcgtgaaaatggccatactgcccaaggtaatttatagattcaatgccatccccatcaagctaccaatgactttcttcacgtaattggaaaaacccaaagttcatatggaaccaaaaaaagagcccacattgcgaaggtgatcctatgccaaaagtacaaagctggaggcatcatgctacctgacttcaaactatactacaaggctacagtaaccaaaacagcatggtactggtaccaaaacagagatatagaccattggaacagaacagagccctccaaaatgatatagcaggattttaaaaagaaatgagaaataagcattaaaaataaaaatttataagatataggatgtaatcaagggtaggttagcatacaaattcaaggtgttaattttatcgcatttactaggcttaggctgtaaaattggctttaacattttaagagcaagcatgaagaaacaaaaattacatgatactcagagttgagtaagactactcccagtactgagatgtgggagatgacaggccttgggtaatgggaaaaacatcatcattaggaagactctttataaaaatataataatatattttattgagttcttactgataatatctatcatgtaggcaaataaaattctgggagatttaaaataatatggttgagtacggttgctcaaagacaggttggaatgcaggtagagctaggcagatgccacatttttttcttaaagattggcagattaaatgacacctaaagatgggtagaaaaatgtcaccagttcatacacgtaaaaattgttccatgtggaatgatctgagatttggaatcaattactgtaatttcttcaactaagagttcaactccttcctgagcctggattagggctcatatccagaatatactaggacagatgtcctagtgtaatgtcctgctatgacctcgtgacatttttctactcatcttcctacaaagaagtaggatatgaagtctagagggatgagaaacgattgtggaattttttttctctctgtatttttatgtcttttgactagacatggggaggttgtttcatctcacaatctttagggcagtggttgtacaaagttagcatgcattttaattactcaaaagcttattaaaacacagattgctggtcctcaactctaaactatctgattcagtgggtgtggagtagggtatgagaactgcatttttaacaagttcctaactgatattgatggctgctggtcagaatgcacactttgagaaccactgctgtacaaataggaaataaaatgaaattggataataatttagaatatttaatgctaacattctaaattagggaaaatcctagattattttaatgtcttttttcctatatacccatatcctcattgaaagtagttttgacagtaaatctgatagaatttcagtttgttgagatggagaatttgttcttgcaaacttgatcatttacatacttataattttatttacttgagccaacccccttttcgttaatatcaagggtaaaattttatataacctgtctcaaattcataattaattgaaattgtaaagttttgcagggaatttttgtccccctaacacccccaaactgatctgttaattatctcaagtgcaaaagtgcaaagattctagcctctatctttagaatggtaataccaccgagggctatttgaataaaaaatggataatttcttgattagttacaatgctttaaagccatggtttctaagggtattgaagcagagaactcattttaatgactttatttcccaagtatcaaggggccttacatatcaattttttggtttaggataataattttggtgtattgtaacaacactctttttatatagtgttgatctctaaggagtgcttcactatttcttcatttttaggatatctcacaatattagtaactcaaatatttcaagttcatagagaatatgagtaggaaaatagatgactaagagttgtggtttaccagtttctcccaatttggcacccaccaatttgactcatatctaatgagagcataaaatagcctttatctttttttattctaaaaataaagtcattgaaaaacttgttgacaacaaaaaaaagattagagatctgaattatatttctccttggttctcgatacggtttaaaagctaacctgaacaactctgagaacgtcatgcatttactgggtaaaaacatgtgggctaactgggcttgcgaagattctaatataatactttctacaccagctgatagtggtaaaggaagtttcagaacatcaatattaatttgtgtccagctgatcgcctcatacggcatgctggtggctctgatttttctttttttaaaccttgttttaatgtctaataagataaatttctacatgtggaaaatattaaagtaattaaaaacatttggcttttttgcatatattttctaaaattaacttacttgttaacactcatctctcttgtctctaattgggttgaaatgtgtgaaaaaaagctttgatatggaactgattttcaaagtatggctcaactgtgatacacatggaggagccaatatatgcagctttgaaaaagtttctgatgtcagtgtttttacttaggtggcataagatttgaataagaagttgctacatctcaataactaaggtttctgttatcatttggaaatctaagcactatcactttagagctttgagttaaaaggtggtactccaaggtctgcttctgaagaaattgtttctcttttttctttaaaatattcatagtgttggcctggtgctgtgactcacgcctgtaatcccagcactttgggaggccaaggcaggcagatcaccttgagctcagcagttcaagaccagcctgggcaacacgacaaaaccccatctatactaaaaaatacagacattagctgcgctttggcaactcatgcctgtagtcccagctacttgggagggtggggctggagaatcgtttgagccctggaggtggaggttgtggtgagcccagatcgcaccactgcacttcagccttggtgaaagagtgaaacgctgtttcaaaaatacacacatacatacatacatacatacatacatacatacatacacacacacatacatacatacataaaaggaaatattcatggtgtcatctcatttcctagtaaagggggtggggctatatttagtaatttgtttttctaaaggcagataaatactatcctcctttcaagtgctctgtagctggatggctttgtttgactttctttaaaattatttttaaagtgtgagcacacataattttatataatatcttcatcagatttaaatgatgtaatttaggtaactcttgcaaaggctttacatttttttaaaaatgtaaaccatccttactctactatttcaccatagatgaacactcagtacattgacacagcttatactattttttgaaggttgaattttacataaaaacaaggttatattctatgcctgtggaaaagttaatattcatttctttcctgtcatcctgtgagctttattaaaactgctaccacctgtcagcaagaggtagaagagcgtcataatgaaaggaattgatgctgaaatatctttctgaagaaaaatagaagcagcttctttttttgacttgtgatatttggggcctcagctaatcaacgttgcagaagtttgagatgattggaaatcttaatggaggcaaatggagccatatccaggcttgatgggatctgaagcatataaaatttgggaggtttcctttaaagaaaaacaaaaacaaaaacacaaaaaaatgctttcctttagaaatttataaaacttctaatggaaggtgttggattctctcctggggccctctgggcaggagaagcccttaagcttaaacttctttaacttcaaggtacacactgccttttgggcaaagaggagaaatattagttctgcctatgggcatgaggtggtctccaaacttccctccagatctggcccaatttttcaaaccttcaatccctactgaaaataagttttatttctgctatagaatttccaccttgtcttcttcagtcctggtttccagtacatctgtcttataacttgaaatctctgaataaaacttgctgagtaggtattttttaattggtagatgatgagttgaccaaaattcagcacttggccaaaattgctgaaaattgagagaaactgtcatggatgtagttgacaattcattggctttcttcatgttttaaggtagtattaagataacacaccagcaagcaaagtatcttaatcacattatccctgaagaaatgtaatcactgacttaaaatttaatatttcatattatagaggctcaacaggagaactctgtgttggaacattatttccataatacatcttgttcataagatctgtgatgtcaagggctatgtattcatcctgctgatcccaatgtcaaatatgtcttactagatatttgcttcacaagaaagagaagtgctgtgtttaaaaatgtaggctttggaacttaaaatatctgataagcataatcattacacaccagggttacttccttatatcatcctaaaacatttaggaaatgtgctcattttatatattgagaaagtaagattatctttaaaagtgtggattttggagctaggcccagtgcctttgactgtattgcttactttctgctatggggcaatctttatgtctttatgattccattttctcatttataaattgaggtatcttaaggttatgatgatgattaaatggtataataaatgtgggctacttggtaaagtgccacataagtaagccctctgaagtgtttacctattgctgcagctgtttagccattgattcagcatcatacaagcacacatctaatgaattcgtacttttagtgaatgaataaaaaatggtatctttataaactcgaatgttgccccttgttaattttctaacaaattagaactgtgaaacccaacttattttcatttttgccttagagatcagtaagcttagaacgaaattcattattccaatggtgtaacttgttcagttcaattctaggaacaactactactttattttcttcagttgatccctattctctttgatcctttaatttctgattttatgtcatctccatccataaatcactgccaagccttttgaaaggggtataatttatattaaatggcctatctcccattccctgttaacatcttgaccatgtacaattgcgtgccgttctcatctgtgaggttttagttgtagcatggattctttttaggcttaattggaaaagccgtcaatcctgtaaaccacctacgacatcccacagtgtactatacaggttaattttccatgactattacaatttgtgacactggtttaaagagcaaaatccaaattatctgcttactaaatgtataaattcagaaaatgacatcttttcaaaattcttttaaattttgggtaagtttaggtaacgccaaaagtcctattcggtattttagagccaaaatctagacagaaggtgtaatgtaaaacacagttttgtcaaaacactcagaccattggcttatttacctgcttgtagtttatattaaaaagtaaattatcattgaatgagattttaggtctttctgaaaatgagaaatttccattgaaagatatggctagtcatgtttttgttgcttaagattttatagctggaaatactgcattttaaaaatatcttcagtttttcatccacattacagctaggtgctcctaaatgtgttgaaagatttctattaatatatggtattaaatgattcataatttgaagactcttaaagttctttgatcttatagctaaaaatactgcaggtattatagttactagaaaaaatttcccattctatactggcttgtctattatctgcagcttacttagaatttttaaaggacagtataaataaacggaaccccccaaatctggtacttgactgatttgactggaagacccatggcctagttccagctgtgtaatcagtagctatgtgattttgaccaaataagttaacatctctatgcctcaattttcttatcaataaaatgaggaaagttgggctaaactgattcctgagatcccattcagctgtggaagcctttgattctcttgtcacaaagcagcacacaatgaaatactttattcaaaatgaaatggtgagccaggcatggtgggccacagctgtaatcctagcactctgggaggctgaagaaggaggattgcttgagctcaggagtttgagatcagctgggcaacgtagtaagacctcatctctaccaaaaaattaaaataaaataatataaaataaataattggtgcagtgttattaagcattggcccctggaatatatccaaaggtcaggaaagaagttcacaattctgtatagtctgcatagctgcagccaggctggctgatgcaagtgtctgtaaagttactgtggctttctatttgcctgctgggattctagcattgaggatagcctctgaaaaacagtgccactatgagccagtttcagttccattgaaggaaaaaatgatttgagaacctcaaaatgggatccatggacttctgtattctaccagggctcagcaaatacttcacaggtgatttggttggtagggatgaaaagaacgttgagacagctttgttcacatacattcttcaatttgaaatgttaattattatgacaggcactgtagcatgtgtaatcatgaataattataagaagcaataaagctcataatgttaaagagagggaactcgaaaggcagtcttcctgggtttaaatctgagcactgtctgtcaatagctttgagagttcaagcaagttgtttaacctctttgtgcctcagttccttcatgtagaaagtaagtataataatagaacctgccttataaagttattctggaaatcaataaattattaaatgtaaaacatttagaatgtctggcatgtaaattcttcataggtgttatctattgttattacattattttcacagaaaatatttaatgtttgcaatatcaggaatagatttgggtacaaataactgaaaatcctaagataataatgacttaggcacaacaagatggctgctaaagcacttcccttttaaacacaagttttagaagtcacatttgaccatttggtttacctcttcttgaccagaacttaattatgaggccaaataagcttcaaaggaagatgtaaaatgtgcaatttaatctatggggctatgtgattagttcaaaatataatggctttattattgaggattaaagagagaatattgggaaacagcatctttccacaaatataattacattttgaaaaccgagttcctcagttttctcagttaagggacagcttctttgccaaactgttcatattatttgcatatctaaatatttaatttcagttattagtgttgtgttatttaattgccttgcacgcaaaaaatggactgatttctcaaaaatgattacatggcaaaaatagaattaaaatattaacatcagaactccagttcaggcactaaatttaaattgacataagttggtagaaaggactctgctagtgccataatttaggggaagctcctaactacggaaatgtgtgaataggaagtatggcagtgaacactagtgttcagatttgattggactgatgatctactgaccccctagtcacctgttaggaaactgtaaaaataagctacccaaatatgaaattgatgattcttttttcccgaaaggcagaagttaaaacccttcagatgtcatttagaatttcaatcctttgtgtgacacaagtcacattattactgagaagcttgtcaaccaacccaaactcttacgataaatgggtgtagaggggaagcagattaattattggcaaaacctctttgttaaatgacattttttgttcaatgacacatcacacattagtagccatcaatgtgtaagtacagtcactattttatgtactaatatttttctcccagtaaagcacaagaactggggtacagagactgaatcacagttcagaatatattaattacatgcattcattcatttatttgttcattcaacatacattttttcagggccaagagttattccaggcaatggaaatatggcagttaacaaaagaaataagctcttaccatcatagaacatataattctaatgacagagaaatgcttgatgacttttaccactatttatctcttatgaccctgtgttacatgaaaaggaagtgattgctgtgagcattcttgtgtaggctgagcaaggtgaattaggatttttagagagagtgaaacagtttttggttggggcaagagtagcattgctatgtatataagagtttacctggatacttgtctatcttctgctttacttccaagagcatttcctaatcaatagtatacgtcctggtggtgattaagagatgaaggaagtagtcaaaattgtgactaggatggaattgcagtcattgagtttctatgttagtgttctgggcaaagaaatacaatacagctttctccctactccttcccaatggcaagggggtcacacaagattacctgaaatatggaataaaaacatctttttatggacagtagattgactcttttttatattaagtggcatgatcagttggtgtttctttatgatatttagtgtcttgagtagtgtggccctatctttgtatggctgcaatattactgtatttaacattaaggataaattattggagattttgaagaagactgaatagtgatacaaatggttgttaccaagagttatattttttctccattatttgattttctttatttgaataaataaatcgaatagcttatgtacaaatcagtgcaaatgctgcagcaggatataaaagtgcatttctttacgttgaaggaaatggttagctttgctttaaatgtgacgagtttttcaactgaaagtagacataagggagaagtctctccataattcccaggtctacatttgctccaaatattcccaactctctgagagaggcacgccagacttgccgtcattcctaatgttttataatggtaaagaagggctttctaatttagatgaaatagagtaagaaaagaaactgaatggatatggaatccgattttttaaaaattttagatttagggggttcctgtgcaggtttgctgcataaactgcatgactctgaggtttgggcttctaatgatcccatcacacaagtagtgaatagtgtactcaataagtagtttttcaacccttttcctcctttcttccctcccctcctttggaatctcgtgtttattgttccatctttgtgtccatgtatatccaatgtttagctcccactgttaagtgagaacatgcagtatttggttttctgtttctgcattaatttgcttaggttaatggccttcagctgcatccatgttgctgcaaaggacatcatctcattctttttatggctgtgcagtattccatggtgtatgtgtaccacattttctttatccagtccaccgtttatgggcacctgggttgattctatgtctttgctgttgtgactagtgctgccataaatatatgaatgcaagtgtcttgttggtagaatgatttattttcctttgggtatatacccagtaatggggtttctgggttgaatagttgttctatttttagttccttgaggaatctccaaacttgtttccacagggactaacctcatttgcattcccaccaacagtgtgtaagtgttctctttcctccacaaccttgccaacattctttttgaccttcttatagtagccattctgactagcgtgagatggtatctcattgtagttttgatgtgcgtatctctgattagtgatgttgagcattttttttcatatgtttgttggctgcttgtaggtcttcttttgagaagcatctttgtcctctgcctactttttaatggggttattttggaatctgatctttggctcatgtcagataaagatacctttgtgaaagattgcaaacagcaaatctcttgctgatatgaaactagcgattttaaaacttttaatttttatttaaaattcagatgactttttttaaacaaaagattggtgactgtatgctgagtgcttttgaagtagtctacaaatcccttcagtttgagaaatactactcttggcagaagaacagaaataagatacataaaagacaatatgaggaaacaagaaaagtcagagttgggcatataaaacttcagggaatagtggtgggcccagatgttgtttaaggagtaaatgtaaagtttacaagtatttaatgttctggttatctgtgaggtaacaaaccacttcaaaacctaatggcttaagatgacaactatttatctcacaaatctttgtgttggctgtgtgctgctttgttcagttggggccacaccatatgcattcagcctagcttagcagaggcctcttggttttcctccatgtggcagtgtctcatcctccagggcctctccaagtggtatctctctagttggacttacttttaaagcatggcagctgagccccaagatgggtgttccaagaaggaaacccgaaagctcagtgcttgcttaaggtcacttggctaaaacaagtcatgtgcccaagcccagagtcagtatgagaagcacaaaggcatgaatccctaaggcatgtttcactgggatctaccagtgaaacagtctaccacaagtgtggaaagaaagaagcctgtcattgcaatgtttatatttcttatcaaacctgaaggacattctatcttggaaatgggacaagttcacactgtgatggtttgaatgtctatgaatgtgataatcagaatattttaaagcagtggctctcaacttcggctgcacagaagaatcacttaggggaacactgaaaactgcaggtgctttagattgcaaaggccaattaaataacgtttctccaggtatgagtatattttaaggctctttggcagatttctaaagtgccatcaaagttgagacagcactgttgtttctgagattgacttgaaggaggacagccatatattttctttgcaccactgttagaatgcttgcttagatgtgcagtgaataaaggatcaagcgtggcattctttatgattcttgtttggctccgtggttatgatttcttccagtgagataccatctcaatcatatttctccccttagaaccctaaaatagttaagtattttctcaagtggccttacaatatttcttatggatatatctgatttgagttcctcagttgtccttctctgatgttcttgtttcttattcatatctcatatagacttgtcacccttctgtgtctgtgtcacttcaaattatttgatccttactgtccttccacatctcagtcagagcagatgccttcctaatatctaagctatcaggcactttttcctgattgtccttcttcttgtaatgttctcataataattcttcatgactgcagttactcaaatgagttctataattcaacacctttttggttcctctgaacacataaaattaaaatttaaatgcataaactttcctatctgattggccacacctttaagttttttgtagtgttaatttatttcaaaatgtagtatgtatacctggtaaagtaaaacttttcaaataagtataaattaaaaaggaaatctctttccatggcgcacccacagtttcattccatggaggaaactattagtgcttgtttgtgtattcctccagaaatgtttttatataccataatatacatatttaaaaatatagcagtgtttttaagcataatgtattgttttgaacctttaaaattatttgatatatcttggagattttgtcatatcagtggttttaaaaatgtcattatagttcactatatggccataccataatttatttaaatgttcctctgttgttaacatttgcatgcttttaagtgttatttccaacacatatctttctgtaaatgtataaattactagtggggaattgctgggtcaaatagtctgtttccttggattttgatacctattgcccaagtgccttccaaagagatgccactaattttatattcccacaactgtttatgtgattatacctgttttcttatatcctcatctgcatctgcacaggatttaaaccaaattttattttttgctttagtttaggcctttactatctcttgtctggtctaatgtaatctgttttttgtttaccctcttatagacattagcagagtctggaacatatagaagattacctatgaatgttagaatgatagattttactgaattgtaggacataaaatttctgcttttgttaatcagtaacaaatatccaatgaaatataaatactgcatggtattactctgaaaacagaacccatgctgagcattaaagtagccaaatagtctaacaggcattatatgttttttaattagtttaagtttttatatttttgagttaaaaatcccagcaaagtcctagaaataatgcttgtatgatatttttcaccttagtgggttgtaacatactcaaagaggaagaatacatgaattttcattagaaatagtgatatgaagagttgatatacatgaaattaatatttatttttgaatcgtgttaaaagcatttttgcttgtattgatttttgtggggattttctcttgtatacaaacaatggaataaatcatgacaaaaagcttaacatatgtagtataatatttcataaagtcagaagaaattatagcttatataatgaaaaactgacattgagcagtattttattatattgtgattaaaaaatcatgactttacaaattacatttcatatctggctcctgtagtttttcttttaatatattgaaactgttttattaataaggaagtttcaacttcttgggaaccctttactttgaggcaaatacagttttcctggttcattattaaacttatctctcttttaaataccttgccaatttttgagagtggtggaaggtgtggaaagctctatgttctttagagtttgaagaaatatttattgtgttaggtatattaatagaaaattatttacttttcgtaggtgaaagtactgtgctataaaatgtctctccttttcaaaatttgcattatccatcattaattcaagtgaagtagtactttcaacatggaattgtgaaactgaagttgttcactttctatttagaagttacttctgttcaaggatatttctttttacctgttgcagaagagcatcttaatagctgccacatttgttgactattttctatatgccagtatttgcactagacattttacagatattcttttatttaatctttacaatagaacctttaaagggttattattgcatttatggctgacaagagtaaaactccaacagattaagtaacttggccagtgatgacacaaacttgttaggggtggagctgggatgcaaacctaactccaatgtccacaatcattgtatggccaaggatgactttcatgggattgaattttagccaacagatcaaaattctaaagaatttattttagtgtttcatcatcttctcaaaccttcagcttcattaaggttcagtaattaaaaatgggaataaccacattttatgatccttgttagaatacagatcactaaaaggcacaccattcagtttccttgctgaaagagtagtcaccaagatagtctcctaagttgagagcagaggcagatattaataatgtcaagttgctcaatcagtccttaagctgtgtggcttttaaggaattggattcaagaatgtgaattcagttgtgtggccacttctgggttggctatattttcccatttattaaattcacccatagttgtttttttttaaataaggggagcttgcatttctacctaaaaattacaaaaaaaaaaaatagatttttcatggtttctttgaaatgtaatttcttaccatgatatcttcaattatcacagtttagatgtattacaatataaaaatctttgcttagaaagcttacgtctttgaatgttcatctggattttatgttaagagaagaaattttcctttattttggctttaatgaaagaccatgtcaaacagtgatttatctgacatgtaaatagttataagccttgttttaattttatattttaaaacacaaatgtagtccgtggtatagttataatatgcattatatatgttgccctagtgtcatgatatttttatgaatcaggctttcaatttcaaaaatcagcttttgcttttttatgctcctgggttggatactgtcattgtctttaatatctaaggaaaatgtctcttcttgccattgagcccacaattttctttttaaaaaaaatcagataatgcttatatattgaatgataaagattttcttttcttttccttctttttctatttttttttttttttttttttttgagatggaatcttgctctgtcacccaagtcggagtgcagtggcacaatctcggctgactgcaacctctgcctcccaggttcaagtgattctcctgcctcagcctcctgagtaggtgggagtacaggcacgtgccaccatgcccagctaattttttgtagagatggggtttcaccatgttagtcaggatggtctcgatctcctgtccttgtgatctgtccaccaatccacccggcttggccttccaaagtaataggattacaggcatgagccacggcgcccaacccgaatggcaaagattttctaaagctagatcagataaatttctagcagctcaagaggcaggatttctatgaagttagaagtaaatttaaatttaagccttgattcatctatagacagatatttgcattgaattaggaattaggtgtacattgattttttaaaggtgtcaattaaacagtatgggaattggagttttaatttgtttcttttaatgtctcaggtcaggcaatgactttttcccatttgttattgttttgaatcttatatgttttctttagtgtgatgattagggggacttaactgccagctgttcatctttcttttttctttttctttttcttttttttttttttttgagacagagtttcactcttgttgcccaggctggagtgcaatggcacgatctcggctcaccacaacctccacctcccaggttcaaacgattctcctgcctcagcctccctagtagctgggattataggcatatgccaccatgcccggctaattttgtatttgtagtagagacagtgtttctccatgttggtcaggctggtctcaaactcccgacctcaggtgatccgcccacctcggcctcccaaagtgctgggattacatgcgtgagccactgcgcccggccttgttcgtttttctttacttgacaattaggttccctctattgccctctgcctcatattgtataaccctataacatagctatatgatttcttcctaaatatgcatctcagggcttgacctaccagggacagcatggattgttaactgctttccgatgttgacagcactgctgttgttctatccacctaaatctgatttagctaaaacaaaggcagtatatctgctaccttaagttattatatatagattcagtttgctttgtgtttgttcttttaatttggttttacagattaaaggtttgactctatctgattattttgtgtaaatgcatttttcaggtctgatgcataggcaactttgcctaaataaattagcttcctggctggattagcaaaagactcaaaattcttcaaaatataggagtaatttttttccgaagagctactaaagtggtttccattaaactggggaaaaatgaatattaaaaaaaggaaaattgatttataaaagattatagcactttctgaacttattccatagaggagataaacagtgcatttttactcccaataatagaagtgactgacgcatagcctcagttttttcttaaaacatgtttcatgtgcacataatgccagacagtcctgaacaatatgtggagcactatcaaggataattctcctgtttaaacattgaatctcctgtgcctggtgtatatatgtgataaatgcactgtgccatttattcaccttcaatacatgtgtatttttattttggaaagataatgtgtatgattgttgattagaccaacttttcttccatgcttatagaatagagtgaaatttttaatctatgtaatacttagaaaatgaatatgtggtctattcttatgatatttacttttttgagaccaagtttcttttttgtggaattgtagcagtctctcattgcctgaggtataccctaaattctttgtcccatgaccaagaaaattaaggagtgtggacactaagggtgaggctgtagcaagagtttaatgagtgaaaggagaaagctctccaccacagagagagggccccaaagagggttgctgttttacagttgaatatagaggcttttatgagaaatcagtgaaagctgggcatctcatttgcataaggcatgaatttctggtagctccaccgcatccttctagtgtgcatgcaagcccttagcttgagttactccatagttactccatactgctttgtttcctttaaggtacatgtgtcaggggatggaattttccattgtgagcatgtctgggcaaatctcctgtgtagcctttcttatctatgtggcagtgggcatgtcttaagcaagttcccccgtgcaaattcccttttctgtgcctgcagcttgatttctaagctcgttttttgtttgaaagaattttaccgaggacccaccctaactgcctgcctgaccatttccttcctcctctctcagaatgatttcttcacagttttgatagaagttttactaagattgaaagaaaacaaactttgaataaatagatgcacacaccatgtaactggatgttagtactgaattttatcatgatattaatctgggcaagttggctacctgaccagcaggctgaatctggcatgcatgcgtgtgtgtgtgtgtgtgtgtgtgtgtgtagttaattttttaatttacatttgaaataggcttggacaggacaggcattctgcagctgccagttacctccatattctcttatataaacctcatatttaaattcattccttccctcctccctcctgcgctggctcttagattcatttgagtttttgacagttttgtttaaataaatctaggaaggactgatgcatttttttttgtaattctgattaatattccagtgagactttagagaagggaaggaacaaatttacaggtcatctggatcatttaactcttagagaaaatagttaaatggagatttaccagtgtattttttaaataagcaagatgggatttggttaactgagagaagaaactaccttgcaatatttagctggcttgactgcaggataaaacagaggtcagtacatttgtttcactgagcagatggtgactgcacttgttctcaaagtgtggttgccagaccagcatcagtatcacctgagaggttgtttgaaaaatatttagccccatccaagacctgctgaatcagaaagcctggggttggaggccacagtctgagttttaacaagtcttgcatggtgttcttatgctgtctaaaattggagaaccactcttctgctgaatcttcttgctgcaagaagatcagtggaagacgtggtgttccctggattgaagaaatctgagttctgatcttaacctagcctcttgtcagctgtgtgaccatgattcctctagatccatatttcctaattgcaaaacaagaaaattgtgttatttgactttcttccaaatagtctgaggcattaataatttcaaaagtcttttatagtattatttcttcaaaacagcatattttggtttctttcattcttctctcctattgctatgcaataaaaaaaaattcagcctgaaagaagtaccatttaattttcttttgtttaaggggctgtgggaaattgaagtagaacatttatcaggtgcccttaggctacaaactaataatggaggaaatggccctgaatcttcctagcacctgtgggccttgccttagaagatgcctgacaaggacagttgaaatatttagtggtacttgatgtgctagagtatgaaaccaagtgtaatttcagcaatttcgagcccatcgaacttgcctagctagtgcagttagtatagcccacaaatggttatgaaggaagcagttaatagtaatggtttcctgtattacttggcatattttgaaagcaaattaattttaaaattttacttttaatgctagcttatttgtgattgtctttcctcccaaacttgatacttgaatttgtattaggtttccacttttaaggcaattctatatattttgtttcatattattgccagtgaaagctatcttatagtattgttagaacagtgaaacagaggtgaaagttctcctgctttatctggtcaatacccaacaacacctagaaactttcttccaaatctcactgattgattttatgttaagtagtacttaatacttatgtgtttaaaatacatatcagtacttacctgttttaaaaatatttaatattctcattataaaaacagtaactacccattgtagaaaattcaaatattattggggtacataatataaaaagtaaaagtcctttggaatccactttctctacttttgcccaccacccatggtaactattgtcattagcctgaagtttgtcataagttcctttatatttttttctaaattgcactgttaaaaattttagtgtactatactcttaatgtactattgctataccttatttcatattacattcacagtcaaaattttgatttccttgacaaatctaagacagaatagctagcatattggtgaaattttgaattcatattcatcctcataacaatgaaatgcagacatcagtgctgttataaataaaaaccagaggaactaaaaaaaaatttgaggaaataatcagcaaactaactttgttatgctttgcaaagtaatttttctaaagcttatgaagttgaaatatgcccttttgtaaatcaaaaaaaaaaaacaaaagcaaacattagagattatactgaggaattgattgaggtaaaatattatccagattcggtttagaaattaatggtaatatttctgtaggaaggtctggactggagtattctgctctctgctgtttcttgtattttctttttctttttttttttttttcacattttttattttatttttttatttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactgtgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattgttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtcttttgttggtgtataagaatgcttgtgatttttgtacattgattttgtatcctgagactttgctgaagttgcttatcagcttaaggagattttgggctgagacgatggggttttctagataaacaatcatgtcatctgcaaacagggacaatttgacttcctcttttcctaattgaataccctttatttccttctcctgcctgattgccctggccagaacttccaacactgtgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccggtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtagcagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttactgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttattgcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgtggtgtctttgttctcattggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacgtttgctgaggagagctttacttccaactatgtggtcaattttggaataggtgtggtgtggtgctgaaaaaaatgtatattctgttgatttggggtggagagttctgtagatgtctattaggtctgcttggtgcagagctgagtttcttgtattttcaaaataatgtggcaacgttctttgagagagtataccaggttaaattgctaagatgatcagtcaacaaatatttttggcagatctgcgatgcatgatgcgatattttgagaggtttgtgcaagatttttatttccctcctcctttgtaggaaaagatccactactcatacctactgacatcccctggcacttctagaaccagcttacaccccatcctctgctcacccttctcccaccttccacctgtattaacacctgacaggcacttatttccctatcaggagtctctgtagttgttttgccattgaccaagatatgtttagaacatttttaatctcttgtgcaattttggcaaacagcagcctgagctctgcttttcctaacaaataacttgcagattgtcatgtttctcttgggagaaggagaaaggttcaatcagagcagaattgaaatgatataaattaggcttattgtttagcaaatcgctggtgttaggtaagaattgtagataagaatagcctagaccctcttaaagatcagagcaggcatgtgtgcatgcatgaggaaaccaggcctttgttagtatcctttctgaaatggctattaaagtaattacagtaatttatagatttttttttcttcttccatttcaaaatgggttccattttttgccttttgtcttgagttcctcagttggagtgtgtatgtgtgtaagcatgtcttgggtagcactgccatagatagtatctatgaattatctgcacccaagctgatgaggtgtggtgaccacaggcactcacagatggatttgccagctttgctttcagggagccttggtcctttgagaataagagaattgtactgagaacactatgttttaatggttagttatagtttgtcatagcaccatttaaaattgctgtgttttatggacataaagatggcaacaatagacactaaggagtactagggcagggaaggaggggggcaagggttgaaaaactacctgtagggtactatgctcaccacctgggtgatgggatcaatagaagcccaaacatcagcatcatgcaatacccatataacaaacctgcacatataccccctgaatctaaaataaaaattaaaattaaaaagttgctgttttttatttaaagagacactttttcccatgtctttaaaaacacatccattcatacctatggattttattattatactttgttgcttttttatatcattgatgcttgtgtataagaatggcaatactttatgtgtatgacttttagagggagactttaaaaattattgatcacataagatggtatgtgcttattgtgcaagacctgtaattttaatatgctggaaagacaaaagaaattttatgcactagtctttttctgtatttgattttataaagtaacttgaatagtttcaaatcctaaggcttccttttaacaatatatgcttattttaccttgtctttgcatgaacaaaacaattagtaaaggtgactttcttcctaagaagttcattttgaatatggagattaggcaatttctaaataagccttagaattagtattgcttacaacagtagttattaatagtattatttatatataacttagttttgaatttaaccaaatgagatgtttactcacatacagacatttcacaaggcagaagacgtaacatatgttatttcccttctttaggagagtcagtcctgaaagagttaaggttttcttgttctggagatcaagcattgtaaccacagtaaccaatttactgttatttgcttagtcctagcagagaagaaaagtcagagtttggaaaaaagtctaattcatagacaagtacaactgcaattgatcccaatacattaggatcctgaactgtaattaactatttgtggttgtagggaccatggttttaatcaaatattttgcattttatttttcagatggtttgactcctcagcaacaattcaagtttaatgtaaagaaagtagaacacagtttatattttgcatttttgtaagggaacagttgacaagcacattttcaaggaagcagtaacagataggatttaggataaataatagaaaaattaaatgtacattacagaaacttcagttcctccataaaattacagtaatgttgagttttgtaaaagatgtgaatggtaaatttatgacttcccattgaaatgcaacaaatggaaaatgattgtattttgtatggtttatataaaacaacacgtgttacagctatctctaagaaatgttggaataagtaaatgagtgtatgctaactagagtggttagggcagttttgaagaaatataattttaaaattaatctgttccaagccccagctcctattctttataaattttctccctcaccttggatgctttatgaagaagttgattttattgttttgagtttacatatatatcaatgttaagataatttccctcttatatctgggagaattttgtgtaattgatatgggtagatttatgaataatatatttaacaataatcatttgaagtatttaacaaactggtaaaagataattttctttttaaaaagggcttattgagtattttgctttacttttaaatatatcagtgctggcttctatataaaatgcaccattttcctctctaccattcaatgaaatacagtttagagtctcttacggagtaaactggattagtcatctgcatactagaccttactttgcttagaattttacagtttacaaaacatttttgcaaaaacaatgcaaatatattgtttttgcaatatatatttgcaaatatttgcatatatatatattttttttcttagagatagctgtaacacatgttgttttatataaatcatacaaaatacaatcattttccatttgttgcatttcaatgggaatagtcataaatttaccattcacatcttttacaaaactcaacgttactgtaattttatggaggaactgaagtttctgtaacgtacatttaatttttctattatttatcctaaatcctatctgttactgcttccttgaaaatgtgcttgtcaactgttcccttacaaaaatgcaaaatataaattgcaatatatattcttataatctctactattgccttggacagtaattgaagccaacattatcgttttggaccagtgcagtagcctcctaacctctctgatctcctttcaccctgacttcctcttctcttccacgtaccccgctctcatcccagttagaatgaccctttagaatgtataaatcagattatgctacattttgctcagaaccatttaatgattttcgatctcacttagagtagaattcagagtgcttgtcatgggtgtcgaccctgcctgttcctggcctcatttttcattccttttctctaccttccttgactctggccatattagcttcagtgctgtgctttcaacttgtagtttccctaataggagtttttgtccctgtcttcctctgcatgccaatctctcactgatattccaagtctgcctggactcctcttgatttctgcttggatgccatgttgtcagagaagccttccctcaatgaccctgtctcaaatagcacctttcttcttctgtatctattatgctgttttgtttttctttattagcacttaatacttcctaacattatgtatttctttactgtcttccttccatgagaatccacgctctgtgaggatgggaactttgtactttgtcctcagaattctcaggacctaatttttgcatataatagtccatgtaattgtttaaaaaatgaaaattccaagaactaaggctgaacaggcgtagaaatcacattttcaaatagatgaccaggagcaggtttgggatatagtgtggggaggcagtttggactcagcaaatgctggttattttgaattattttagacccttctgattgctcatgtattgtatgacactttttaaaatctgtatttatggataacattagggacaaacacctacctgtctctagtgtcttctctcccacttgtgctactagcctactttttgattgctcttctcatcagatatgattggaatcatcttttaggaaaatacactttgatttataactcagaacatagtaagaatacctttgcataagccctactatgaaaatgttatgattttattgtggtctgtatttctaagaagttacccatagccggaatttgctcagtatgctttctgtcttcttgggtgtatttcagtattactcttcagttattcacacttgggagtaagggcaaaaaagtgtgccgaatccttccagtaagaaattgtggcatttctcagtgctttcacagatcagcaactctttccgcttatgacagtattttgggaagaaatatttcactgaatgttctctatatgtctaaaaatgccaatgtacatcctcagaatgggtaatttcctttctaacacaaatagctattacccaaatgtctggatttccacaagcctgaggttctcaaatcttcctgattttgtttatggaggatgattttgttgggtaacttaaaaatccaggggttaaagtaactttgttcgtaaatacggataaaaaaagtgtcgtataatacgtgagcaatcaggaaattaagtgtactgcataaaagtatgttttagttatcagaaatttaatcactaatcttggacagttttataaaatttcctcttttcaatgaagtctgttatattaaatattgatcatggatctagctaataataatgatagtggtaataattgaatggtcaggtgacagaaaccatcctaagacttaacaaaatgttatctcttttaatccccaaaacattttataaagtgaatcctcttaatcctattttgagttgaggaaaatgagatttaagcttctttatgtaaatggagctggaggagccaggattggaatccaggaactcctaattctcaaacccaggatctctacacaaggaaacctccatgacttggctgaggttcttaatgatgatcccattttctctgtcataatacagtgctgccttctgagtctactaaagcatgtaatcctctttgtttacctccccattttaaagtcccagatatcaagtaattctgcttacttggctgtctcttctagttatttcttagggcttcagtttctggcaggtgccctcaatgtgtagactctgttagctccctgtcatctgaggagaggaatcaaataaacaccatggttaaattagggaggctaattttttctatttaaaaatctttctggcttgcaggtttctccacttctcttgggaaaagttttatgacagcatgtttcccagaagcctgcatgctggagcaagaagcagcattgtcatatttaactcttctaagagaaatttacttttttcccacttgtttgttcagcagaaattctggaatttatgtggctttgctagctagaaaaaactcttccagtaactaaatatgtggtctgataatctcctgacatacagttttcttcttatttgaccttttctttaaggaatattattgaatgacacaatctcttgagaaattttgctgaaatgctgagataggattctatagatagcaattacagctgttgatatgttttctagctttgggactaatgtgagtgagttacaaggggagttgaaagccttgagagtttacacgtgtggtttgatgggatgacaagcattaattaagatttttaatatggaggtgatttattgaaaatagattctggatgaactctttggcctcagaggtgaggtaatagaataatttcctctttaagttacctgtataagcacagaatagattattagtgatggaacatcttcatcattctgtggtagtctggctgccagatgtgatattttattatattagttagttcttaagtaggcaagtggccatttctcaaaagcagaattgtgtggatatttatgactccctttccaagcatattccttttttccccgagacatggcataattgtaaaactttgccttttgtataataaaacttgcctaccgttctgtggttagggttagggaagtgggcagtttgctaactatttgcctggggtctggtaggaatttaagttgaaccagaggaattcggatatttgggggtttgccttcaagaaaaatgatgcctcttctcttacctccacctaagggaataaattctaagcccaggagaggagggttatgttaaatatgcctgggccatggcccagagaccgcaaggagaggatggcatacataatgggggtgggtaaaacaggagtgtgtatgtgatatggaaaagagaagtgagtagatagcaatgcctctgtgagaacaagaaggaagccaaaggattacatctgaacattgcatgatgtatccttggcagcagctttgctcagtgaagatgataaataaacctaatggtatgttcattcctgttgtagataaagttcactttcagattggtgaagtctaagaattaaagtccagaaaaacaactttgaataagttgcacagaacattatcagtttacccagtagagaccaaataactttgatggttagaaatcatttgaaataggagtagacagatcattttttttcccctggagctagaactcatttaaatatactgaacatttaaaagtattgtgccatctggctagcacccagtcctcctgatttcaggccaataatctttctgctacactactttaatgtgtatgttggggctgtgggggtcaaggagtcagagagagagtaatgaaaggaaacataaggtttatatgaatttaaaagaaggtgactaagaacatgtgttattctctactcttagatcatcatccttccaggcatagtggcccatgcctgtaatcccagtactttgggaggctggggcaggaggatcacttgaatccagacttagagactggcctcagcaacatagtgagaccctgtctctacaaaaaattaaaaaaattagccaggaattgtggtgcatgcttgtggtcccagctacttgggcagctgaagtcggaggatcacttgagcctgggaggtcaaggctgcagtgagccatgattgcaccactgaactccagcctggtgtcaaagtgagccactgtgatatgctttggctctgtatccctacccaaatctcatcttgaattgtaatcctcatatgtcgagggagggaactgtaatccccacatgtcgagagagggaggtgattggatcaagagggtggtttccccattctgttctcatgatagtgagtttcatgagctctgatggttttataagtgtttgacagtttctccttcacacactctcctgctgccttgtgaagaggctgtctacttccccttcagccatgattgtaagtttcctgaggcctccctagccatgtggaactgagagtcagttaaacttcctttgtttataaattatccaatcttgggtagtatctttatagcaatgtgagaatgggctaacacaccctctatcaaaaaaaaaaaaaaaaaagatcgtcatcttgttcctctatattctgcttccttgtggtcttattgaaattcagagttttgcaaaacatttcttgccaacttggatgttatcatgtggtcatttagtctgctgataattgagagccatttaatattttgaagcagtgaaataacttagtcacttttatgttttaggaaaaaaaaagacactggctgaaaggcagagattaaattggaattgagagagtttgtagaaatgaacaacatttaggacaagtgcaagtcaagaccctaaccaaggcagtgacacgaaaaatgcagagaggtggtaaatgtacctgaaaaataatttcaggtagagtgtgtagattttgccaggtggttgtacatggatgatagtgtaaagtgcagtattggatggatctgaaatttctaatgtggttaaggaagtaagtgacttcataaaactagaactagccctgccatattcccctctctcatcacccaccagtagctcactgccaagtcctgttgatggtcgttataaaatatatagtgaatcctccttacttacttaactgccatcatgctagtccaagctgccatctcctgcctggacttctgcaatgtcctcttaattgatgtcctggcacctgctattcccccttcccatgcattctcctatgactgtgccagtcatcctatgcgtacgtccgatcatgttactctcctacttagtattctgtcatgagttcttattgctcttaagatgaagatcaaaatctttaccatggcctacaaagctttatactttgggcactgcctgccgcctcagcctcatctcaaaccactttattatgtgtacatggggctctagcagttatattcatccttctaggtgcccagatcttttcagacttgcaacatctgcacttctattacctgctggagatgctttaacctgtcctcttcatggggtcaacttctcctccccctcaggtttctgataaattatttttttcctcagagatgccatcatcccctggaccagtcttgcccattttcttccatactttaccttctctatataattatttttttagcgagttagctccatgcgaacagggattatgttctatattttaaaaattgccaagtcctcagtgcagtgtctaatacatagcagctggttgataaatttatttggggcagatgaatagtggctttaacagaactgatatgcattggtcataggggtcattaagaatatttagtgagctgtctactcactagccatcacgtatgtgtcttaacagatgacataatggcaagtcgtgttttacttggctgtttttgtgaggaccagaataatatagtgaaacatggaacattctgatgatctgatagaaaagtaaagttcagaaactctagaaaactgaagacgtgtctggtaataacatggctggtaatctttgccttttgttatttcctaccaaccactgtattaaataaccagggcttcatcattacaatcaaatgcctccttaaggaagcccagggttgtgaggctagtaagtggtagagtggatggtattcgaggccaggtcccactccaacacctgggctcagacacttgcctattgaaactagaaatcataaagtgtttttgcaaaaatgttttgtaaactgtaaaattctaagcaaagtaaggtcttgcatgcagatgactaatccagcttactctgtaagacactctaaactctatttcattgagtggtagagaggaaaatggtgcattttatataaaaggccccattgaatgaattgggttgagctgttttgtgaaggcttgattgtgattgcatggctgttatttggcaagcagagaattcctaatttcctctgctgtgagactcccaaggagacatttatattagtaaaactgaatttgcaaacctgcattttaaaatttagctttatttgtattccatgtctctctgggaggtgttcagtacattatgaaattctgtgcttttacctcctgctaaggatttgagttcttagcctaattaatcattaagtgttgtcagtctatcatgatgtggttaattatcagagagagtgtatgtgtttcagacagtcatgaccctttcctgggtaactatagaaaccttaacagtactagttattatctaaaattatagaatttggttttaaagcagtttggcctttgatagttatgggcaaataatcggttatcatctagaaagaaaggaaagcctgcatgaaacagattttttaaataatttatacataatagaagtgtgttctaaataatttataaacaacagaaatgtgttctatagaatatttctgattatatcttaaaaggctttcccccacactagttctgtttatttgttatgaagctttctcacaaacaatctctttttcccccaagaatgtttagaacgattttaatccaagactagggtaattcttaagactgccatttggtacagtgatcttatagtgcatagaagctacgtatctgagtggaaaaacagacgcatttgggggcatatacatatctgtgcagttacagagaccagtattgacaatgtgaagtatcattggtggattcttgaagccgtagctctttaaagatgggagcaaaagaagaacatgtccttttccttttttcaattctgagaagttccatctgagccagaaagaaaaaaaaaaagatatgtcattgcacctttaaatgtgaagctcggcaaggattgctgtctgaatgggggtgaccatcaatatggaaaatggaaatctgtcatattttgtacaatgctttgcatatcacatcattcagagaacaggtaaagtcccctttggagaaggcagtgcttgaagagggttttccactctcattggtagggtggatttcagtggtatgtaatgataatgatttgcttccatgttacaacatgtgaacagcttatttatagatcatgagctgcatccctctttcctctttttgtgcatgtttgctttcaaggagaatatagtgacaaaaattttaatctgccttttagctcaatgctaggttcttggtaatttgttgagcaaattaatgactttcatgtacatttacagataatataagcaaagtatcataatattggcacaaaaaaacattaaggttcaacttaattctgtttttcaaaatatattttaataaaactatacatgtaaacatctgtacttgattttaatcattttgtctttatactgcataagcttaattcataaagctagtctgtttccacaattgactgtatcacagaataaaactagctttaatgttgatgtttacttttcatatcaaaacgcaaattaaagattttggcaataaggattcagctgtcaacttatttgatgtacaagaatggcaataattgctttccattgttgagcttttactaaaaacactgaagtataatttgtttttgatagaaatattagtagctacagatattaatgatttattggtttgaaaaagatgctttttaaaaggtttctaacctgtagtaaccaagtccagtaggtatgcataatggacatacctagccagaacatcatacatgctctttgcatcttaatatatatatttttagtatgattttgctttgttgaaacaaagtgcttaaccggctgtttatttgttgttattgtggcattataaattgtgccatttcagatctcttattatgtgctaatagtttttccagcttttattatcagattctgctcttaatatttatcttgttcttttttactctacaagttttcaagctaataatgatgttagaagtttacttgatgagaaacaatgaaaattaaatctcttatttaaaacaacaaaagtcacaaattctgtgagctgagagcgtgttaggctctggaatggagagtgtaatatcactggtttccttatgccagaatgctgatcagcctaattatccaagaatcttctggttctctggcatgctacagctgtgactttctctttgtctctgaaataactgtctgccacactgcatatgcatgagagaatgttttttatatcagtaattcacttatgagtttcattccttgttaaaatgatggtgtttgcttaatttaaatattgtgtatgtgttgtatatgttatataatatataccatcacatatgtattacatatgttatatattcatgtcacatgtatgtattgtgtgtaatatagacacattacacataagtattatatatgtaatatacacattacatatattatgtaatatatagtatattcatgttatatagtatgtatgtaatcggtatgttattacatatatgtaatatatataaaatgtataaatagctatatacgtagatacatctgtgtattaagacactccttgttgtttatctgcttgagtagagtatgccatccatccatttgtaggacattaaaaaccagccatataaaaatgaaattcagtgcaagtaaagctatttcttatatttttgtaaaaatgtatattttcactatatctttttcaaataggcaatgtattatttatctcttacagttttcttactttacttggttaagtatggctgtttctaatgcagtgttttaattttttatttccatactgttggttattaatgataattggagccacacaaaatgctgttcagttcaaatttctgacaagaaagtgggttttctgacaaggagagtgggtcttccagatctattattctttatcactttcaaaagagtgcttattccttgaaaatttctgttctatctacctgttgtattttcaacaggaatttgaattcaacaggaagttatctgtgccataaactctacttttcctgctaagctgctttgtcactggaagaatttcaactgactaggcaacttgatttgtctttcaatgatttcatatctgagctcttcatgcaatggagacaatgcagtttagaacatggttgtgacgttatagaatgatcaaactgacccaaatggagggaacctggtgtaatcataatcagtgtatattagtcaggaatagttgttggtaatgcttctttttctgacttgtagacagcagtcatcttgctgtgtccttatgtggcctgttctctgtgtgggtatggaaagagagagagatctttaaagtcggttcttttcttctaaggggaccaatcttacaggatttgggccccacccatattacttcatttaaccttaattacctccctcaagggcctatctccagatatagattagggcttcaacactgaattttgaggaacagaattcagtccaaaacacagtacaaatacctacagagcactttctatagattggtgcaaaagtaattgtggtttttgccattgaaaataatggtaaaaagaacattacttttgcatcagcctaatatgtgccgaacactcatttagggacaacctactttacaaaggaggaaactgaaatcccaagaggttaaatgtctcactcaaaggcacagtagtaagggacagagttgagattcaaacctaagcagcctggcttcagggtccatatccttacctattagctattctgcctctaaaattgtggagacatatttagagcttttccttgctaaatttacttagggtatcatcttcgatgagatttcttttggctttttggaatacagtataaaaactagtttccagcgtttttttttctttgtaattcattctttacctattgtaacagttaagagagcagactctagagactgagttcctgggttcagaagtgtatttttctggaaaaaagagagaatagaatcaacgacctagttgggatgttgtgatactaaaatgaaagaacacatagaaagggcttagatgtgggctgtctgcacacttgataagcgagtgattgttaaagcaggagtagtaaataaagtgtgatctacctacctgcattagggaaggcttaccttttgctttgttgtaaatcctacatgcctactctaactagtggcaacacaggccttcttcacagagttcttatgctctggcaaacctgtcagttagatctttactaaatggatttttttttcaacttttttgtccttaaatgactttgaagatgcgagggctatatttttgttcgtttttggcttgtagattattggattcctgttaaaccagatgatccttttaagttgcatgcttaaaggacaaactatacccttctggtatacaaatagtatacagaatagtacttgcccaatgtggggacatggcatgtaagcattcatgtggtgtgttaaatgccacggatggaggaactaattttactttggggtattggaaaccaacagtaagaagagaaatcatttgtgttacgtactgaaggttgatgttgggtaccaagtttaatgttgttggaaccaaactaccaaggctaacattgcttctgggggcaattgtttctgtttaaggccacttatttacaaatgtgactttggtacctagcccatttataagttgatacgattatttttataactacttatttgttacccacctttccttgacaaagatgagattgctggtcaagttaacaatgagatttttcatcaatgatttaacatttgatttatactgttctatcagcattctttctcaaggtctactttgacaaaagccgtgtatttttacgtcttgtgttaagagttcagtctatgaccatgaaagaaattaaagctatggagcttccatgaaaatcaaactcctaactttggtctaacaattaaaaaattaactacagtaaccataaaactctaataatcaatagtagtatagagaataaattatgaaacagataaactgaaagaatatatacccaaactctaaaagtgtgattgttttactcactgaacatatgaaaagaaattatttttctaaatgcttaatcagtttttaactaatgaattttcattagtctttgatggttccttcttgtaatgctcctttcatcattgaaacttctctaacctacctgtttccctaggaattatataaatgcatctgttccccgtgtaatctggcacctctctatctctctaacatacttttcccccagcccctcctttaaactgtagatttccatcagctgaattatgtgccagcccctgctcttacctctgctcttggctgtctcaccttcgccattccaaacatgacagctcttcccctttctggactcagcttagaagtcaagtctccgtgtccatccttccttaatatgacactttaaggttggatagatactcctgccataacctaccaaacccataaaaatacttgctgttctcagaacccttatgagagttatgtgtattggtctctagtccccttatctaggccactggactgcttttcatccattattttatcccagtcacttgggcccagtgcccgacatgcaggaagcactcaagaaatagaaatgtgttgaataacttagtaagttttatttatttttacctttttcccccatattgttttaattattgaactgatagccagggtcttcactgggtaccattcaaatatcaaaatgggttgggtgtggtggctcacgcctataatctcagcactttgggaggccaaggcaggagaatcatgaggtcaggagtttgaggccagcctggccaacatggtgaaacccccatctctactaaaaatacaaaaaaatagctgggcgtaggggtgggtgcctgtaatcccagccactcaggaggctgtggcaggagaatcacttgaacccgggaggtggaggttgcagtgagccaagattgcaccagtgcacaccagcccaggtgacagagtgagactccatctcaaaaaaaaaaaaaaaaaaaagtagatgtttgaaaccaacgaatcgctattctctttattttgggcatcacataaatcatatgaggacgaggttatgcaggtgacaatagaaactggtagatggtataggataacaggcacagtttgattctatgggattttacattcaggaaattcatggtgtcttttatgtagacttaatttcctactcctggagtttctttattttgaattctgttggaatctgtaaaatgagttcctgtcaaacaaaggatggctttcttgtgcaaggtgccttgagcatgtcttctgtttgcttgcttttggtcctatgaattactgcagcccggagctccagtgacttgcatacacttcagagtccacacagtggcctgaattgactgccatctcatcggatggcaataagcttaacaatctgaaaaattcctgcactgcaggattaccaggggaggtcactggaacttcatctggctaataagttttttgtcctgtttccccttgtcagtgttcctctgagctccttaggttggatttccttttttaacttaaataaaaatcattaacactgattttctttagtgagcgaataacaaaacaccgtatctaaaacaagagtcatttcagagatggtgtatgacattaccaccaatgcaatgagaaaccgtattcatcatgatacagatgccctggggatcaaatactgtgaaaatcacaagcatttcgctctcattctcaatgtaataaagatgaaaaatatcaataaaactaaaaagcatttgccagtcgtacactctggaataatcgtgacttaaagacctgcttagttctctggacgtatgggatgtcaatgttttgtttctttagagtctagatcaacaacacgtactttttttgttgttaacatagctttttatatggctttattaaagttgaaagcagaaatcatttttattgcagcctaggagttactcagcacatctttttgaatccccttcatgtgctatttaggaagactacacaactcagagtgctgccattcctcagccttggagtaagagatcacttcacctggggcatgtttgacttgctgccccagggctaccttggcactcatccgtgaaagtacctgatattctgtttcatggtttatcctacccctcacctgttagagacccctcaacttctgtcagccttttgtgtgttagggagaaaatctgcttgctacatatcatcaggtgtgaaggtaggaatgtgaggaggaggtgtatctccagcccagttgagaaattatgttgtgaaatatatagtctcagcaccattgccactggaggtggcaattctggaaggcagtctataactcagagttttatctagtcatacttgatctcacctcttagaaaacaggatttctggagagtcgacatgatactagcaaaggtaggccttgtttcccatgaccatgtaagtgaaagagttctattttcacattttagtgtagccaattcatgttcaggtatcagaaatttagaccatcagtatatttctaataggtggaatgtaactctcctctaccactgttcaaggataaaatatactgtaaatttatcagctgtctttaaaggaaaatgactttaagctggactcttaacaccaactttttgggcagggttgaatatatggacagtagtattctattttctcgctcctgtagaccttgggtgggttgtcccattttccagttttctgtcatggcagagtgtggctattgaactggatttgtccattgatcctaccagacggagctcctgggggcctcctgatcatcatctctgcacttccgtacagtatctggtctgtattagatgtttaatccatgttttgtgaataaacttcctttcataataactcctgaatgatgtgtgtgtccagttggctagaaattatgttttgtaatggttatgctcatgagaatcccatgtgtctagctgaatatccacttgtattttactggatgtactgggacagtagaatacatatagtttaatggactctgttggaaaggcaaacacccttaacagggaaagtggctgagatacgctgatacttttcaaagaagatagccactgccttccagcctgacattctgtttcaacagaatctatggaacatattcttcctcaacagccctacactgttatctcatagggattgtctagttcctttgcaaaagacagaggcatagacctcacattgtacaaaaatgacaagctgcctgttactctgtggataattttgtcattcacgtagcagagttcttaatcagacctaaattattttgaagatattataagccacccaggtgcagatgatcttttcttatgttttatcaaatattttagttcaaataactttaacagtctttggatgtcccatcatttctgatggtaagatttctttaagatagaaaaatgtgtgaactcacagcaaggaatccagaatcgtagctccagatcttctactaattattacatggtccagcacaaatcacttaaaggtactgggcactggatttgtcaccttaaaatattgaggtgagatgattgcaaattaggaaggaaaagacaagatatgtaaattatgatgcaagttagaataatagcaaaataattatggatatatttttcaaatatgaagatcatagtatatttgacagcattttgcatagtatttttatacaacattatgtatattatattgtataatgtgatgtagagcatttcctctactgctgtatctcatgaattaaaatatagatttttagaactttagacgaatttgtcatacattcacttacatttttatcacttgttcctgttaggcagttgtcatgttctattattaaatggaatataattttattactattgctattattattttatagtcagggcctctctctgtcatccaggctggagtgaagtggtgcaatcatagctcactgcagcctctaagtcctgggctcaagcagtcttcttgcctcagcctccagagtagctgggaccataggtgtgcaccaccatgactggctaatttttatgtttttaatttttcatagagatggggtctcatttggtctcgaaatcctggtttcaggtgattctctctccttagcctcccaaagctctgggttaacaggcatgagccaccacaccgagtctggaatatgttttttgagtaggtgaaatgatttttattttgtgacaaagtattaatgtttgaaatcagcttttaagatactgtaacaattatgtcaaccacaatgtagcaaaaattggaagatgttttatatttatttaaaatccatcagaagtagtaaaatccttaaaactcacatacataaaacaactgtataatttaggaaagtgatgtcatgaaggtttgattttaattctgcaatgaagcaagaactactgggaaagccatcagcctgaattctgcaatttttttaagatgaaaattaaatgtttaaactttagataaaatacctttctaaatctagtctatttgttctcggaaatttttagtctgttacattattcttgtcaatattagttttagtgctccatatcattacacatgttatttcattaaccttgtctacataccaagaacctgtgacctcctcaagtcctttacataaattctctaacttggtgaaggtgaatttttagttttcttcttttttttttttttttaagacagagtcttgctctgtcacccaggctggagtgcagtggcgcgatctcggctcactgcaagctccacctcccgggttcacgccattctcctgcctcagcctcctgagtagctgggactacaggtgcctgccaccgcacctggctaattttttgtatttttagtagagacagggtttcaccgtgttagccaggatggtctcgatctcctgatctcgtgatccacctgccttggcctcccagagtgctgggattacaggcataagccaccatgcccagcctctgatgtttttataaaatagttcatggaacaatttagacctcttgagttgcatttttctaccagctctttatctctggttgtttgttttgcagttaaaaacaagatagtcagggtcctgtttgaaaacttgctttctagtcttgagtacctggaattctgcctaactgtttcatgaagaggggttttttatagtctcttcaattgaagttagttaactcacagctctgtttttgataaaccagcaaaatctttgaatcattaaataacttcaagcgttgggaattatttcatttgcagttgaagttcagggaagagattaagacgtggtgtgttataagaagtgttctgggtgctgatgtttacattctggtaccagtgactgactgaatgaattttataatgtggagttgacaccacctgttcccaaaagcaccatctaagagtctgccaatttagtagacccgtatggatgaggcatcctctgaaatagccaattactataacagagaatgagtttttcctaaaatcctggcctctaggttgttgtttttattttttacttcgtatttcgtctttgtcagcatcctgtagagtctagaaaatgaaaacactgtccgcttattatttgagtttatagtataaaagaaaatgggctgggtgtggtggctcacgcctgtaataccagccctttgggaggctgaggcaggcagatcacctgaagtcaggacttcgagaccagccgggccaacatggtgaaaccctgtctctactaataatacaaaaattagctggacacagtggtgcatgcctgtaattccagctactcgggaggctgaggcaggagaatcacttgaacccgggaagcagaggttgctgtgagccaagatgacgccaccgccctccagccaaggtagcagatctagactctgtctcaaaaaaataaaaaaaggataaaaaaaaaatgcctcttcatgttagaatcagagcaagcccaaaggctttcctttagtcatttggtggttgtgacattgtggacactggggtactgcaacaatcaaacttttaagttgacccttgaccacagtgaaaatcatagcaattacttttgatctacatttaggtctcattctccatagaattgtttcataatatcactttatgtagtattgtttcctattgatatcttcttagccatattatatcattcccctcatagttataaaatgagttgctattcatgataataatcctggtgcagtagtaaggaaacattggtggtttacagaatgaatttctaacatagttctcattgttttactctacttcccaaaataaaagtttcaaagaatcagaagattttaggtattggatgaatctcagaaaccattttggagaatgaggcttactttgctgttgaagaaaggactctttttcagtggcttacctgaacttagtgagttcttgacagtaataactattgattccagttttctgattacttttaattaaattgttctttttgaattgcctcacccttttaaaataaggattgtgcccataatcagattttgcaagggccagagccattatttcattaaccttgtctacatacctattattacatcccgattattgtagtagtagaaactggaattgcctagttatgatctcaacttgattttcactatttctatttgcctatgtatttattaatccacatcgcttatgcactttagaacagagagtgaggagctttgtatgtggatgtgtttaaaagttcctaatgttgataatcgttggtggtaccttatactgtctaaaatttatttttatcacatttactaaaatgcatacagggatatggcttcagaaagaatgctagactcttttacatttaacaaaaagttctctggagctcatgcccttgggaaacttgataatgaaagtcagaagagtgttacaaatctaatttagaaagattttaccaatttggtaaatagaaaaattctgaatagtgaatctggtagcaaatatacatttattagacttttgattggttatggatatgtgctgaactttatgggtaaaagcacaaatatcagaacatattgtatttcacctatcatattttttcttaaagtgcttaaaatattatccctttgaacctgcttcactgtttttgcttgttaaagaatatagcaataatggctttaaacttgaaatcttaaaataaatcactgggaccagaacttttgtatttcttctcaagttttatattgaccaaagaacaataatatgtatgctttattttcatagtgctgtataataaagaaaaccagacaaattcctgagtttccctttcaagtaagaccatttttttttaatagctagagaaactgaagaagaaaacatttggaatttaggacttcccagcattctatctccaccactgtccattcttcagatttcaacactaccaccaacacccccacaccaaatacatgtacttcaaatattgtacctaaaataaaaactcagtcctatgatgaagtcctgggctttcttaagtagtcaattagaaaggtcagtggtttctaatgcagagagtttatgacctggtgtgtttcagctaatttcgattctttcagatgtcttctgcgcaaattgcttgattacctcctacatctctcttaatctgggttactgaacataataataaggctttacctatttttttttttttatagacccgttcatcacctgaatcttttagcacttcaccaacagctggtaacaagcagaatcactgacattcttttagatttctttaggctgctttttaatcctccctgattgtcatgagcaggaataaggaagggagaaggaagaccaattttttgtttaatccaaggtgatcaaaagaagtccccagtaatagtacagactgactttgacagtgatttgtatttgcaaaatatatgaggcttgctgtattccactttttctcttttttttcctctttgacaaaaacaaagttttcgtttcatccagaatatttcatttatattttagaggactatttcccagtccctttatcatgggaatggcttgtctattctctgctacttcatttgacttttaaagagtctcagcctttcttgaaaattaacagattatttaattagttatacatgttttgttttgttttgtttttcagtcgtaatataaatatatatgcttgtaggattgtaaatctggaaggtagccctttaagtgagggtattcccagtcgaatctgttatctttttaatattctcacttatcattgaccttttttatttttatttttttggtgagaaagcgtctcacactgtcacccaggctggagtgcaatggcgtgacctcggatcactgcaacttctgcctcccaggttcaagtgattctcctgcctcagcctctggagtagctgggattacaggtgcccaccaccaagcctggccaattttttgtatttttagttgagatggggtttcactgtgttggccaggctggtcttgaactcctgacttcatgatccacccacttcggcctcccaaagtgctgggattacaggtgtgagccaccacgcccggccatcattgacctttttcagtataaatgccctcttatttcctttttatcattacacatgtcaaaataaatttctgagactgcagtttttactatcactgaatagtctcatagagaggcatgtttgcaagtagtattacaaatcataactttttttctggcactttattatagggccttggagattaccttggatttgtgtaatctcaatatggatgtgttcaaagctaaaggaatttatttgatgcgaggggagattgaaataggctttactacagttacaggtagttagtagacttggataaaagaaatgagggtactttggggtttcataaatgttggtaatgttcaaagcaacattgctttacttttctgaaggtcagaacattcctatacaaaatttaagtcagttttgatagagatttagagagacttaaatctctataaatttcatgtaatgaaaatacgttgttacctcaaggaaaaatgaattatattattacaagattgtttttaagtttgatatttataatacattaatgaaagtaacgtgaacccttgatgtcatgatgcactagcgtatggtgctccattgttttgactgtgtctgcatgagtgggctggtagtggtttatcaaatggctttcagggccaggatgaggtggagtggaactggcttgtagtatttgctgattaccgtggtggaaacactttgacgtggacaattccagcctaccaatgtggtgcaccccagggcactattatatggtcttcccagtgtataattgtagatataaatgaccttgagcacagataacagtaacatgtagtcaaataatcaggtagtgatgagttctgagtctttattacatttgttttttaacaatttaattgtaatataaaatgtttaataatgaatatggtttaatgactggctcacaaaatacatgaaagtttaagtttcctctcctgagttggtacaagccagcttcagcacaccgctgaaaatatattgcgacactgagttctattatacatgtggtttctttccttgattatggcccttgcctttgaaaatgctgctgtttcctctctctagataatttattattcttatcatcattaatataaattctaataagctgtttatgtttgagaatattcttgtttctgcataaagttagttaaagattggtgtcattgtccctcagaaccttagaactcagtatagatagagaaagtagatagaaatattcaaaatgtaaacattaaacaatgatcgggttaaatgcttatattttgtcttgctggttaggaattgaaaagtttaagctagagcttaagcttaggttaggaaaataggttctcttccattctgattagtccagtaatacttctggtggattaaagtaagattttgttaagccctgtcccctttctccctcaatttttgggcaaacagattgatagtgattgagtcattttgatagtgattggagacattccttcaccactgcaaacaggaagggtctgtgagtcattttgttatatatggagttgcttccaaaagcaagagacactaccatggtttgccaagggtggacttctgagatgactggtcacgtttgaggatttggggcttatttggaacaatcaaaggaagcaggagttgcctttatactgaggagaaatgttcaacagaagggtcaaggctgacagtaagatatcagtctggccacttgtcaccatagtttatgaatttatttctgttacagagtacttggtatcagctggaactttctccaaagatggacattctaaagaaatttccaaactttcatcaggttagatcattggagaacttattaactgagcctgccaagcaacacatttctgaactccattttaatatttaagctcgtattgagacaattataggcaccagttgaataaagaaagaaaacatttcctactttacatttgatattttcttctattataatcaatgtgaaaatcatttttagtttactaacaggaagtaatttctttcccttaaaattcccttattttaaaagaaagattgtgtataacatatgaatcctgtcatttttgtcttgttggtcaggaatcgaaaataaaatttaacaggttttaacaagtgtgattgagatttgtttcctaatcactctacatgttttttctcttttgcatatatgtcattatttataagcaacttcaaatagaacagaaggtagggcataaattatcaacaactttagtccaaaaagatgttaatgaaaaaagtaacaatatttgtgatataatatatgccgtgctggtgagtattgttggttgtcttataatcccaattgctgtgtgtagttactgttccctctcctttcctctaccagggtggtcttgcaatatgatcaaatggttatgttcagaagtacagttagcctggtatttcacagggagcaatatgacactgcataagcagggaaaatatcatagatgggaagatatattatctggcaaaagagtgatagtccttcttgggaaaagaacattgatctcacttggaaaatgccacagtcagaaagctcgcagtcctccaatacatggaccagagaaagaaatttcttcatcccctgggccaagaggcaaagaagttgtttcaaagcctaacaagctcagtggccactttgtccttctgaacatctcaacgtagaccatgaatgtgaaactagggtgcccagcacaaagtgagctgttgtgattcttcattctcattgccaaaattcagacatgcagaatgagcatcaccagagaaggagcaccctaacaaaattaagattcattgcattacatgtcacacaagttcttgtgaagcctagaggttcattagcttttctactgtccagtttctggatgactttttgtggtcagcatacttacgtcgttggttttcagtttctgctcttgtgtattcgaatccaggtactatgttttgagtaaccatatgcctctggctatgctaaatttagacctatttgcatttttctttgactgtacattaaactattcattagattaagaagtttattcatgcctgtaatcttagcactttgggaggtggaagtgggtggatcatttcaggtctggagttcgagaccagcctggccaatatggtgaaacctcgcctctactaaaaatacaaaaattagctgggcatggtggtgggtgcctgtagtcccagctactcgggaggctgaggcaggagaatcgcttgaaccgaggaggtggaggttatagtgagcagagatcatgccactgcactccagcctgagagacagagcgagactctgtctcaaaaaaaaaaaaaaaaaaaaagtttatgctatagaattgtaagctttcatagaaaaataaatggattagtatatcattaataattaacaacttagaattataacatatgaaataactttttcaattaaaatttggttatgggactcgaggtataacattttattgtattttatgtttaaatggattacaaaagtacatgctcacactttactgatgaacaagtttattacctcaaagaaaatgtaatcagttcaaaaacattttgtatcatgaggagctaaacatgtcttattttctttggttgtattgttattgtattatgctgttctcataaaggaaaattattaaagtgcatattgcaccaggaaactagacctgtacataacactgacttactagaaaattgcattaaaaattgtttgggcaatgatattaaaaattattataaacagataccactattttactgttcttcaaagcttccttcatttgtaaaatacatatattttatataaacatattgaacatcatacatttctgaatttaaattaaaattttttaaatgacgtttattgccaaattagtgcttctacaacagaagactttttttggaagaatgtcattgaaccaatgagataggagaaattctctctataatttgaaaccccattactttagttgacttaaaacgcaatttgaaatcacattactttaggtgagttaaaatgctaaggatgccatttttaaatttatataattatcttgggatatatagtcacatgaaaggatactgatactgactatattgggagcaagattgtggaatagaatccttcagcaattgtcctccctgtaggaacaacagatagaacaactatccactcaagaaagtaccttcataagaatcaaaaatcaggcgagcaatcccactatttggttttaatatcacagaaaaggaagaggcactggagagggtaggaaggacagtcttgaattgcccacaccactactccctcatcccccagcagccgctgcttggcaccaggagagaatctgtatgcttgagggagagagaacgcggttcctttgggacttggcgttggaactcagtgctgcctgtcacagcagaaagcaacaaggggcagaattcaggtggcactcatggagggagcatttagaccagccctggctggtggagaatggtccatcccctgagcttctgccagcccccccacagcaggctaaagcactccggggttctaaataaacttgaaaggcagtctaggccacaaggactgcaattcctggggaagtcccagtgatgtgctgggttcagagtcagtggaattggaggcgcaggccacctacggaggcaccagaggaacagcgaagggagcgcttgccatcactcctgcccttagccccaggcagcacaactcacagctctaggggagaatccatcctgcttgaggaggttgggggagagtaaagaggactttctattacaacttggataccagctcagccacagtatgatagggcactgggcagtcttgaggcctccattcccggccctagttcccaggtgacatttctaaacacaccttgggccagaagggaacccgatgccttgaagggaaggatccagtcctggcaagatgcatcattaaggagccgttggtccttgaataaatgtcagctgtagccagttagtacttgccatgggccttggttgagactcagaggcatgctagcttcaggtgtagcccagcgcattcccgcctttcttggccacagggaaagactccttatgcttgaggaaaggagaaggaagagtaaaggggacttttcctttactcaccagctcagccacagcgaagtggagcagcaaatggggaccctgagtccaggctttggctcctggacattatttttggacctgctatgggccagacgggagcccactaccctgaagggagagacccagacctggaagcattcaccacaagctgcctgaaaagcccatgggcctcgagggaacatctgcagtagccaggcagtacttgccctgggcctgggtcgctggtggctgcagggaaactccctctgcatgaagaaaggacagggaagagtggggaggactttgtcatgtggcttgaatgccagcacagctgcagtagaatagagcaccaggtagattcctaaggtttctgactccaggtgctggcttctggacagcattcctggaggtaccctggatcaaggaagacctcattaccctgacggggacacaagcctctctgggtttcccatctgctcactgaagagcccttgggccgtgagtgaacattcacagccagacagtggtcactgtgggtctttggagagacccagtgctatgctggcttcaggtgtgacacaatgcagactcagtggtggtggccacaggtgtgctcatgttatccctctccagctccaggcagctcagcacagagaaagactgactctttttgggggcaaagtgagggaagagaacaagagtctctgcctggtaatccagggacttctcccagatcttatccaagaccaccaagatggtacctgtacaagtctgcaaaagccatagtattattggactgagggttccccaaatgcagatatggctgcagtgactaaagatttatatcacagcatcagttcccttggaatacttggtaagccttcctaagaagggtgggtacaaacaagccaagactgtgaaggctacaataaatacctaactctacaatgccctgacactgatgaacatccacaagcatcaaggccatctacaaaaacgtgatctcaccaaacaaataaagtaccagtgactaatcctggagtgacagagatgtgtaatttttcagacacagaattcaaaatagctgttccgaggaagatcagtgaaattgaggatagcacagagaaggaattcagaatcctatcagataaatttcactaagagattgaaataattataaaaactgaagcagaaattctagaggtggaaaatgcagttggcatactgaagcatgcattggagtctctcaaaagcaaaactgattaagcagaagatagaattagtaggcttaaagacaggatatttaaaaatacaaagttggaagagacaaagaaaaaaatcaaagcacacctataagatctagaaagtcgcctcaaaagggcaaatttaagttagtggcctcaaaaagtcagtagagagagagagagacagagatctaggtaaaaagtttattcaaatggataataacagaactttcctaaactagaaaaatatatcagggtttaagtacaagagtgttatataacaccaagcagatttagtccaaaaacgacctcaaggcatttaataatcaaactcccaaaggtcaagaatagagccctttgtcagacagatagattgcaaaagttttctcccattctgtaggttgcctgttcactctgatgatagtttcttttgctgtgcagaagctctttagtttaattagatcccatttgtcaattttggcttttgttgccattgcttttggtgttttagtcatgaagtctttgcccatgcctatgtcctgaatggtattacctaggatttcttctaggatttttatggttttaggtcttacatttaagtctttaatccatcttgagttaatttttgtataaggtataaggaaggggtccagtttcagttttcctcgtatggctagccagttttcccaacagtatttattaaatagggaatcctttccccatttcttgtttttatcaggtttgtcaaagatcagatggttgtagatgtgtggggtcacttctgaggcctctgttctgtttcattggtctacatatctgttttggtaccagtaccatgctgtttgtttttgttactgtagccttgtattatagtttaagtcaggtagagtgatacctccagctttgctctttttgcttaggattgtcttggctatatgggctcttttttggttccatatgaaatttaaattagtttttcctattctgtgaagaaagtcagtcgtagcttgatggggacagcattgaatctataaattactttgggcagtatggccattttcacagtattggttcttcctattcatgagcatggaatgtttttccatttacttgtgtcctctcttatttccttgagcagtgatttgtagttttccttgaagaggtccttcacatcccttgtaagttgtatacctaggtattttattctctttttagcaattgtgaatgggagttcactcatgatttggctttctattattggtgtataggaatgcttgattcttgcacattgatttttgtatcctgatactttgctgaaggtgcttatcaacttgaggagatttggggctgagacaatggggttttctaaatatacaatcatgtcatctggaaacagagacaatttgacttcctctcttcctatttgaataccctttatttctttctcttgcctgaatgctgcggccagaacttccaatactatgttgaataggagtggtgagagagggcatccttgtcttgtgctggttttcaaagggaatgcttccagccttttcccatttagtatgatattggctgtgggtttgtcataaatagctcttattattttgagatacattccatcagtacatagttaattgaaagtttttagcatgaagcagtgttgaattttatcaaaggccttttttgcatctattgagataatcatgtggttttgtcattggttttgtttatgtgatggattatgtttattgatttgcatatgttgaacaagcgttgcatcccagggatgaagccaacttgattgtagtggataagatttttgatgtactgctggattcgttttgcctgtattttataatctacgaggaacttaaacagatttacaagaagaaaacaaccgcatcaaaaagtgggcaaaggatatgaacaggcacttctcaatagaagacatttatgtggccaataaacatatgaacaaaagctcatcatcaatggtcattacagaaatgcgaatcaaaaccacaatgagataccatgtcatgccagattgaatgacgatcattaaaaagtcaggaaacaacagatgctggagaggatgtggagaaataggaacgcttttacactgttggtgggagtctaaattagctcaaccattgtggaagacagtgtggcgattcctcaaggatctagaaccagaaataccatttgacccagcaatctcattactgggtatatacccaaaggattataaatcattctactctaaagatacatgcacatgtatgtctattgcaacactattcacaatagcaaagacttggaactaacccaaatgcccatcaatgatagactggataaagaaaatgtggcacatatacaccatagactactatgcagctgtaaaaaaggatgagttcatgtcctttgcagggacatggatgaagctggaaaccatcattctcagcattctaacacaggaacagaaaaccaaacaccgcatattctcactcataagtggcagttgaacaatgagaacatatggacacagggaggggaatatcacaccagggcctgttgtggggtgagagcataggggagggatagcattaggagaaatacctaatgtagatgatgggttgatgggtgcagcaaaccaccatggcacgtttttacctatgtaacaaacctgcacgttctgcacatgcatcccagaaactaaagtataataataataataataataaagaatagagaaatgttctgaaggaagtgaaagaaatgaaagaaaatgcagttgtgctccagtacatctggcagcagacttttcagtggaaacttgacaggccaggagagagggacataatgtatttaaagtgctgaaggaaaaaaaaaaaaaaaaaaaatatatatatatatatataatcctagatagtatatccagcaaaagtatccttcaaacatgaaggagaaataaaatccaagggatttcatcaacaccagaccggttctataagaagtgctgaagagagtttttcaatatgaaattaaaagacattaataaacaataggaaatcatctgaagatacaaacctcactggtaatcgtaagtataaagacaaacacaaagtattatgacattgtaattatgatgcatgaactcatatcttgagtagaaagtctaaaagatgaacctattaaaataactacaacaacttttcaagaaatagacagtatgtaatatatgtatagaaacagccaagagttaaaaagcaggggacatggagttaaaaagcatgggacacgaagttaaagcctacagtttttattagtttcttctttgcttgttagtctgtttatgcaaccagtgttgtcgtcagtttaaaataatgggctgtaagatactattttcaagcctcatggtaacctcaaatcaaaaaacctacaacagatacacaaaaagaggcatgaaattaaaatatacttccagagaaaaccacattcactaaaacgaagacaggaaggaaagaaggaaggaggagaccacaaaaccaccagaaaacaaataacaaaatggcaggctgtaagtccttacttaccaataataacattgaatgtaaatagactaaactctgcaatcaaaagacagatttgctaggtgggttgaaaagcaggagttgtggccagcgagatagctaatgcctgtaatccctgtactttgggaggtgggcagatcacttcagccaggagtttgagactagtctgggcaacatggcaaaaccctgtctaccagaaaaaacaacaacaacaaaaaaataaattagccaggtgtgttggcatgtgcctgtagtaccagctactcaggaggctgaggttaggaggatggctgaagcccatgaggtggaggttgcagtgagccaaaatcacaccattatactccagcctaggcgacagagtaagaccctgtctcaaaaaaacaactcttgcctacaagaaacacagtttacctataaagatacacatagactgaaaataggggatagaaagagatattccatgcaaattgaaagcaaaaaagaacaggaatagctatatttttataagacaaactagatttcaagacaaaaactataaaaagatacaaagtcattatataatgataaagggatcaattcagcaagaggatatcacagttgtaaatatacatgcacccaacagtggagcacccggatatataaagcaaatattactgtagtgaaagatagagaccccaatatgttaatagctggagacttcactctgcttctagcattggacagatcatccagagtatcaacaaagaaacactgggcttaatctgcactatagaacaaatgtacttaatagatatttacagaacatttcatccagtggctgtagaatacactttttcctcagcatatggatcattctcaaggatagaccgtatgttaggtcacaaaacacgtcttaaaactttcaaaaacaatgaaataatatcaagcatgttctctgacaacaatggaataaaactagaaatcaataataagaggaactgtagaaactatacaaacacatggaaattaaacaatatgctcctaaatggctattgagtcaatgaataaggaaattaaaaaattccttgaaacaaaatgtaaacagaacataccaaaacttatgggacacagagaaagcagtattaagagaaaagtctacagccatcttcaaataaacaacttaataatgcatgtgaaaaagtagaaaagcaaaaatgaaagcataaattagatgaaaagaaataataaagatgagagctgaagtaaataaaatggaaacaaaaaaattacaaaagaccaaggtaacaaaaagttggttttttgaaaagataaaattgacaaatcttttgcctaaaagagaagacctaaacaaataaagtcagagatgaaaaaagagacattacaactgatactgcagaaattcaaaggatcattagtgactactatgagcaactctataccagtaaattggaaaactagaagaaatggataaattcctagacacatagaacctacaaagattgaaccatgaagaaatccagaacttgaacagaccaataacaactaatgaaattgaagccctaataaaacaaaatctcttagcaaagaaaagcctgggacctggtggcttctgtactgaatttcaccaaacatttaaggaagaataccagccctacccaaactattctaaaaaataaaggaggagggaatacttccaaactcattatttgaggccaatattgccctgataccaaaagcagacaaatacaaatcaaaaaagaaagctacaggccaatatccctgatgaacattgatgaaaaagtcctcaaaaatcccagcaaactgaattgaacagcacattaaaagatcattcattatgaccaagtgggatttataccaatgatgcaaggcaagggtggttcaccacatacaaaccaatcaaagtgatacattatactaggagaatgaaggacaagccatgtggtcatttcaattgatgctgaaaaagcatttaataaaattcaacatcccttcatgataaaaacactaaaaataactgagtgtagaaggaacatacctcaacacaataaaagccacatatggcagacccacagctactatcatattatgaaacattgatgtgagaaattgaagaggacacaaaaaatgaaagctactccatgttcatggattggaagaatcaatattgctaaaatgtacgttctgcccaaagcaaaccgcagatgcaatacaacccctgtgaaagtgctcatgacattcttcaaaaaaatagggaaaaaaaaaatcctaaaattcatgtggaaccacaaacgacccagaatagtcaaagacatctggaacaaaaagaacaaaactggaggaatcatactacctgacttcaaattattctacagagctgtggtaaccaaaaaagcatggtactggcataaaaacagacacatagaccaatggaacagaatagggaacctagaaagaaatccacaaatctacagtgaactaacttttgacaaaggtaccaagaacatacattggggaaaagatagtcttcaataaatagtgctgagaaaactggatatttatatgtagaagaatgaaactagacccctctctcttgccatatattaaaatcaaatcaaaatggattaaagacttaaatgtaagacctgaagctatgaaactatttgagactaaaagaaaacattgaggaagctcttcagaacgttgttctgggcaaagatttattgagtaatacttcacaagcacaggcaaccaaagcaaaaatagacaaatggattacatcaagtttaaaagctgcacaacaatggaaatactcaacaaagtgaagagagaacccacaaaatggtagaaaatatttgcaaactatttgtcagacaggattaagaaccagaatgtataaggagctcaaacaattttatgggaataaaatctaataatctgattttttaaatgggcaaaagatttgaatagtcatttctaaaaagacatacaaatggtaaacagctatgtaaaaatgtgctcaacatcattgcattagcctattttcatactgctatgaagaaatacccaagactgggtaatttataaagaaaaagaggttcaatgaactcacagttctatatgtctggggaggcttcacaattattgcagaaggcgaaggaggagcaaaggcatgtcttacatggtggcaggcaagagtgtgtgtgcaggggaactgccctttataaaaccatcagatcttgtgagacttattcgctctcatgagaacagcatgggaaaaacccacccccgtgattcaattacctctaccagatccctcctgtgacatgtggggattatgggagctacaattcaagatgagatttgcatggggacatatcaattattgatcattggtgagatgcaaattgacattacaatgagatgtttcacctcagtaaaaatggcttttcttcaaaggacaggcaataacaaatgctgttgaggatgtggagaaaggggaacgtttatacactgttggtcggaatgtaaattagtacaaccactacggagaacactaggaggttcctcaaaagaaacaaaaatagaactaccatatgatgtagcagtctcactactgggtatttatccaaagaaaatgaaatcagaatgttgaagaaatgtctgcactctcatgtttattgcagcagtattaacaatagccaagattcggaagctacccaaggattcatcaacggatggataaagaaaatgtagtgcatatacacagtgcattattcagccataaaaaagaacgaaagcctatcatttgcaacatggatagaactggaggacattgtgttaagtgaaataagccaggcatacaaagttaaacttcacatcttctctctcattcatgagagctaaaaattaaaacaatttaacttatggagattgagagtacaatgatggctaccagtggttgggaagggttgtgggggttgggggtagtggggatagaatgagtaagatctagtatttgagatcacaacacgataactacagtcaaccataatttattgtacacttaaaaataactaaaagagtataactggcatgtctgtaacacaaagaaatgataattgcttcaggtgatgcataccccatttactctaatgtgattattacacattgtatgcctgtatcaaagtagctcatgtaccctataaatatatatatctactatatattcataaaaatttaaaaattaaagatagagattatattcgatatttctacaagaaatttgtaagttttaattcataaaaattcttgtgttgcatttctattctttttttactagttttatttttaagtttcatcttcattttagtacctaagagtgaaatcacttatttgtacacatttttcagagttgtgtgtcccttgcatatatctatttgtacttctcatttgttttgttttgtttttaacttttcttttagattcaggagtacacatacaggtttattacataggtgaagttgtgtgaagggagtttgttgtacagattattttatcacctgtgtactaaacctagtacccaatagctgtttttttctgatcctctccctcctcccacctgcctctgtcaagtaggccctagtgtctcctctttgtgtccatgtgagctcatcatttagctcccaattataagcaagaacatgcagtatttggttttctgttcctgcttaagtttgctaaggatgatggcctctagctccatccacattcccacaaaggacatgatcttgttctttttgatggctgaatagtattccatgatatacatgtaccacattttctgtatccagtctgtgatgataggcatttaggttgattccatttctttgctattgtgaatagtgttgcaaagaacacatacatgaatgtgtctttatggtagaatgatttatattcctatgagtatatacccagtaatgggattgctgggttcaatggcagttgtgtttttagatttttgaggaatcaccacactgcttttcattttctccacaacctcaccagcacctattatttttgactttttattgccattctgactggtgtgagatggtaccccattgtggttttgatttgcatttctctaatgatgagtgatgatgagctttttttcatgtgtgtgttggcctcatgtgtgttttcttttgaacagtgcttatttcctttgcccacttttaatgggtttgtctgtttttttttcttgtaaatttgtttaagttcctcatagatactggatattagacctttgtcatgtgcatagtttgaaaaaattttctcccattctgcaggttgtctgtttactctgttgaaagtttcttttgctgttagaagcacttaagtttaattacatcccatgtgtcaatttttgcttttgttacaattgcttttggcatctttgtcatgaaacctttgccagtttctatgttcagaatgatattacctaggttgtcttccagggtttttatagcttttggttttacttttaagtctttaatccatcttgagttgatttttgtatatgatataaggaaatggtccagcttgaatcttctgcatagagttagccagttatctcagcaccgtttattgaacattgtcaaagaacaggtggtcatagatgtgtggccttatttctggggtctctgttctgttccattggtctatgtgcctgtttttgtaccagtaccatgctgttttggttattgtagccccatagtatagtttgaagtcaggtaatgtgatgcctccagctttgttctttttgcttagaattgccttggctatttggccccttttttagttccatttgagttttaaaattgttgttttctagttctgtgaagaatgtcattggtagtttgataggaatagcattgaatctgtaagttgctttgggcactatggccattttaatgatattgattctttctatccatgagcatggaatatttttccatttgtgtcatctctgatttctttgagcagtgtttcataagtcttattgtagagatctttcacctccctggttagctgtatttctaggtattgtattcttttggtggcaattgtgaatgcaattgctttactgatttggctcgtggcttggcagttgtgaatgtataggaatgctagtgattttttaacattgatttttttttttaatcctgaaattttggtgaatttgtttatcagctgaaggagcttttgggctgagactgtagagttttctagctacagaatcatgtcttctgcaaacagagatagtttgacttcctctcttcctatttaggtatgcgttatttctttctcttgcctgatagctgtggccagaacttcccatactatgttgaataggcatgataagatagggcattcttgtcttgtgcctcttttcaaggggaatgtttccagtttttccccattcagtatgatgttggctgtgggtttgtcatacatggctcttaccattttgaggtatgtccctacaatacctagtttattgatagttttttaacatgttttttaacatggaaggatgttgaattttatcaaaagccttttctgcatctattgtgcatcattgtgcatctattgtgataatcatgtagttttctgcatctattttctgcatctgtaatcatgtagtttttgtctttagttctgatgaattacatttattgatttgtgtatgttgaaccaaccttgcatatcagagataaggcctacttgatcttggtggattagctttttgatgtgttgctgggttcagtttgccagcattttgctgaggatttttacatcaatgcttatcaaggatattggcctgaagtgttttttttgttgttgtgtctctgtcaggttttgatatcaggatgatgctggcctcataaatttgatggggaggagtccctcctcttcaattttttggaatagtttcggtaggaatggtaccagctctttgtccatctggtagaatttgctgtgaatccatctggtcctgggcttttttgttgttgttgttggtaggatatttattactggttcatttcagagctcattattggtctgtccagggaatcaatttcttctttgttcagtcttggaagagtgtgtgtgtccaggaatttatccatctcttctaggttttctagttcatgtgcatggagttgtttctggtggtctctgatagctgtttttatttttgtggggtcagtggtaacataccctttgttgttcctgatagtgtttatttgtgtcctatttcttctttattaatctagctagtggcctatcttattaattttttcatggagttctacctgtgtctctcaatgtttcttggagttaaattggaacttttgtatctgttgccgtaatagaaggtcttgaagtacttagtataaactgcccattttatttcttatgtatatactttatcaaactctactggtttgtgtatactacatgatgtttgaaatgtttatttcatctcccatggtacctggcacagagtttggggcaagtgaaagacatagaagttgacatgacttgtagatttctgagtatatctggatccattagggctgtggaatttgatgctgggtgagatggattcttagcagctttctaggttcctgatgaggaagcattggagtgactactgaaatggaagaatggggtgggacaacatcagattctggactctggaatgtaattgtctgcataagactttagcagctaaagcagctctctttatccaccaatttcaaaatatgcagttgttaactcctatatcctctttctcttactgtcaatctctaaagctttagcaggttggggaaatttttctccggcctcagtctgctatcatctacattaaaaaacaaaaaacaaaaaactaatgtttgcataaaccttttctccttcatactattttgatcacggtccttattggcttttttagaaacatttggcctggcaatgtttgttttatttaagtactttttttaacatatgtatatacccataaaagttcaccggaattaaagtaatgatcatgtccatttttctgaatgtttctgtgagatttttaataatttttctcccatgcacccttccaatccattctaaacttttttctatcactgtatattagtttgcacatcctacatttttacatatacatagcatgcattcttttatatctggcttacttcactcactaaaattattttgagatttaatgatattgcagtgagcataaagttttttgtatgtttctaatccatatttattgtatggatataccacggtttgattgtccatatgttagcaacggtgaatccacatgggtctgcagcagcttgattcttgcctccccagaggaaagaattcatcacaggggcataaggcagagtgacagagtgaggcaggttttagaatgggagtgaaagtttattaaaaagttttagaggaggaatgaaaggaagtacacttggtagacggccaagtgggctacttgagagatccaagtgcaccatttattctttgtcttggagtttttatacattggcatagttctggggtctgcatttcttctcccctgattcttcccttggagcgggctgtctgcatgctcagtggcctgccagcacttgggaggggccgcatgctcactgtgttgaccgaagttgtatacatgatcatttgagtgtttttgccttaccagttgaatgttcctaaaagaaggtcatataccagttaaacttagcctcctagtgcacgtgctacagcccacttgcccaactcctgaaatcctactaggaagctgctgatatcagcttcaggtgttttctatctgctgggagactgcctttccctggcagtggctcttaccaattattattctagggagacacttaaacaactacctgaccatcccgtgatggtcacctagcatttctaggggtagggggtctcctgccatgctcatgtttgcttaactacttattctaacacattcacctattgatagacatttgggctttctccagtttttgattattacataattaaggctgccataattatttgtgtataaatcttttttatgaacctatacttttatttctctttgtaaatatctagagaggaatggctggatcatatgatcagtgtatatttaaactaagaaattgtttccaaaagtggttgtacaatttttacactcacaccaatattggagttccagttactatacttcctcaccaaggtttagtatagttaatctttttaattttagtcattttaatagttgtgggttatgatttgcatttccctaataataacgttgagcctctttttatgtacttctttgccatttgtatattttctttggtaaagagtttgtttaaaattttgcatatttattttattggattaattgctttattactgagttttcatagttctttatacactttgagtacaggcctttatttgatatatgatttgatagtactttcttcaggctgtggattatcttcttattttcttaaaaatgttacacaaatagtggaagcttttattttcatgatgttcaatttattcttcatggaccatgcttttagtgtcatgtctaagaaacttttgcctaatctcagtttgcaaaggttttctactaaattttcttttagaagttttatcattttaagttttcaaattaggtcaatgatctattaattaatttttctataaagagtgagacatgagttcaagtttattttttttacatggatattcagctgcttgagaaccattttcaaaagagactattctttctacgctgtattgccatttgcaccttgcttgaaaattctgatgtccatatacttttggatatttcttggctcatgactatcttgattactatctctttataatattgtaagttttgaaatgaagtcatattggccctttaactttgtttcttttttcataattgtcttggctattctaggttctttgcattttcatagaatcagcatgtcaatttctgcagcagtgcctgctgggaatttgaagggattatgttcaagatatagtccaatttagggagaacttgcatcttaataatgttgagttttctaacttatgaagaaggtataacatatctctccatttatttaatgctttagtctccctgagaaatctcatgtttttagtgtatagatctttgttacttatttgatttatacttacagttttcataatttttaattctattgtacatatattgctttttaattccaattttcagtttttccttactgacataaagagatacaattgatttttttcgtattgaccttgtatcctgaaactttactaaatcactcattagttttataagttatatatcatgtacaattatatataaaatatagatgatatataacacaaaaactcttataatctataacataaactgtaggatatatattaaaatgtatatatcatgtatgtaaatattttttctattggattttctatatagattccctggtcctctaggagtaaagagttatattttttcctttctaatctcaaatgagtttcatttttttaacttaccttatttcattggctaggatgtccagcacaatgtggaagagaagtggtgagagtgaaatccttgtttagtttctgatgttagggtgaaaacattcaatatttcaccgttgagtaaaatattagctataggcttttcatggatccctttttccagtttccttctgtttctagtatgctgagggttgttctcttctgtcttgttatttttaagagcaggatgaatattggagatatcaaaagctattttctgctcttagtgagatggttatatggtttttcttttttgttaatatggtgagttacatcaattaatttttgaatgttaaatcatccttcagtacaagtaaaattgtaataagttccacttagtcacattatattttctatgtattattggatttgacttgctaaaattttgttcaggatttttcatctattctcataattttctgtttctgtaatgtttctgtatgattgtcagggtaatttaatgctggcctcatagaatgagtcttgacttattttctcatatacttttctggaatagttgatgtagaattaatatctattccttaattatttaggcctggtgtttgggttataaaaatgctttaaaaaacaaattcaattactttaatatatatgggattattcaggttaatgagctcacttgatgaatgagcattggtagtttttatctttcaataaatatttgcacttaacctaagttgttgaatttattggcataaagttgttcaaagtattcccttatccttgtattatgtatagactctgtcataatattatctgtcattcctgttattggtaatttttgtccgaatttgtgtcttctcttttgtattcatgatcaatctgcctagaggtttattcttttaaaaaaattctcaactagcttttgttttaatttattttctgtattatttctgctttctagttcattgatttccactctgttctttaccatttccattttgctgctaactttgccattcaatttcctcttctttgtgaagaggtcattgattttgagacctttcctcttatctaatataggcatttattctgtgctattagtttccttctaagtgctgctttagcagcatcccactgactttgatatgctttgttttaattttcactctgtacaaagtactttctaattttccttttgatttcttcattgaccctgaattattcagaagtgtatttttcccagacatttaaatttttctggagatgttttgttactgatttctaatttaattctgttctggtcagggaacatgcttgtgtgacatgaatgctttcagtctgttgagacgtacatattctgctatcgttggacacattgtttgatagataccaattcggttacattggttgataatgtttttcaggtgtgctatcttgagtagattactttttttgatgattttttgtttgttgaatcaaatattgtgataagggttttactatgttagtggttgctgtaagatttatactctcatctgtagcttatgaaaatctacctttaagtgatattaaagcactttacatacagtataagaaccttgtaatagcatgtttcagtttctgtccttctgatcattgtgctattgttgtcgtacgtattacttttagcatgttataaacgtcaaacaacattactattatttatgtttaaataatgaattatcttttaaatatatttaagtaatttaaaagtatttgcctatgtcttaccaaatccgatgctcttcttctttgtgtagatacgtttttctatctggtttcatttttcttctgcctgaagaactttaacatttcttttaatgctggtcttctggtgatacatttttgcagcttctatatgttttgtaatgtctttatttcatctttgtctttgaaaaacttttgggttggatatagaattacaggttaacaattatttttcttttattactttaaagatattactacagtattttctcacttgtgctattactaaagagaaatgtgctgccattcttacctttgttcctctgcaaaaaaatgtctgtttttcctggctccttttaagattattttttttttaccactgattttaaatgatttgattatgttgtatccccatatagttttatgggtcttatacttggagtacattgagcttcctggatctgtgattttatagttttaataaaatttaaaacattttttcattacttttagaatatttttctcttccccctctcttttagagaacaattacatgtgtattcagctcctttaagctgccccacagcctacagattgtattttcaatttttaaaattgtttattccctctttttgtttcatatgatttctattgctatgtctaggctcactcatcttttccttctacaatgtctaacctgctgttcattccacccagtgcatttttcatccaacacattgtagtttttatctctagaagtttgttgggctctttttatatattacatatctatatttgagtttttgaacttacagattatttgtaataactgttttaatgtccttgtctactaattctcacatttttgtgagttctgcgtcagttttgattgattcctttatctctttattatgaatcatgttttacagattcttggcacatctaggaattttttttttttggttgccagactattaccttattgggcactggatattatttttattcctataaaggtcctagatcatatttctgagacacagctagatttattagaaacagtttaatccttttagaccttaatttaaatgttgttaggtgggaccagagcaatgatcagtctacatgtaactacccactactgagccaatacccttctgtgtactctgcccagttctctgtgaatcttgagcatttcagtgttccttttgggaagaagcactcctcggtcttgtgtgcatgttaacactattatgtttaatccattcaagtagttttctaataggtatgtgttgaataatactcagctgcaggggaccctctgcagatctctggagttatttctttgtgcagccctctcatccttcctatgaaatgtagctgctttggactcttcaaactctcagcttcatcacttgaatataggaagtctgctagtttttcacaatggctttttcttcctaatctacagacaggaaactttgtaggcagtaagctgaagcagttaatagagctcaccgtgtttgtttcttctgtctcaaggatcattatccttttttgcttgataggtatcttgaaaacttgtatattctgttttttggtggaaaaaactttttttcaggcaagcagattaaatatctggtctcttctccttcctctaggccagaaggaaagtttacttggagtatttcttaagggagaaatttatttataaaggcatacgcccaaactgtccctctttatttatcagtgctggtatatcctaatgacatactctctactggtgagaatagttccaccagacagacagacatctgctttagcattcagcagattcttggatagtttatggaatgacttctttcaagtgattatgaatccaaaaagtagaattacaagaattaactagtaatatttaagaaatgcatgatcttgagagtcttatgtgttgttcacctataatcctcagttctcacaggagtaagtagaaatgttagtttaatcaggttatgagaacaaatgaaagtagatattaattattcacactgattttacattttgaagatataaggtgtttattaatgtaaactatttgcttctttctaaaataggggttgtagaatcattgagcttgatagagatctagaataaagtactatttttatattgatcttaaatatgttagtgtagtttcagtaattcctgtgggatcgtcatacagtaattacaattttaaggagtttatgtgtctcaaaatgttatcattgcatatattaatgctattataaatgcagtcataaaaagaaatgtgaggaaaattattaaataattatcagaatgaagttgagttaataggtgtgccatccaattataacttgccctaagagaaatatcagtggaggttgaacatttcagcctcagctaagacatatacttgtgctaacttagactaggaagtatcataaagaaaaaggaactttttattagtatctcctattgacaatatcttgttatagtttagaacgtatgtattataggtgtggattgaactattaaatggaagatcaaacacttttttcagatgttgccattttcatgggagagtatgttgaagtgcgttttggaacatgttaagtaagctagagtgagaaggtatagacaagcatatggggagactaagatgatccatgtggtggtggattagagctagagacatcagcatgaactcatgtttagcttaatatagatacagttggagatacacacacatacacatatatacatacatatctataagtatttacgtatacatacagaaattcttcattttattgtgccttgcattactgcacattgtagatattgtgtttttttgcaaattgaaggtttgcggcaaccctgtctcaagcaagcctgtcagtgccatttgtccaacagcatgtgcttgcttcacatgtcactctgtgtaacattttggttattcttgccatgtttcaaaccttttcattatcatatttgttacggtgatctgtgatcagttatctttggtgttactactgtaattcttttaggcattacaaacagtgcctttataaggcagcaaacttaataagtgcatgtgttctgactactccaccagtcaactgttctcctgtcttctctctccttaggcctctctcttccttgagacacaatgataatatacttaggccaattgatgactctacaagaatgtctatgtgttcaaatgaaaggaagagtcatacatctctcactttaaatcaaaagctaaaaatgattaagcttagtgaggaagacaggttgaaagctaagataggcccaaaagctaaacctgttgcaccaaacagccaagatatgcatagataaagttctcgaaggaaattaaaaagactcttacagtaaacacatgaatgaaaggcaagcaaaacagcctcattggtgatatggagaaggttgagtagtctagatagaaaataaaaccagtcacaacatactcttaagtcaaatccagagcaaggccctgactctcttcagtttaacgaaggctgagaagaggtgaggaagctgcagaagaaaagttggaagctagcagagggttggttcatagagtttaaggaaagaggccatctccataacatcacagtccagggtgaaacagcaagtactgttgcagaagctgcagcaagttgtctgcaagatctacctaaaataatagatgaaggtggctacattaaacaatagactttttttttttttttttttttgagacggagtgtcactcttattgcccaggctgcggtgcaatggtgcaatctcagcttactgcaacctctacctcccgggttcaagtgattctcctgcctcagcctcccaagcagctgggataacaggcgtacaccaccatgcccaattaattttatatgtttttagtagagactggatttcaccatgtttgtcaggctggtcttgaactcccgaccttaagtgatccaccccccttggcctcccaaagtgctgggattacaggcgtgagccaccatgcccatcctaaacaacagatttttatgtagacaaaacagctctctattggaggaagatgtcacctaggactctgatagccagagagaagtcaatccctggtttcgaaggacaggctgactctcttgttagggattaatgcagcaggtgactttaagaggaagctggttgggcatgggggcttacacctgtaatcccagcactttggggggctgaggcaggcagatcacttgaggtcaggagttcaagaccagcctggccaacatggtgaaacctcatctctactaaaaatacaaaaattagccagatgtggtggtgggtgcctataatccaagctacttgggaggctgaggcaggagaatcacttaaaactcaggaggcaggggtttcactgagccaagatggtgccactgcactccagcctgggtgatagagtgagactcttgtctcaaaaacaaaaacaaaaacaaacaaaaagccactgctcatttaccgtttctaaaatcctaggactcttaagaattatactaaatttaccatatctgtgttctgtaaataaaatagcaaagcctggatgctaacacccctgtttacagcatggtttactgattattttcagcttactgttgagacctactgctcagaaaccagattcctttcaaaatattactattcattgacaatgcactttgtcgtccagaagttctaatggagatatacattaggagagtaatgttgttttcatgtatggtaactgatatgttttggctctgtgtcccaaatctcatcttgtaggtcccataattcccacatgttgtgggagggacctggtgggaaacaactgactcatgggggcaggtctttcccatgctgttctctttgatagtgaataagtcccaggagatctgatagttttaaaaatgggaaccaacccaaatgtccaacaatgatagactggattaagaaaatgtggcaaacatacaccatggaatactatgcagccataaaaaatgatgagttcatgtcctttgtagggacatggatgaaattggaaatcatcattctcagtaaactatagcaagaacaaaaaaccaaacaccgcatattctcactcataggtgggaattgaacaatgagaacgcatggacacaggaaggggaacatcacactctcgggactgttgtggggtggggggagggatagctttaggagatacacctaatgctaaatgacaagttaatgggagcagcacactagcatggcacatgtatacatatgtaactaacctgcacattgtacacatgtaccctaaaacttaaagtataataataataaaataaaaaaaattaaaaaaaaataaaaaaaatagaaatgggcatttccctgcacaagctctctgtctttgcctgccaccatccatgtgagacgtgactagcttcttcttgccttccaccatgattgtgaggccaccccagccatgtggaactgtaagtccattaaacctctttttcttcccagtctcaggtttgtctttatcagcagcgtgaaaacaaactaatgcactaacataacatctattctgcagtccatggatcagcagtaattttgactttcaagtcttattatttgggaaatacatttcataaggccaaagctgccatagatagtgattccttaacttggcaatgtaaattgaaaccttctggaaaggattcaccattctagatgccgttaagaacatccatgattcacagcaagaagtcaaaataccaacattaacaggagtttggaagaagttgattctaaccctcctgggtgactttgagaggttcaagacttcagtggaggaagtaactgcagatgtggtagaaatagcaagagaactagaattagaaatggagtttgaagatgtgactgaattgctgcaatcttatgatgaaactatagtggatgaggaattgcttcttctggatgagaaaagaaagtggtttcttcaggtgagatctaggcctggtgaagatgctatgaacattgttgaaatgacaacgcaggatttagaatatttcataaactgagtttagctttattttggcagttatcagtttatgttgaaacaaaatacaagcactacataaaaggactttaaggttcaaataaaaaatagatttaattcattttgtatctatttgtataataaacatctttcttaaattgttgtgtaatttctcttaggtacctgtgcagcacaggtaatttggaatgaatgccacaccacccatctttccctgttaatgatactgagtaaatactgagagcaaagaaatggggaaaacagctcattaaaaggtgtcccatgctgtgaaatgtggaacatatttttcctacttacttctttgattgaagacaaaatatttaggcacttagatggcctttgagagaatctttgtgtcacagtggagctgcttatttgaaataattttttgaaaatattaactttccccatttttaaggtaaaagtattgattagctacatattgttaaactcttctctttagcttcatctgctctctttcttgcttttgggatcctcatcttcttcctaaggaatggcactaatcaggtttgaaagtttgggggacacttcaagttgctcatcatttcccacagccagctttccctctggaaatacaaggtagtcttgtatttacctgtgttcctgtgctgcagaatgacgggtcttgcagatttgttataggacagttggttatcttgtgctcttactttaactgattgattgtcaacataaagatttctggggttagtgaaagaacaaagaaaaagggtgtgtgttatggtgaaatatttaggaactgttatggactgccacttattattttattgaaaaaataagtgtcatttatatattacatgtactattattttattgaaaacatgagtgccatttatatattacattattttcaataaaataatgctctcattttcaataaaataatatatattattttattaaaaaatgagtgtcatttatgtattacatgtactatggtaaatatggagatgaaaggtaacaattctgccttcatggtttttataggctactggctacatacataagtataattcatacagggtaagaaatagtatgaggccctaggtactgcttattgagatgcttgtggatgcatactggggagctgtattctgcttattggcactgatacttatttccttattaatatcagaaaaatatagaactacattgggggtggctgggcacagttgctcaagcctgtaatcccagcactttggaaggccaaggcggttagatcacctgaggtcaggagttcaagaccagctggaccagtatggtgaaaccgtttctctactaataatacaaaaattattcaggcatggtggcacatgcctataatcccagctacttgggaggctgaggcaggagaatcgcttgagtccaggaggcagaggttgcagtgagccgagatcacacctctgcactccagcctaggcaccaaagtgagactcagtctcaaaaaaaaaaaaaatacattgagggtagcaagagttaaaagggagaaataataaaaatgaaacagctataagaggaggaaggaagttaggggtgggagttctgaagataaagcacttctctaataatctgagctccagatgaaagcacagtgagcaagaacagtgcaaggtttcaaggcatcaagttgtcagatatctttcctttcccctccaaaccagctgtctgtcactctctgctctcatctgtacacccagggactgatatgttatcctctggcttccaattgcatttggccaatggagaatcctacaagtacactggagaggagaggagagtgaaaatatattatttttatcttggagcctctgcacagctgcaataaataggctggctgtatccttctaccaaagatcacagctcaaactaaggtagccctttctccatctctctgcttgctagttctgggaacacttgcatcttcttgcttctttaggaatagctcagtggctcctagctctggtgtactgcttattaccttgttggcatagtccctatattaagccctccttgaactatctctatttgagtacatcatatgcttccggactggcacattgagaaaatagagctgccagaacttctccatcacatagtcttcttcccacttcattttatgagtgatgaaaaggaggccagggagagagtagcttttcccaaatatttaagtaaagactagtgtggaatctagacatgccatttcctagtcctcccagttctaatttcccacttattttgaaattttgtaaatatatttctatttagtttcccacttccaaggcttctaatgctgaggctgtgaacattcctacaatcaggttttgagcttatagaaataaatgaagacgctggcccacctaaggggaacagaggctttttattcagagctggctgtagcaaaggagtgagccaccatcacatgctctgggcggcgtatgtgttctcattggtggttgctgcatggtgaagctggagcaggctaactagaagtgaggcatctaatttgattggtttagggagcatatgttttttttcctggttggtcctgagttggaacctggggcaaaaaattagagaagcaaacagtcattgtccaagtcctgactgttctgagctgattattgcagagcatatgggtcagagttctactgtcatatatgatctagctgttatctgttcgtgtagtcagtgcgtcaagcatgaaagcagttgatttgcattccagctttcttactcatcatctgaaggaacctgggccattgaatagcacactaattataatgtccccagggagagttcaggatctctagaaggagaaagtgtggctctctagaggaagtgatggtagaattgggaagcacacagtgggaggcaaatgttgcacagcttggagcagttcttttgacagtctcctagatgaaggcaaatagggacagtgcttgcaggatttgaggtcattcatatgtatttgtgccttggggatataggtttgccacagccgactttcttcataggagctttgtcagtcattagcatgactaggctacaacttctttgcgagctctttcattgcacatagcagcaatattttcagtgaagactaaacagaaaactttattcttacctgaggatctggcattggagagtggccaccacatgagtcaagcaccaagttaggtgaaattctaaattcgattctcctatatatagtttcccagtaattatccactgaagttacagtgagcttcaatggagcgagttcttgaaaaaggccctgtcttcatctcatcctaatccagctgaggatgcagaaatgcagctgttgtgtatagagtaattggtttcttcaattcttgtgaagtcttggctcctactctacctagattttcgttgttttggttgttgaatcacttccctttttcacagtatcttatataccttagcctgagattggctgtgtgatgatcctaaaggctcaacctccttcgtagactcactcccactgcacgggagtctccaaagtgactccacttccacttttattgctttttctgaggaaattccaggcatgataagtcaaatgagaaatttaatttgagaggaaaagagggaggagaggagcctctgaaattacctttacagtcttataataaccttgaaaagtattatatagtttgggggcaaaaggagctgacccttatctcttatcatacttgattaggtctctgtctgaggtttccaggagttgtacctccatagctagtgctgcgtgctcttataatggagcagaggtactgttgtttgggacttaatactcagagtgaactattgactcaggataggaccaattgccgccattgttcttctccagcacttggtagagacagggattctaagctgtcaaattgggataagttggattttaattctattcagtagggcacaattcattgccctgtgatttcctaggggcaaaaaatgagtctgtttttatgtatctatggactaccacaataatttacataaagatattcagatatttattgttacttttctaaccaacatgttaaaaagttacttatgatagctatccaaaaaattgctgattgatagatagtatcttttctctggaaataggttgaatttttaaaaatatttttatttccacatatatatgtgaaaacaaaaagtagtatcacatctttcattttgtttttgtttacttgaaagttgcattctcggctgggcatggtggctcatgcttgtaatccaagcactttgggaggctgaggtgggaggatggcttgaggccaagagtgggagaccagcctgggcaacatagcaagactctttctctacaaaaattaaaaatattagccagtcatggtggtatgtgcctatagtcctagctactctggaggctgaggcaggaggatcacttaagcccaggagttgaaggctgtagtgagctatgatcatgccactgcactttagcctgggtgacagagcaagactctgtctcttccaaaaaaaatctatattctcataggttttcgttcttgttctacaatgtgaagctcattgagttttctagtggttgatcttatgtgtttatatttgctcagaaaataaaaactagaaaatgtgactgtcattatttgtgtaaaatttgaataaagcaacaatccatattaacagttattgaaatattgtgtattgaaccagtgttagcaatccagcattggcaacatcctactttatttatttataagtttttgcaaatcagtatagtgatagaaatgcatgaaattacaatacttggagaactttttataatagggaaagaagctagtgacagaggtgaggatttgttcatgtattacatgaaaatattaatttaattggtttcctttaaaacttttgtataaatggcagtgatagttacagaactaggaaagatagttcatgcttaaagagatctggccttctcttttgttaatgaatgactttaaagttgaaatttgcattaagaatattaatgtgataattttcaaagtacccattagtctaacacttttaggataacaaaactaaattctaatgaagttgacatgtggaagaacagtggtaggtattaggaaaaagtaatctggtcacaataaaaatatgcttttgctcgaaaatctgtcaagataaattccaagcacttcaaaaaatgcatgttaaatgtgctttactacagttttgaaatagattaaaattatatgcaaattaatgcaaatcatgtggcttcaagattaagttttgaagtgctatcttcgttccctggagtaaatggctgctgaatgaatagatgcataaatatctgactggatgactggctgaatgaatgaatcagtttttcacttggaaagctgtttcattctcttctctgccagaagcccagttttatgatcttattcaaaatagaatctgggaggtgggcggttgtaactcaaagattagcctaatcaatccagttcaacccaggggacaccatctgccccggtccagtgtagagcgtaaaatgtagtgcatctgaactacaaaggaagaatgtcatttcctcagcactcatttgttgaataggtatctactgagcacgtattgggagccatgccttatttctgatgcatcacagttaacctctaagcagcaattgctattgtttttgatgttcattctttcttgaaatttcctcttctcttgaattctgccatatttcattttcttccctttccttctacttctgtaaaatttgcttcctttcaatctccttttctgaccttgttctgggagttccctgaggctcagtttttgccctgtgttctttctctgctccagtgattctcaaccctggctatgatcacagcctctgaggtgaggccccaagcatagtcaaatattaaaagctccgtaagtaattcttattcgcagctagacttgagagccttttttataccatagtccggggaattgtttgtgtctcaaaactttacttacgtctctgctgattagtgtcataccactatctcctttcacttaagtgcctgctctgtgcccctgcctaaccaagaagatatttccatttagaaataccattcccctggtttatctccaaaatatctttatatcctgatttttaatttattctttagttctaatctgaggaagattaatctttgatctttctttatttcttgattcaatctcttttgcatagtatgaccaaattaatactagcctcatcaaagagttagctactcttttgccccaaatccttttggctctccattgtctgcagggtcaaattgaaaatccttatcatggaatatgaaacttaaaattctagacccacagatcagcttccttacagaacatctctttgagacttttgtaaaatataagggcctgtgcattccagccttctgcatgaagtctttcctgacttcaaggtccatggtcacctgttccctccaagtcttatggatagtgctgtaaactgtgttatatcatgtaactgtttcattgaagtttggtaaccacctgtaagacaaaatcctgactgatcttgttctgaaacataactgtgaatatgtacttatattgagaagtgagctatatgttatagcagcaatgtaaggaatactaaaagtgcacatagcctattgtaaattctataagttcatagttaaccaacatttactgaatgactattatgtgctaggaacttgcttattcttactgtcttattttgtcttcatgtaaagtggcattatcccaattttaaatgagaagactgagtcctagcaactttaatcagctttcttcaatagaaagttatgactgggatcccagtttgatcttcagagttcaaatcttgtactttgtctccctaattcagtaagctcttaggagagagggcattttcttttcatcaaactcaatgacataggaggtagccattaatatgttagtaaataaagtgagagaaggatcctaggatgatacggtttggcttggtgtccccacccaaatctcatgttgaattgtaatccccagtgttggcagagggacctggtaggaggtgattagatcagaggggtggatttctcccttgctgttctagtgatagtgagtgagttctcgcaagatgtggttgtttaaaaatgtgtagcactggccgggcgcggtggctcacgcctgtaatcccagcactttgggaggccgaggtgggcggatcacgaggtcaggagatcaagaccatcctggctaacacggtgaaaccccgtctctactaaaaatacaaaaaattagctgggcgtggtagtgggcgcctgtagtcccagctacttgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaatgtgtagcacttctcccttagtgtgctctctctcctgccaccatgtgaagaagtgcttccttcctctttgcctttctaccatgattgtaagtttcctgacttcccagccatgcctgctgtgtagcctgtggaaccgtaagtcagttaaaccttttttctttataaattacccagtctcagtagttctttatagcaatgtgagaatgcactaatacataggataactggatttaccagatccctctccaaaagtctttctagatttggtcccaagtagaaggcctgccgttggccaaaaatcagctttcagtggtggattgctgttagagttgtttaagtaataccttgctcatagggctgatgctgaaaatattctaaaattatttgtgctatttagctatattaagataccttcaggaattcatttgatgtgatcttacaattgtaggagaggagaattgaggaaaattagcataatgtttatatagtgaagaagattaatgtatggacacctggcatgtatattttctaagaaactattttaatgaactggaatttgaaccctgccattgttacttaaagattcagactaagaaatgctataagaccaagcagaccaagtttgtttccttcaaagggaaagaagattagggaactctctattctctcctatcactgtctctgacgtgggaatgagaccagttcctatgataacagctgtccagcttggaggaactttctgttccaatctttagggaatagaagaccatgggtactctgtagttagagagaagggaatttagcccaagggaggagaacacttattcagaagatcattgtcccattaggtctctgatatatgtgtaaagtacattttctgatttagatttggtaagcaaatgtgctttagaataaagaatttaatcccaactatcattgctggcatgtacctattatactataaaatgatatctccttttattatctaaataactgagtaaattgaatgcttatatttttattaattgaataaataataggcttcacctataaaagtaactaaattctgttgtctgaactcttctttattgctaaaatttagcttaatagctttgttttcttagatactatgttatttaaattttttgcttgaacttttctatgaatagaaaaattaggagtaggaagcagaacttcaaagggaaatgtaattttactcttttagctgcattgctgagatcaaaagcatttgagaagtgacctaggtggccattacacgtaattggaaaagaagtacaatttcttattactgcatctaaaaatgaggacaacattctttaaatatcacgcttatataaaaacttgcagaaactcaatccacatgtcttaattagaagccaccataaagaaagacatttcattgttttaataacttatgttcagaaataaaactgctcttacttaagcactgcttagcagaaacgttaaaatcaagtctagagaaaaagtagaagatggtaatgttcctaagatacatgagaactgagtttggttacagttagagagaaacagaattttttccactcccaaaccagatctattgaatttacttggtttatttttgtatatatttggcatctaaagaatgaattgccttttagacaaaacccttctcgtagttgtttcttttgtattaatagttcctactttgcactaataggatattcctatttgaaaggggactattgcaaacaacaggaatgtatgagttttatgagaaaagcttccagatttttttttatacaatataaatgaattactgaacagagtttgtgacaatgggtatatgaactcctgagtatatgcagatactaactgggagggccacaagtagaatgttcagttattttattcaccttaaaaaatagatatccacgcctgtaatcccagcactttgggaggccgagatgggcggatcatgaggtcaggagatcgagagcatcctggctaacacggtgaaaccccatttctactaaaaatacaaaaacaaaattagtcaggcatggtggtgggcgcctgtagtcccagctagtggggaggctgaggcaggagaatggcatgaacctgggaggcagagcttgcagtgagctgagatcacgccactgcactccagtctgggcgactgagcgagactctgtctcaaaaaacaaacaaacaaacaaaaacaaaaaaaaaagctatcatattctggaccaactggatgattttttagtgtacttcctcaagatttttgcgttcatgcttgcttttctgtttaaaatcagtgctatagtagttgattttttttctgtatggacaagaatgaaataatcattgacatatagaaaagtgaaggaacattgaatcatcgcatggtgtataccttctcggtctgtagcatgttcatgtttaagccactgaacttgacactgtgagacagtgaacatgcaacactgaaagaacagctggataaagcaaaagggtgtggcaaatcatgccatacttaggaacagctgtgcagaaggaggtgcagtggacataagagaagactggcatgggagacaaggtgagtggaatctgcaagagccagtagattcttggctgtgatgggtacgctgggcttgagtagtgaggaacctctttaggtctcagatagggctgtggctgaagcgtagttgtgttctggaagtattgtgggtttttctctccctcagtgtagtagtgcatttcctattcaacgacacctccaactgataggtattaattgtcttaaaaaatagaaaaaaacaactatagttcttacttacatagcacggtatgctgggcactataaagagaaaatgaacgcctggtccctatcattaaagaacgaatatgctttgaaactcaagaactgtacagatgtaaggtagcattattattgtaataaaagaaaaagcgttgttctaagcaggcagttaaacatacagaagaaaatttataacattgaaaataccctgaaactctagctcgttacctaacagtgatttcatttattgtgaaaaatggcgaatgcaaattgcatgccttattatggtgtcatcatcagcaatttcatcttgcaaaaatggacaccacactatagataaatcttggagtccaagtattcagcatttaaagtgtttgtcagtattcactggcatctttgaatgttatagctggggaaacgtttagataaccctttgtttttctcacaccattgaaaaaaaggtaaagagacattaaagagtagccccacatttcttgactgttaacacagcagagccagaactccctgtaaagactctgcttcccagatcaatattggtggtggtttaatttaacccagacatctcttgacttatgccccttctgattgaaacccttcgatatggtttggctgtgtccccacccaattcttatcttgaattggagctcccacaattcccatgtttcctggaagggacctggtgggaggtagttgaatcatgggtgtgggtctttcctgtgctgttctcctgatagtaaataagtctcaagagatctgatggttttataaaggggagtttccctgcacaagttctgtctcgtctgccagcatgtaagacatgccttttgccttccgccatgattgtggggcctccccagccacgtggaactgtgagtccattagatctctttttctttataaacacccagcctcaggtatgtctttgttagcagtgtgagaactgactagtataccttttcagtgtcttaccatttgcttgaaataaagtccagggccgttaacgtgacccacaagcccggagtgtcccagccccacctacctctccaaattcatccctgccattcttcccctgctcccatgccacaatcgcagaagcctgtcttcgtttcttccagcccaacaaactcccatggcaggaatgttgcaactacttcaactggtccccattcttcacctgggatgacacccttctgctctcatatgcaatattttttttttaggaactaccttggcatttcttgacctttccaactaaaccagctctctctgcacttataatttataacattgttttcctttgtggtatctctgattgtttttatgtatttatttgtgaatatttgctttatgtgtttcctcagctggtctgttctcttcatgaacaaatgtgtcaattttgttccttgctgtacacatagtgcccagcacagaatacagactcaatacataaatatatattggtgtttggatggaagaggaagtaataagaatatgattgtgataatcactggaaatagaagtaatttgtcagttttacatgattgaataattgaagcaaatgtctgccaaaacaagttagaatcctgtagaggagctacattataatggtattgagcaaaatatctttaggtgaaggtagtattatgtatttctgggcattacaaaaatataagcagaaatatattttaaaataatgagattttagagtagcatgtatatgtttattaattattatcctcactaggagatcaaaacagttgattaagaggaatacagttccacaatgggagagccattttgagaattaatagactgtagctggcaaaaggaaaataggagttagagcttagcaaagggagaggaaatttcttctacccctatcctcccatagttcagcagcagagtgtttattaaaccaaaagtgatcaaatcacttttactgtgtcagcgatgggctgaaaaaggcacctgcatttcatgaattgatgagtaattgtttttagtcctgattctaagtaccctgttgattgcaatagtgtgatgtggttgaaaaagcactaggtttagagctagaacacctggatttgagtcctagtgtcaccacttaccttgttcattagacctggtacaagtcacttaacctcactgagggtgattttgttaatgaaatggtaccctgcaggattcttgcatgtatcaaataagataattacaggaaagctcttggagaactggatgcagtgctgaaatgagctctgtggagtcatgtatatatctgtctctaagtaatgcgcttaatgcactttgtgcagataagggtgctacacccagtcctctgatctggacaagctcacgttccactgggtagatgagatgcatgctaagaaatgtgtcttgatgcagaaattatcacaatgccacatactttgggaatttatagatgtggggaagaagactccttactgagatatcactgaagcatttttggggaagaaatagcatttaacctggaccttgaaacatgagtatggtttctatctgacgttccatttcttgttccattgatccctccctgcccctccttacctctcctcccctctccttatgcctctcttctcttacctacccttcctgtctttatcccctgctccgtttgccactcccttccccaaacttgtattgggaaagcagtttgatggttggaaagggtggtttattgatctaagatatgaataccagttcaattttgaaataaaatacagatggtccccaacttaaaatggtttgacttgagattttttgacttatgctggtgtgaaagcagtacctattcagtagaaaccacacttccagatttgaattttcatcttttcccaggctaggaatatgtggcgtgatcctcacatgtgagttgttcaagacttcattataaaataggttttgtgttaaatgattgtgtccaactgcaggcttatgtaagtgttccaagcatgtttaggctaggctaggctaggctaagctatggcgtgttctgtatgttaggtatattaaatgcattttgacttacagtggattatcaagatagtaagtcaaggagcatctgtactccatttattgacaccccatttaaaaaaattgttaaaaactatcaaactatgaacatgaagtgaaggatgcatgtttcgatgtagtctgaaattagctttcaacatgaatgaagtgttaggttttagcttcgtgggcaactttgtctgattttcttccattgacataaaaatagtctcaggcttgtgtgggaaaattaagtatatagatactattgcatttatcaagggagatataacttgtggattcattctataatgttttacaggagaattttttttatctcagaaataagaattttacatctctacaagtaaatcagaaatataattagatacataaattcataaacatacaaaataggtaaaatgattatatggatttctaaaagtacctttaaattggctgggcatggtggctcaggcttgtaatcctagcactttgggaggccaaggcacgtgaattgccagagctcaggagtttgagaccaccctgggcaacatggcaaaaccccgtctctactaaaaatacaaaaattagctgggtgtggtggttcatgcctgtaatcccagctattcaggaggctgaggcagcagaatcgcttgaacccaggaggcggaagttggtgcgccaagatcgtgccactgcactccagcctaggtgacagagtgagactccatctccgaaaaaataataatgataaaataaaatacctttcgattatactatagagcaaaaaaaatcgtgtaggtgtggataagtgagtatgtatgtgagtgtgcatgtggatttgcttgtatgaagacatgaagaaaatacaaagggaaactcttatttctgagaggtaggattgtgggtgagttttttcctttatggttgtttttattttagatattttctacagtgatcatgtattttattataaaagtgttataaaaatgagtttttacatgctatatagaactaaaaacacttacaaatgcaaaaacattatgtcttttgaaatgcaaggcctctacagaaacagtatccctcctgtttttaaaatcacacttttgatacccaatgagatagttcaccttcggtaacatgaggcgtttaattaacatccagtggggtatgattggaccccctgatgtgtcatactttcacgtgaattattatcttgcaacatacattctagtaataacaatgacgttatctagtaagttttcataaatactaagactatataaaaatcttagcttttcctctttatctcttagacagtacgtagttcaaagtatactttttacaagagcccgtgtcttctaaaaatctagggacatgttagaaattaatgcatttagtttaccatttttaaataactgagttttatttcattgacataaaggatccaagattttaagtgtttggattttattctcttaaaaaataaaaattacttttttttttttttttgagacagattcttactctgttgcccaggctggagtgcagtggtgcaatcttggctcactgcaacctcctcctcccgggttcaagcaattctcctgccttggttcccaaatagctgggattacaggcacgtgtcaccatgcctggcctggtctttcttaaagagggctttccctgagtgtatacatccagctttgtaagttgatgaatttggttctcagtaagtttgtaaagagaccctgctgatgtctgatcatgaggagctcactattctgtaggaaagaccataccctagttgggcagctctaatcatttcgaattttcacctgatttccgcctctctgtaatttccagcccttggccatatgttgttttctggaattctaatggataagactatttgctctatgagataacccatcacatatttgaagaccactatttgtcctacctaacttttgtttctaaggctcaccccaacaacccacccccagtttggttcattcagcagaactatctggagcactgtgccctaagcattggggctaccaagatgacaatgataacatcaaggagctcacagtataatggggggagagacagatacatacacaggtaaaataagtgctgtagaagagtgatcaacaaagagctatgaaaccagtaagattctaaaaactgactttgtgctgagcaagaggaggcttttcagaaaaggtcaaggttgaatcaggttttgttttcgttattattattattatttttgagaaggagtctcactctgtcgcccaggctgcaatgcagtggcacgatctcggctcactgcaacctccacctcctgggttccagtgactctcctacctcagcctcccaagtagctgggattacaggcacccgccaccatacctggctaatgtgtgtgtgtgtgtgtgtgtgtgtgtgtgtgtgtgtgtgtctttagtagagacggggttttgccatgttggccaggctggtctcaaactcctgacctcagttgatccacctgcctctacctcccaaactgttgggattacagacatgaaccaccatgcctggctgcatcaggttttgagtcaaataaaatttttctttcaaagaagcagaggatggaagggtatgctgtgcagggccatttttgagctatgggtacacatatacagtgtgatagaagaaataagacctagtgtttgatagaatcagtagggtgactgcagtttacggaaatgtatatttcacatagctattagagaataattagaatctttctagcatacagaaaagagaaatatttgagatgatggatatcccaattatacttatttgatctttaaaagtatgaatgtattaaattattacatgtaaccaaaaacatgtacatctattgtgtatcaatacacaatgaaataaaaatttaaaaaaacaacaaaattgcaagacgttgaaagggcctaacctggctccctgagtaaaaattgtgtaagagggttctagggtatcctctgttcactatgtgtagatcataagttgaggaaagagattttaaccatgaagttaaagtcatatgctacaccaaagtaagctagatgttgatttgccaaatctgtagttaatttatctctgctgggctccatttaggatttgattttaagaagggagttgtttgccataatgttacaaggtcagccctgttctgggtttctattagctacagttagtgttttggagtatcagagaaacggtgcttccttatattcagctcatggcatcaggaggcacaaaatctgtgcttttacagcagcataaatttctctggtcaaggtcagttgtgttagcaaggcacatatcatcgtatcaattttacattttctaagtcattttgtagacattttgttgagtaaaagtattctcttacttctagtaaggtagtttcaggaaaacacttaagtattatatatgtaaaccaaacagacttttcccattgattaactgtattttccattttgattttagaaatgtttaccttaagcctggccacagctttgtggcgacttcttcaatgtactccctgcctcaatctgatgtggccatgcactcgaaattcttaactttctatttactcttttagagagagatgatttgtataatctttctcttctccacatcccactgttccctgtatgtccctccttttctcttgtgcctcattttgtgtgtgcatttgacaacaaatgcagggaggaaaacaaacaaactgagtataatcagcaagaaaaaacatcatcttatgaactggcaaccaaattcttcatgaagaatttggtttttgaagaacaactgtttttgttcaagataatactttgaaaaaagatttgtcatagaagtttaaaaacttgaatagacagctctcattgtctgtaaggctaggtttctgcggcttttaatgtgtaagagacttgtcccatttaacaataaatattttagtgccacttaaaagtataattaatatatctttcttaaaagtggtattccctccctctacgtatatttctctttcctcagccccaaaagcacatattcagggagggaaggtaagggatttacatcctttttccatcactacgtcaaaacttatacaatttatacaatttaatattattaaggtagttaatgtagcagttcatgtgaagttactcagtagaaatactttaaatcatataaaaatatagctgaatataaattgaagggtcagagattaagggtgaagcaagttttaaaaatcagaagcatttccaaattcaagttatttggggtagctgtagagaaataattgaatgacccttagcaatattttaggaaaacttttacctaatgaaaaattctactccaaagctgtgttttacttcataaaattaatagaaagtggggaatatctctacacttccaatatcatgctttcctttagtcctagtaaaaagggacccagaatctttgttttaccctcccaaattacccactttaatacgaatacatgaaaatagattttaaaaaagaagtgaataaaatagatgaatttgtcctttttttttttaactatggtccttagacaatagctttcaactctccatagaactggaacaacttgcacgatgttgactacagtaagataacaaaattgtatattgtatgaggcaaatacgtgtggttgtcttatctaaccacaatgataagtacggtagtgtcatccagggtttcatcttctgcagttcagttacctatggtcaaccacggtcgcaaagtaggttgagatcattacaatgagatattttgaaagaaagaacactttcacataccttttactgcagtatattgctgtaattattctttttcattattagcattgttagtctcttattctgcctaactgataagctttattgtatgtaagtataggaaaaaacatagtgtatatagggtttggtgctattaccagggtcaggcatccactaggggtctggaaacacatcccctgtgggtaagggaagactactgtacataatttgattctttctttctttttcccaaatagtggtcatatttgatcagtcacctttgctcatgaagagcacattggcaaggacaacacaaagaagcttgttctgcaactcggttttcttatgttaaatatttagttttctgcttgcttcttcttatctgtttgtacttggtaaggctccctccttcttatgtgataggttggatgctgccggagaggttactagtgcatggaagctccaaaacagagtggaatggaaaattatagcctcaagggtatccttgggaaggagccagacaaaaggtgcatgcccacattgagacaaagctaaagcaaaactaccaggtgttagaaaacccagagcacatatacaagaacaaggcaaaaaattcctgttactctaacagtatgccttacttttctttaattttacttatttgtaaagtagacaaatgcccctgttgtgtcttgttgagttacaagtgcaacaagtagcattctagagtgggatgttactgtcagtgcctgttttgggtcactttaatatactgctgtttaattgattttatatctgaagatgcaggtctttaacatggacagattttcataagatcactggaatactggctttcttttgttttgcgatgagggcaaattttctgtggtttatttttccccatttctggtgaaaataatattctcttttcctcttctacagggaagatggcagtttcctcagttaaacttaggatctttgtcccttttaaataggccattgtataaaatacaaatgatcaaaattgtatcacagtaataattagctaatttttttgcagaagttttttggtggggtttttttttggtgtcaacacaactttaaaataacaaataataagagaaaactttttaacattgtaggaatatgtgaaattgaatagcaaactcaatttagatgagttcacatgaataacatacttcaggttggtaatattccagaaggttcaactgcctcatagaaaattaaatctctgaaaaattccccgactaaaaatcatttgaaaattctaattttttctaattatttggattttcttatgttagatttcatttcatggaaggatattgagtttgtgtatattcctgtgtgtgaacatgtgcttgtgtgtgctcttaatagcggttatttttcaaagcaatagtctttcaagcctttctctaatctctccagcatctaaaatgaggtgatataaaactcccaggtgggtactaaatattagatttgttgacaccagcatgggtgcttgagtggtagtgggaaaaagaaaaatgattgtctagagtttgtatgctacagaattgaggtggtttcagctgctttcatttcctttaaagaataatattgtttttttcaaatgaggaggattaagtaagcaccttaaaaaaagaggagcaatatattgacaacatctggtatgaagagttattataaaaggtaagaggatctgtgccagaaaaagaatggagagggagattctctctaataaataaatttcttttaaatgtgcctaaaacattaagggggtttttcccatttaaatttatctttgaaaactccctagagaaggagagtggtttctgtaacagctggttagaattgctgagcaaatgtctggaaaagatgattttgaaacaatgtgttttgtaatgtttaaacattttacatttttgttgaaacctgacttctgatgaagaaaatcgctctgtacagcaggcctgcgctgtgggctgcttttctgctttctctagagctgagtcactgaggactgctaccttagctcctcaaagctgttaaatttctcgaagggaagctgagtcattaggaaatgtaccagaataggagaaagtaggtcattttgctagacttggcaaaactttcatcagcttcagattcgcaagatctgcagttctcaaactccagggttaatcagaatctcctggagggcttattcaaacatgcgtgtctgggccctcctggcagagttcctgattcagtaggtctgagctgagccccgaggatctgtatttctgacaggttcctaggtgaaggtgatgccgctaaacctcggcccatactttgagaattgttacactagtgaaagcttggagagaaaaaaaaaattagacaagccttccccaaaggtttggcagtcagcttcatagttggatggaggaggacactaccatttattaatcactagatactgtcccagtcttgacattcaatcttccatccaattctgtaacatgagtcatggtatatctatgctgcataatcatctgtacagaactcacagaactcagttagtttgtttccttcctcttctctcctctcctctcctttttcttttttttctccattgccctggctgaggtacagtggcgtgatcttggttgactgcaacctccacctgtggggttcaagtgactctcctgcctcagcctcttgagtagctgggactacaggttcacaccatcacacctggctaatttttgtattttcattagggacgaggtttcgccatgttagccaggccggtctcaaactgctgacctcctcagcttcgcaaagtgctgggattacagatgtgagccaccgcgcccagtccagaactcagtttccataatcaacctgcccagagtttaaagccagagaagcaggtgcatctgaatttctgcctttgtctgtttagatctaaaggttcaactctttctatcaaaacatacttttgtacttgttctcaacgtgtctttatttcctcttctttttcattcatacatgttattcagaggatctcaaaattctttggagttttacaaaggaaaagttcaatttccaaaatttttttgcgacctgacatcccctactatcaggtaacactaatttatttaatattgactttgcttatgagtaatggcaatgcacaaagctgatgaaagccgaaattccatcagatggatttagcaaattaacaggagagagaaactacttagtttgtgagaaactactcgtttgtaaactatgcaaaaaggatagacattgtcttacctaatcacaaataagcctttcccaaaggaagtggttaccttttaaatgtgtgcacttatgtttgtttttaatccaaatttgtgccaaggaattatgtaattattatttctgtacaaaagttacttagccattcctaaattatcattcattgatgtctgagagtaaataattttagtaccactacgattaaattgtagcaggaaaaaaaactatgaaatagactcattctgagtcattgcttatagccatttaaagttgattagcaatgttagtttaggagatgtaaaaatgcaaaattttatttttaagttataatattttaatttgtaatttcaatgagctataaaggaatgtttatatttatggaaactctatgaaatataaagaaatgctctcacagatgtcattttagatatattaagtctgctaaattcaaataaaagttttggtactaacgtgtgagcacctggatggcgggggctgggtgttatatatttttacatcgaagatgaagtcctgcatagtgacttgcatgtgaataggagtcaggaagcattgaccaaatgataaagcattgctccagctgagttacaggcctattctttttagctcaaatcaacccattaaattatttgtgagataaaatttttctcaagtgtatttttccaataagaacttgaaaaagttgtacgttttattttatttgaaaatgtattaataactttacactattgactttctcctttcatatatttttaaatatgagaaggctattatctgtttatatgtgattatattgccatttggcctcaattgctcttactctcctcccccactgggccacatttctaggtcaaattattaagggaaaaaagatgcaggattttcaagatataacctctcacagagtatatatcttaaaagaggaaaatgtatcctgcacgctgaggattacctatggctaaatgagagttgaaaatagaagcatgtgttaaactggaagtcaatttgagagaatgtaatagaggacagtctgacaggtgttaatgttaccctcaaagggaataagctggaagctataaaaagtgtatgtagccaccactcattatgatacatgatattcttgctgacttgaagtaggaagatgaaaataactagtttgtttaaagctgcatattctgataatttaggatttaactttctgctttgaacaactttttcatgtggaaaaccttaactttttataggtataatttgttatttttaataatgcttataaaagtttttttaaaaagtaagctgtattgtagaaatcatcaaataccaactagaattatattttaatattttatagattttactcatagagtaaaaattacattgttagatatgtaaggggtggtaacaccttttaaaaatcttggttgtccttgtttgttctgtagtttatgaaaaacagagattctaaagattgcacctatgcatgaaatctgatttgctcttttgtgcagtataagagtatggctgatttctttcaattctgagaaccttacataggagaccccaacctctacataggttacaagtgaatagactctgatttccgttgattttatttcatgtaaaactataaccttcacaactacacatcaatctcaaacttctttgaatggctcactacttaaaagtcatttttccctaaatgatatgtatagatataagtgatctgaaaaatattttcaagattttattgtccttcttacctatatgcagaattgacatatatgcctatataaaagtggaaaatctgtatatgatgaaacaccatacgtagttaaaatacaagagccagattgagaaagaatatctgcagattgggaatagaataattaatggtcaaaggattggtatcttgaatatgaagaaaagtttctataaatccaaatagaaaaacaaatgaagaaaaggaaaaaaaatgcaaaggttttgaataataagtttacagaggaaaggaagggcaaacattgacaagatgctcatgctcactgtctaggaattggtaattaaaagaaaatgctttcttaagattggtaaaatggataaggagtgataagatagattcagtgttggctttctacactggtgtgggaaggcagttgctcttcatattaccaatggtggggatggaaattgctaaagcctttttggtaggatagtttatgaaacaacttttagaactaaaaacaatgtgtaacttttgatcaggcattcaaatgctaggtatctgttctagagaaatacataggcgtgtacactgcagaattgtaatagctaaaattaatccctaattgtcattgctgtggacacaaagttcatacgttgaagcattaaccctcaatgtgagtgtaaggagttaattaaagtaaaataactttgtgagggtggggccctgatatgatagggttagtgtcttataagaagagttataagagaacttgtgctctttctgtttctctctctttccccagctatgtgtgtacaagtacaaacaaggtccagtgagcacacgagatagccaggaggcttcctatacctgaaagtatttcttaagccattttcttcttcgtacagatgacacattacctccttgttggatgaatgcattgccttcttgttgagaaaaaaattaattcttataccaggagattccgactgcctgtaatgtgttcagttccctgaatcacagggaatatgcccagtccaccattcctttcaaactcatcctctgactgtagatgaaaggagataattagagtcgtagacattgggattgctctcttataaaatttactctatattttaatatagtcatatttgaagtgtgttacttttatcataatctgtatatatgctggttcaagaatagagtagtcatcacacagattaaggaatagactatcgccacgtatttctatatcctgaaactatatattgtttaggtatgtttgtttcttgaggaaaatgtataacagctatttttctgtaactttctttcttttttttttttttgctaagcattgtttatgttttaactacgttgataggagtagctgctgtcctctattgctataactatagaacagtggttttcaaatggctttgactagaagccaccataagaaatatgcttaaattgcaaatcagtgtgtatacacatgcagaattgaaacaattgaaattttagagttagcttgtctagattcatgaaaaaaactggagagtttaacatggcataattaataaggtcttaaatagtaaatacagttgtccccctttatctatagcttcattttctgtggtttcagttatctgtggccctaaaatatgaactgaaaaattccagaaatacacaattcatatgtttcaagttgcattccattctgaggagtgtggtaaaatctcgcaccatctcacctggagcgtgaatcatccttttgtccagccttttcactgtctgtaggctaccatccattccacctgctagccttctaagtcatcagttcagctgtggtagtacttcagtgcttgtgttcaagtaaccctcattttacttaataacgtccctgaagcataagtgtagtgttgttggcaatttgaatatgctaaagagtcattgtcaagtgccttaagtgaaaaggtgaaagttctcaacttaataaggaaaggaaaacatcgtatgctgaggttgctaagatctgtcacaagaaggaatcttctatcaatgagattgtgaagaaggaaaaagaaatttgtgctagttttgctgttgcatctgaaactgcaaaagttacaatcattcatctcacttcatctgatcacgtaggtattctatcatttcacatcctcacaaaaatgaagagtccagtgcaataagatattttgagaccacattcacataagttttattacagtgtattgttataattgttctattttattatttttattaatctcttattctgcctaaagtttataaagtttataagttaaactttatcataggtgagtatgtataggaataaacatagtatatataggattcagtactatctgcagttttaagcatctactggcggtcttggagcatatcccctgtggataaggagggaccactgtttactgtctgtcttttaagtttattcagttctgtttttagaagttagtaagtgtagggttttaatttgacaattattatcagcacattgaaaaatattactgcactgttttctggcttccagaattgctgtcagaatatcagctgtcagcctgggcaacattgtgagaccttgtctctacaaaaataaaaataaaaaaaaatagttagctgggtgtgtggtacatgcctgtagttccagctcctctggaggctgaggcagaaggatcacttgagcccaggagattgaggatacagtgagctatgattgtgccattgcacactccagcctggatgatagagtgagactctgtctatctatctatctatctatctgtctgtctgtgtatctatctattatttatatatgtatctatatatatattttaaacatatattaaaaataaagtctgtattcttaaactaaaagctggcatatgtgcttgctaacttcctggatctcttactttgaattttaccatctatagcttatttatagtcttcatttcataacatttttcaagtaaaattttatttgactttgttttgtttctcatttagagtttcttctgtctcattagaagataaagtttctagcttatcaataacaattttaaaaatcaatctttaaggtcctttttaaagctcttgttaagattctttaagttgttttctaatttctgtcatgattgtatcattctatttctttgatttagaggttgcttggctatataaattgactttatgaaaattcttgcaacacataattttagggaagaaaaatgtcacaaattagaagaagtggctattggaaaaagacatccactgagatttaagagtcaaatttggggtctattaatcttgacagaataattagagtgctgtcatttttcaagcagatagaaaaatgaatactctgtaggacatacaggacatacagaatctcctgagaattatgattatttctaattcacaaattactgtatgcatattatttaaaaatagaaactcttttggtaaatatgtttgtaattaagacttctaacagccattcagcattgctgtttcaatatatgactaggctgaatattaaccttcttgcaaccttttacgtgagtaagtttgaggcactgaattctaactaatatgagaagaatcttggtacttagggaatagtgaagtgctgacatctttgtaatctaacttctgaaccttttcatgaaatttaaatgttattacaatgttatcatcccaaaacgctaatttgcataatctttaaaagactgcattttcatacattaggccttcatgggcatctaataaatgacagttagtgacacgttacttagcatttatcagaaagaaaatgtttttcctcagaagaaaaaaatgctttttcaaaatgctgttcttcctttctaaatttgttagtgtattcttactcatgactagagcttatgtttaaattagcatttttttttgcagctggcctaggtaatcattgaaaattgggagttaaatgagttattattttatagaaggataagtaaattgtcatttagtatttctagaagcaatggtggtttctggtaatggagaaattgagaattagtgcatagcaaatgaaataaattggtatttttctaaaagctgaagcgttaacgtattagatatgtgcacatatctatgcatatgcccatacatgtctacaagtcttttggagctggcacatgttaatccaggtctcagatggtagtcaatcctgtcaaacaacttgcatagtttgccttggcaaaattccagtatttgatgctttcagatttgctacttgaagcttagtttgtattttgcctccattttgtttcatggaaaacagtatgtgatgtgagatttggtggcatgatattcctgttttgttacttttcttcttccgatatttctactaaataaacaaatgggaaatgagtacctcataattgaattcattcttccaaaagagaagaagtaattgaaaccactgggttgccttgatattttgcagaaagtaaacctttcttggacaactgagattgtctatttattgtgattgggactcataggcttttgagaggtaaacctgggtgaactttcttaatcagtcaaaaaaaatatgtatatatatatagatatatgtatatatatatgtgtgtgattgatggggtgagagtgatgaaaacatgtaaaaggcagaggcagttactgcatttagtgctcatagctcagcaggaagttgctgatatgaactcgttgtattcatattcgcttcgtgttagtgggcagtgctggcagggttctcaaagcccctgactcctactggatggcatcactctttttctaccttagctgagcaggcactgaccaaatgctgaaacatgtgactgcctatgagtttgcatagtttgtgagctagggcagggactgtgcttaatgtatcttttatgtttttgcataatgtcttacagtgctccacacatggtatacgcctgtttttgtattggtagcttgatcattatgactgtctggcaaattacactgaatgctgtacaaggaatcatattgtttccatctggtagagtaagacaaagactgtagaagtacagtcttttgtagaaggcttgcatttggtttatagattgtacttatattttggcagaagttttcttaaagtggggagaatgcttctcaggtcaggaaaacttgaataatgtaagtattcccaaatagaatgtcgatgttcgaagccattataaaatgaagcatagtgattaccctggtttataccagaggtactccattatttcccatttattaaccttggtgaaacacacacttccctttctgcttttattcctcagtcaccaagaaaaattgctaaacaaaaatagaaaataattcaagtctgcctgcctgtgtgagtttgctatttgtaagccctggaagggtgtggtaagcagtaatcatctcctcctccccaccatcatgctaaccaaagtgactttcctcaaggcttctgatttaatagaatagcagaagaatattagaatgagtagagtactgttaaactaatcagcttgttgtcagagtgaatggtaaacattgcaccaaactaggttctgaatgtaaactttattttacagagttttattctaacattaactttaaaatgagattcagtgatagttattgttttgctgtgactatccaactgtatttgagttttccattaaatattttatacaggttaaatagattagaaatcttggacctatgtcattattaataaatgggcacattgcaataaaatatacgttatcaactggccaacagaatgatatcaacaagaagaataaaaacacatggatgtagcatttgacaatccttttttttttttctcggctcactgcaacctctgcctccaggcttcaagtgattctcctgcctcagcctcccgagtagctgggattacaggcacccaccaccatgcccggttaatttttatatttttagtagagacggggtttcaccatattggccaggctggtctcaaactgctgacctcaggtgacctgcctgcctcagcctcccaaagtgttgggattataggcatgagccgccacacccagctgacaatcttttttcaataggtggttttgattgatgaaaaagtttgggtatgaaatcactacaactcccacagagtgatataaggaaggtgttagaaagtaatgacagtagtgtgtaacaaatgactgccctttaacacattctgaatttcttttagtcttttaggtttcttgccacaagtttttttttttttcttggcaaactctgctttcttaatagtgttttaggcggttattttgcttttaaattccagtggagttcagtgctctttaattttcattattgccctgtgggaaatactgcgtatatatttatgtgtatgtatagaggcttgtatgtatatatgtatataggggagattctggttaaggactgttacaacttagggtaataaataaagttaatttcataataaagcatatgactgtgtatttcctcttggccaatagtttaaatgttcatattgtaaaaagagagctgtcctattttttcccaatgcaaatcagaataatgttataaacatgaagtaaaaaaattttgaattgatatttaaatactggaaaaaaaatctatacacagcaagcagctttaaccagtggatttctagggattagtatatttctcaagaggctgaggcgttgtgcctttggtctcagtcttaatgtgcttgagacatgcaataattctacagaaatgcaatgctccagagtgtcttgtttcttaattataaaagctgttctaattattccattttaagtgctaacttatttaagttttaaaggctgagtaactcagctaaaatttatttaattgagatggaatagggactgttgaatatttagttgtcactaataaaatatagtatataataaaggaaagcccactacaatctcatttgtcttgataataaaaagttaacatttttgaagttctttcaggtcctaagttattatatggtatttctcaattctttgtattcaaaatgtaatatggaaataatgaaatattaatgtcttaaagttcattggattgtttaattagttatcaaaatattcatgaatttgatagaaagtgtttctgttcattggcattatttttaatattctattttccttataactatttttttaatgattatcaccatgggcatcttatcattcatcaaattttatcaggtattactatattctagctccgatttgataaacatatgttccataggaactattaagttatagattgtagtaccatgtgcaatatccataataaagaaatacaaggagaattttagaattaaaatagaggacatctcactcaccttagggagtcaaggaagtcgtcttggtggatgtcccacttgggctgaattttgaataacagttttttagtgctggcttgatgaagcctgaatgtgtgaaagtgaagacagaatgatgggctgggttgtgttgtttgaggccaagagttcagcaaactgcaataatcatttggtcttcattcagttctccactttcattatacagaataagtcagacgtaagaaagctggcaatggaagtcagtactggaacttcttatatacacaagctcagcaaactaaagaatatgctgacaaccataacaaataactaaatgagtgatgaacgaactttagaaacaaagaaaaagaaacagaggatatgttcaatcattttttccccacagatattaactgagcactttgtatgcatttagcatgttgctagaagctgaggagtcatcagtgaatgcaataaatatgatccttgcccatataggcctcattctagcaggtgaagcacattttaataaataatacacattttaataagtaattgcacaaataagtgtataattacaagttgtggtaaatgctaggtagaaaaagtaaaggagttagagaggatagaggagttttatataaatagagttagggatcaagctaacatgtctgtgggaggaatgttatgctgagacataaaagaagagataaaaatagcaatggaagagcaaggagtagggcatttttggtagagagaggagcatttgcgaagatcctgagaaagaacagagcttggagagttcaaaacactgaaagaaacatcatgagaatgaaataaagcagatgagggaacaagtgatgtaagatgaagcttggaggggtaggtggaaaggaactcaggagagtcaagaaacagaagagtaaattggaataaagatgtgaggagccaactctttcaaggtctatatggaagtagtgctgttcagtaagaactcaggatttttccttcttggatgcagcaaggaagatggataggtgaggtagaagtgatgagggcattccatgctaaaagtataggttagaataaagacaaggattttcctgagaaaaatgaaggaatctagtttggaataagagggggtaagagaagcaaggcagtatggataatctgttgaaaggtaatgataacgaagcagaaagtatgaatcttttcaaagataatgataatgaagcagaaagtggtgaaatgttctagaggactcagtaatggggcatcgttttcacccaagggtgaattgatgaatattccatactgaacacaccatgctgagcacatagcagatactcaatagctttcagaatcgttgacctcctcgggacatgaggcaaaatgtctcctgaacagaggatagcccatagttctagtcaaaaagaacaaatattagcaaaatatgaatattagtctcatcataaaggtatgtacacttctgaagcagctgtgttgtctgggatatacaccctggggttcatcactgcgcgccaggaaaatttaggtcctggacacacacaaggagtttaggaacgaaggtttttaataggaagaaaagaagagaaagaaaaaatagctctttctgtagagaaaggggtctccaagcaaaaaggaccagtgggcggtggatgcgctgaattttatagtcaggtttgaggaggcagtgtctgatttacatagggctcacagattggttggattaggcatgacatttacatagcgtgcaaggaaggctggtgtcaatatattgaccctgcctgggcaatgtagtgagaacctgtctcaaaaaatgagaactactaggctcaagcagttatcctgtctcagcctcccaagtatttgggattacagccacatgccacagtgcacgactctaaaaaatgtattttacatgatcacatgtaacctgaaaatacgcatatctgccgggcgtggtggctcatgcctgttatcccagcactttgggaggccaagctgggtggatcgtgaggtcaagagattgagaccatcctggccaacatggtgaaacccgtctctactaaaaatacaaaaattagctgggtgtggtagcgtgtacctgtagtctcagctactcgagaggctgaggcaggagaatcacttgaacccaggaggcagaggttgcagtgaaccgagattttgccactgcactccagcctggtgacagagcaagactccctctaaaagaaaaaaaaatatatatatatatatatataaggaatttaaaaatatataatacattattactaactgtggtcaccatgcagtgcagtagatcattaaaacttactcctccagtctaatgaaactttgtaacctttgatcaacatttccctttcccccattctttctccccattgctccatattctggtacccacctttgtactctctgcttctgtgagattggcttctttagattcctcatgtgagtgagatcatgtggtatttgcctttctgtgcctggctcatttcactgagcaaagtactctagttccatctatgttgtcccaaaggatggaatttttctctttttaaaggctatatagtatttcagtgtaaacataccacattttctttattcattcatttgttgatgaatagttagattgctttcatatcttggctatttttgaataatgctgaaataaacatgggagtgcagatatctctttgacatgttgatttcatttcctttggaaatatatccagaagtgggattgctggatcatatgataatttttatatcttttaggaaactccatactgtttcccaaaatggttgtactgattgacattcccaccaacactctacacaaaggttgcctttcctccatatcttcaccaatatttatcacttgtcttttttgtaatagtcattctaacaggcaggaggtgatatctcattgtggttttaatttgtatttctttgatgattagagatgttgagcattattttcatatatattttggtcatttgtatttcttcttctgagaaatgcctgttcagatcctttgcccatttttaaaacagttttctttctgttgaattgtgggagttccctatatattttgaatattagccccttatcagatggacggtttgcaaatattttctcccaatctaggttgtatcttcactctgttaactgtttcctttgttgtgcagaggaaacaatttttagtttgatgcaatcctgtttttctgtttttgctttcattgcctgtgcttttggaatgctatccaataaatcatttcccagactggtgtcatggagcatttcccttgttttcttctacttatagtttcaagttttatgttagatttctttattcttttgagtaaatttttgaatatgttgtgagataaaagttcaatttcatttttctgcttgtgaatatcccattttcccaccaccatttattaaagagactgtacttatttccaattttggcacctgtgtgtcataatttactataaatacttagatttctttctgggttttctgtcctgttcattggttgacgtgtctgttttatgccatccagtaccatgctgttttgattataaaagagttttaggattttcttttttagatcagtgtgtaatgcctccaggttttttgtttgtttgtttgttttgctcaagattgctttggttgttatgggtcttttcttgttccatatttgacccccactccacttttaaatttaaaaaagaatctctcacttattatcagttattgctgaagccagtgaaattcatattattatctgttttgcatcactgtttgaatgctgcatatcaatcccctggtgaactttgagcatcttttttcaactttcttcagttaatatcattcagattcatgaaggcacatctttcttcagcagttcataaattagcagcatacattttaggggagagccttcatctaaaagtaactctttatcttaagaataaatcctgtttgtatctgtctctcaagctattggtgcctttataagttatcttatgtggaagagaatgtaggggaaggaaaatttgttttctcacccatttctaggttcatgactgaggcccctataggaaaagacagatgaatgagaaaaaatcatacaaatgtacttaatataaaagttttatgtgacataggacacttcataggaaaattaagatgcaaaaaaacagagagacctgtgtatttttatgctaagtttgattaagaagttgataattatagataaatatttttggacaaagggagtatgatctaatggaattgaactgggggacaggggtcaaacaaggccttcttgttcatattcttctctgtgtcttcagagataagaatgtttctttcctccaagcataggaagaacacttctggggagaaagtcagagagtgacatcctcgattttatagcctgcttcaggggacaagagccaagggaaggtgagaatggccttcctgcttctgaagttttctcaaatgtcaagatgacataattagagattctgaaccccattaagagctcatcccaagacaaaaggaatgagacaaacatatccttctacagatccttaatcgtctaaagggagggttagtcctgaacacttggtaatttggatttgtctttcaaacggtacttcaatggaatttatctgggttcacagttccaaactttaaattatggtataaatggatacaatagtgtatccataatattgtaaatggattcaatggattccataagtttaagtatatataaacagcatatttaaacttaaggaaactagttaattgctcattttatcaaatacgttaatactatcatattaaccttagttttcatcaagtggtaaaatatctttaaagttaaagtaccagagaggatcacctcaattgaaacatgttcattgcagcattatccacaatagccaggatacagagacaatctaggtatttatcggtaaagaaactgtggtgtgtatacacaatagaatattattcagcctttttaaaaaaggagattctgctctatgccacaacatggatggtcctggagtatattttgctaaatgaaacaagccagacacagaaaggaaaatactacatgaactcacttatatgtggaatctaaaaaaaaaaaaaaaaggaaaatgaaatatatagagaggataaaacagtggttgccagagttggggtaggggaggaaatagatttaggtcaaaggatgcaacatagggtacattaatgatagtgtattgtatttacgatttttgctaaatgaatagattatagctgttcttgccatgggaggggaaatggttaactatgtgagatgatgggtgtgttaatttgttctacaacagtaacagttttactgtatatataggtgtatatattatatatacatatataatatataaaaaatatagtaaaatacatatataatataacatgttatataccttcaatatatacaatttatttaaaaactcatttatgatttcagttagaatttttaaaaacattatgcttcagagtatttattgcttttaaccctcacaaaattatgcatcattctcatgtttccaatattcacctgggtttgtctaagtatttgaggaaaagtaaaagtttttaagaactttattattctcaaatttcagtgaaattagaatgtaaaatcttagatgtgaatacttttacatgatgtttattaaatatagtatgcttcaaggcaaaaaaatatgacattgaagaccaatatttaatagccaattttttcttttcttttttctttttcttgaagtgagcagaatatgcataatgataggtatgatgaaattttatttagtggtattcggaagtattcgactttaacaagtatgtgctgttctgttgtgaataaaaatttgggaaataaaaactagaaactttactctgcacatattaggagtataaaagtagattatgtttttagaaatggatgagaatagccatataccccaacatcaagatctatggtctacaaagctaaaagatgtaaaagaaatgtggaggttaatacaataagagcaccctcccccatttataaaggtcagacatgcctatggtgtacattgctatctgtaaagattggaaaacctcagatgttgcatcttaaaatatgtacattttctgacatttgggtagaacaatataatttcttataaatgaacttgattcctgacattcagttgaatgttaatttaattttggtgctagtatagcaaagtcttccacatgtcatcgtagttgagttatcctaggagttttgatgactgggaataaagagggcctcccttgaaggctgggcagtgatggagacgtaagataaattcatagcagtaacaaatctagaaagaaaagccctagagcataacccacagcaaatcctgaaactctcttcctttaaggaatttcctggtggccttagggaggatattaatggaactctttaggcttaaccttgttaagggactgttatgcagcccttgttgttttctactttaaagtcaagaattttaagcagattagaatgaagaatagtgcagtgcagcataaagttagtattatactgttaataacattcatctgaattattaatttctgccagcagttgcttttaatataatcaggattaactgtagaaatacggattgttttcccctttttgcttttttatctgaagaataatttattgtaattaagaatacattataaaaacaaaaaggaatcgcagctataaaaatgtgttatatcaatgactgattatattaacattctatagctgtctaatttcttaggctaaaaaaaaaatcaaaggaaattgtttcattcaaattgttgagctttttgccatctttagaaccagtcagctagaggagagtgtttgtgacgattaccaagaatggttaaaaccaaaaggtgttggtttgcttgctctctcttctggtgagacagccatttgaaatagcattcaggcagcgtggcctggacgctgaagcagagcttggcagatggtaccgcaggatggagaaactgctggcagatggcatggactatttgagcaacaaagagacttttggctaccaatgctaagagttggaaagaaagaagacgacaacttctccagtgctgccagcttgtatacagaaaacgttttggcagaatggagactggtaaaagatattcaattgttaactgcaaggaaagagaagagttgttgttattaagtttcctaagtgtgctccctctggtgtgattggaacgtagtttcatatggaagagccctttagagatcatctaaaccaactatgctgactgaatatttggacacattcagtctgtttttactactgaaaagatatctctttgaagcattatttataaaaagtttaatccatgtttgtttttgataagttaaaaaaaaatctttattgaagaccttatttcccaggcttcatatgtgcagattagcagtggttcttgtttagcattgggctaaaataatgtacagtgaagtcaggtttggctaatatgacacaaaaatgtagagttttccctgcaaatgctatacataattgaatcactgaattacttagggggttatagtcattaccacacatctccaatttgttttctggaatctctgaagccacttattacaaatagacatttagttcctaatgatttcattgggggctgctacaatttttcatttgtagctttttcacctattgctacctaatacctttctctctctctctctctctctctctctctctctctctctctctctctctctcgtacctcttatttgatattgtgtttccagaattaattaatttagatgactttcacgtagtaacttttatccacaagtaatactttaagcagaaatatataacttggtttttctaaaataattaatttaacatatcaagaatggtattaagaaaaatatttggggatttttaaatgaaatttaaagtggaaatgtattacttgaggtagaaaaaccaattctatacatattcttaatagttaaatctcctagctcactgaagtttaaatttttggtatctcaattattcagaaaactgctgagattttggatgtaattgaaaatgctactgaattgagatcaaaagggataagtaagttatattcagaatagtgtcactggagatgcctctgagccaccaaaattaccatcataatgattatttaacttttgagaagtactcttggcttttggactcttaccttacataattttctgtcagtctttatgatccagtttttctcagtctgtagaagactagtagcatctgactggaattagagggctgcaagagggaagcatgcagataaaacggcacagagacaggttcagataagaaggatcccataaaaattactcaattaccaaaatgaaatgatggcttcaaggcttcagtggggaaaaactcatttcagttgattcagttaagacatttaaaagaagacatttctcaaaaaaaaaaaaaaaaaaaaaaaaaaagaaatggctgaaagttttgtcacttaaagggcaaatattaattttttagaaaattcatttatttagaaactttcactccatgtttatattaggtaaagagggtctaaatcatgtatgactgtttttaccaatgaccaattttcataagtggaaaattatgtttcaaatctttgcttagaggaatatgcctttttagtctacgtatgatatccactcccagcgatacagctctttttccttgtcctcattttggcaatgaagctggtcttgctggaagtgcagtggaaacctctgggtcacacaagccaggcagccctcactgtgacttcgtcttatgcaagtcacatcactttacctccctggaccttcgttatctcacctggaaaataagggagtggcttttaatgtccttctttcattaatggctgaagcttttcctgtgattccagggcataatttattaaaaggaggaaaaattgatattgattagcatatatgaatagatgtttgattatcaagcacttgatacccgattccacatttaccactggactcctttgccttttagtactaggttcctcctctgtaaaacgtgagggttgatttaggtagatggaatatataaggtttatactacatcaaagactgaatgggttttagttaaattcatgattctctttcttttttgttctgtccccaagaacctctcactaggacactcacatctgttcttgtcaccagagcctcactttttccaggacatcccttttcccctctactgttgcagaactttcccctcagtttagtttaaaccaggttcttgtcacacgaccaggaaagattaggcttgagacacatagaggggtgaggaacagaacttattgggcaaatagtaaaacaaaaaaataacactcagcaaagtgagagagagtcctgctagcaggtttctcaccttacagattgaatcccagttcaccacccaggaactgaagaagccacaggctcctcccaactgcaaatggcgcaaacctccggaggctccaccccgtcctcccagtgtgcaggtgggcattgttcagagaaccagtcgggaaagggcgggctccatccgggaccagcagtctgttttttcagccttcaggctgttttaggcttgaagatggaatttcgctggggacccttggctgtctcctgtctctatcaatacctcttgcctcctctcccactgtgataaagtctttgcactgtgggatgagacacatgaggccttattcattgttgcatctccaccttccagtctgatgcttgttgaatgaattaatgcagatacctcttgtatacctgactcccagtgcctcatcctccactggagcgccatccttgcatcacctttcttactctggtgaggagtcgtactctcagcccctgtggtttgagacccccacaaccacttctggtatgaagacagacagacacccctcattctcattgtcagacactaggcattaggaatcggaatttcagctcttttcccatagaagcaatatttaaaattgtcacagctttggtattttaatataaatacagtgtgagttagaacttcggttgcctggctaaggaatctaaccattatttacaacacagtgttgtttctttggaaatttctattctgggttccaagtgactgacttgcaaataaactttggtaagacagtccatttgtagtttgcgaatggcctttaggccatatagatagaaaagcatattgggataagcatggatctcaatgtgcatgaaatttgcagtgcctcaaagacagatctttagtgtatgacaaaagacagagagtattcccaaataagtctttgacttttcccacagacaccgattttcatgttaagaaaaaccttttcagaacacatctacaagagcaaggtacagttgaattttatgaaaattgaatttgaacaagggctttatgattgcaaactttgtcaatccccatggtttataattccaaaaaaaagtttaagtgtatcactttcatttaagctgtcatctgtgttttgattttccatgggggtgttcctttcatcttgatagcgcttcactggggagattgtttgattgccaatagactgtttcctattctatctttatactttcccttttctgtgtcttaaagtcaccatcgtcatttgcctggagcacgacagcatactcctaagccgttcctgtacttctgtccttgccctgccccgtgccagatttgcatatggaagtcaaagggagctttacaatgggacccatttttttccatgataaaaccatccagtcacaataaattgacttagattaagatgtaaacttcttacctgggacttgaaaagccccaaatgatctggccctactatcttctctaattcagcatgaagcacaacctccttttgactcagcatgtcccagctaaactgacttttttttattgcttgaccacccaacatcctttcttgctagaactaatgcaatggctgtttcttctgtttgtttgactctcagaatctttcttagaattaaagtgtccacgcaaagtccccctattcaaagagtgcttctctgaccaaattatctaatatagtctaatattaaacatcactttcctctttctccaatataacaatgttttgttatcctcctggcattcgttactatctgaaccaattttatttatgggcttaaggtctatctcccacttttgaatgtaaactttgagacagaggacattgtctgattttcttaccaccctatacctggtgcttagaggagtgtctggcactttacagaaactcacatgtgtaagtgagtgctttgatagattactggcctctgtgcattagataccaataacactcttctgatgtgacaataaaaagtaccacaagacatcatccctggttgagaaatatgatatacagcaagaacaaaacaatcccatcaaagagtgggctaaggacatttgaatagacagttcttaaaagaagacatacagatggccaagaaacatatggaaaaatgctcaacatcactaattatcagggaaatgcaaatcaaaaccacgatatgatatcacaccacctcactcatgcaagaacggccataataaaaaaaaatagatgttggcatagatgtggtaaaaagagaacacttttacactgttggggaaaatgtgaactagtacaaccactatggaaaactgtggaaatttcttaaagaactaaaagtagatctaccatttgatccagaaatcccactcctgggcatctacccagaggaaaagaagtcattatacaaaaaagatacttgcacacacatttatagcagcacaatttgcaatcaggaaaatatggagccagtccaaatgacttccatatgcaaatgcccatcaatcaacaaatggataaagcaaatgtggcatatatataccatggaatactactcagctataaaaaggaatgaaataatggcattcacagccatctgaatggaattggagaccattattctaagtgaagtaactcaggagtggaaaaccaaacatcgtatgttctcactcagaagtgggagctaagctgtgaggacacaaaagcctaagaatgatacaatggacttcggggactcgggggaaagggtgggaggcaggtgagggataaaagactacaccttgggtacagtgtacactgctcaggtgatgggtatactaaaatctcagaaattaccaccaaagaacttatttatgtaaccaaacaccacctgttccccaaaaacctattgaaagaaaaagaaatagtgatatagaagaagagtaaatcacagtattagtattttagagtggaaagagtaaaaatgatgcaaggaatccattttcaccatttataagctacatggacctgtgctcttgttgcttaatctttgaaccttggttatgagttattgtaaggattacatgaagaccttgctttcaggacagatcctgcctgtggccagagctagcctcccaatccacctgcttcccattcatcctcattgtgtaccttcactgagggcttgtaccagagcattgtcatgtcctgtgtaacactgggttctttgagatgctcagtatttctagaattttgctatattgttttatttcactgtttttgattggtcattactcatatccagtggagaaagaatgaatctcaagatgtggcatggtagaatgctaacagacaaataggtccagggagctcaaaatccatttccaccatttattatcaataactctgggactttttgttctggttacttattctctgtgagcttttgttgtgagttattgtgagagttaaaagatataaatgaaacactaaaatagggattggtacatagttagtacttaatatatgtgagctgtcttctctcccgtttcttaaatttctcaagccatgtttacatacacaaacaagtatatttatccatacatatctgggtaatcattcaataatttattcattaaaaaaaggtattgacctcctacttattaggtgccagccctgttctggattctggagttggaacaacaacaaaaaaatacagtcaaaagcagtcattaacagtgatgattgtagattatgttctctgatgagttgtgtatgtgattaaaagatatatatgtgtatatatacatatatatgtgtatatatatgtttatgtatgtatatgtgtgtgtgtgtatatatatatttaaatcaccctattctatgaacagtaaattcaggggcgtaatcgtttgaaataatgtattataaaatattgtcataatctcagcactttgggaggctgaggcgggtgtatcacctgaggtcaggagtttgagaccagcctggccaacatggtgaaaccccgtctctactaaaaatacaaaaattagctgagcatggtggtgggcacctgtaatcccaactactcaggaggctgaagcaggagaatctcctgaaaccaggatgcagaggttgcaatgagccaagatcacaccactgcagtccagcctgggcaatgatagtgaatgagactctgtcgcaaaaaataaataaataaaataaaataaaattgtccttatcaaaacagtgctttcctaccacttggtaaagcatttgttgattttttttttcaggaatacaaatgcaaaatattgaaagcctgaacttttgacctaattagcttttgagtttttagccctaacaaatctgagtgatttaggcataaaacaaaacaaaacaaagcagaaaacagcttttcagcttgataattctttctggtttgttatacctctcaacaccttcaattctcaaattagtgctcaaggtctgcgttggtggctacatatatttctgcattgttgtgtcttccagtctgagaatatctgggttggaatgaatttcctctcagggaaatgggtgaaaataactttttgcaaaacatgactgcatcatccccgagcaccattacaacatgcttaatgggctgtatatagtatttttattatcttataacttcagctcccttaacttgtttgaaggtctttaaaatgcacctttgagcattgttccatgtgctttgtgtcccttgaataaatattatacccctattgactttttaattttgaaatttgataacagtagtgaaagagaaatccctgaccattttatgtgttttgccacttcatttcatatagcttctttctctttccggcgatgtatttagcagacatttctctgttttgaatgggtgttatttggttgttaaaaaaataataataataactaaatcccatcgctgcctgttaatctttaactgttctttaactgttgatatgagccaaatgggaagtgtttgaaatattgaaactgactaacctacaccttctactgtaaaaagtatgggagaggaagcagtgtcttgggctggcaaggaatccttatggactagatctcagagattgatggagcagggtctgagggactgtgagtgttccctgagagaaacatcctaggtgccatcctgcttagggcattgaacattgtgaaagatatctgtatatctcacttctggggtggtgaagggtctatgtgaatgacttcatacaggtctctacaaagtaagtcatggccagtctgggctctataaatagatagggactgtgcttaactgtcagtgaatctgagatattttgatgcctgttatttgttattgaggatttattatgagccaaagatagtgtgctgtacttttaaatctttattttatttaaccttcaccacaattccactaggttaatattagtgccattatctttattttataaattaaggactgattcataaagcttatataatttacatatgttcccagtacccataagtagtggaactatagtagaaggatgttgtacataatatatgaggtttaaaaattatccacacccatgccttagttgtagaattttaaaactagaaaaattttagaaattatccagtcttcctccactatcaccagtatttcagatgaggaagaccgtgaaacccggagaatttgagtttccttttaaataccctgatcaagctctgctactgtaacaacttcatgggaggaactctacttttagtgaattacacatcaatatcactttttactgtcgttgtcataaatactttagatttagataggtcacgaatgtagtatatttaagttcaaaacttagagtttcttaatctgttgagctggggaggattgcatgaggcaggattgagtgggactagttaagttgagacgatctgtctggactctgcatttgtggtggagatcccatgcaatggcaattaggtagaaagagcatgcaactttggtgactgacaatttgtacttaaaagccaacaacagggaatcaggtgttatacttatccgtccaactacctctgaaatacatgaagttacatgtatttaaaaggtaaaatgagatattccctgtatctgacctgtgtctaatacaactttgtaggctgtttgaggttgatgtattttttccttttaaaggtttttgttgctatcaattatctactttatacagatcagatgtgatttgtgaaagcaaggaggtattatatgtatgatttttatggggctttgtagccctattagggatgggtctttttggtcttcttggttcatttcacagtttctcaaacttatgtgtggaatccacttgaagaacatgttaaaagattcacatttagaaattctggagtggggcccaggactgttctttcgctcctccttgcctagcagcccaggggattttgatacgagtgattcataatcaaactttgacaagcatagagttacaagtaggattgtgcttctgatctttctaagatgcctctgatgatctttcatgtaaaaaagaaatatttagcttattagaccactgacaatttctgggttttgccaaatctaaaattagagcctgaagattgtatttgtttatctttaccgagattatatttaggaatacctaggaacctaaggaaacaaaatatttcaatgacttctttgatgcagtatgaggttttccttttaatgtagacagtttatttttgttggctgtgattctttttatgcagtcttgttacattgggctgagacatggaggtaatgaatatttttcttatctaggatcaaagaatactgaaaacaggaaaaaaaaatgtgggtattcagtctcatctctacccttaactttttgatattcctgccttgctctcctcaagtgttttggaattgttttaaagatatgtgtctggtgtttttaatgttttgtttataattaaatgtcagaatatccttgttttcacaatggctgcaggtgagtgatatccagtcaattaccagttttctgttacctcagccactggtcagcatagtgttttctgatagggctgtacctactgtgagaacaggttgcagaggacactgattcctcctttctaccctcttccagacctgcctatgcatactagtgaaacaggtatttgttttctctggataacaccctcttcgccctccatttctctgtctctctctttcttgcccttttccaaggcccccaatataagcattttggatggggtggtagagaaagtccccttagattgagaagccagtaaacttaagtatgctgtcaggcttcaagccaaataaagtgctgagcatgacaattaattggataactaccagaatacctcttactgtaactataattcagaatatccctagctgaagttaaaaaaatgatgttaattaatttgaaagttgctaagagtccctatcaaatgcctgtgctctgtttgcatgctaggttttggcattgtgagcaagaggagacaccgatagtgaagctctatccttctgctagggatttaatactcttgacaagccaggaaataggtggtcatgtctctatctcaaagatggaggagaatgaaatgctcggggtaagcgtttcaagccagagctgtcctggttgattaaggtcatctgatcactttgctaagtaaaataggaagatgaggacacatgttgaagagtttgcaagaagagcaaataattaaatattttcttttaagctctgtgaaattaacttggaagttttgttgcatttcagttgaataaaaataatacacaaaaatgagctggttttttaaagtgaagaaagaggtgcacataatgtttcctttgtgtcttttgaatattttatttggaaactagttaaatttgcttaaatacccatttgtttttggtttcagggattttgatgtttgttttgagatcctcagcaacaaattatatttagagaaatgtgggattgcctattattaagacattttaaattgtttgaaaatatttttaaaacataataaaagatttatgctttttaattttgtatcatcaaatccaaactgcaactccttatgttttaatatataatcatacatacatatatcatatattgggacattaaagtttagggaaatgcagtttgcagtaatgactttagatgttcttcctggctctctttaattttaggcccaaagttattttcctagctgtattcacattaattgtttagtattttactgcatatttttgtgtttttacattacagagatatttgtagactgttcatgaattgtaattctctttttaaataacccccttttggggactttgtgtgaatttccctttgatttattatagactataaacaactcaacagactctattgtttgaataaaaaatactaatcatgtcatatttctgcatcatatcctgatctatccttcaattttaactttagaagtagcttcctctttgttttcctgagctcaaggcagaattcagaacacttagaacaatgtatgagacagaataacattttcaatggggggaaaaaagttcaattctaatcccttctcacgttatgttttgtattttttaaacttgaagtgctagaaaagtaaataataatgatatgaatgatttttttccttagaaaatcaactgtcaattaactaatgaatattctttttaatcagtgttaattgacaaatttcctgcacttacaaactcactgcttgcataatagtttcattttgactcttcctgatttcccttttatgtgttggtagtcctgttgggtgtaattctgcattattttctaaattccctcatctggagctagatggagctatgagatcttttgtaaatgtatacaaggccagtggctcttcttcatctacttgtggcattaagtagattaaaacccaattttaaagctttcttgtccctttattcttaaagacagcatggaagagaaagtctggatatctaaaacacagtcattaaaatggacagtcacacagttctttaattatcatttactactgagcaactcaaaaaacaaaaacccaaactcccaaaatcaaaacaaagaaaaacacccggctacatatatacctattcttaacactattgactcaaaactacattaaatgtgttttcattaaaaatataattatttttgttttgttttccaaaagattataattctctcagaaatccacacaatacagaaaatgatgggaaaagcatatggcaattgttttaggacttatctgccaaattttatacatacacattttatagatagatacatggatagatagttatatatataacatacatgtaatatatatgtatgcatataattatataaaaatgtagaaaatatttcacaaggaaggattaaaagttttgcttaaaaggttttggataaaatgtcatcttcagtttccctgtatatagggacatttagatgatctcgtcactgtatcttatccatgcctacagagcattttgggaggaaaggtattcattttttgtgtttgtttagttttttgctcagctttttattgagctagctatgcggttttcttgacttgttattcagtgtgtttaagtcctaagagatgtgcccagactgctgtcatactgtttaatatctgttaggacagaagttgttaaaggtcatctacctactttgagaatctaattgtaataaattcttctgtgtgtttctctaattggattaactttagctctatgctgttcacatatttgggtaattatatgaataattttcatttacctaatttggcagatactacataaaccaaatacttatttgaactctacaccatcttgctttttaagttacttgtaggctttactcttgagtcttttattgtgaattgtatccttttaaactttaatgtccctctatattctgtccttatttgcttctcaaatctagagaggagtaaacagtattttaaacaatttctaaagaagtaagaggtagggaggtggttcttgatttggctttaataagcacttcacttgaagaaagggcattttactaatctagctattaggtaagtaaaaagataaagataattataatgtaatgattataaaataactagtagataattaacagatacatagatagaggtgttacatgtgaaagacctgagcagtgaagctctgcataagaaggacagacactaaagcgtatatcctttacaggtagaatcttgttcaggatctgctttttcttgctttacacacaatttgactaggcttcattctcagtcttttaccctaaagaggacgtgaatgccattcagtcctcacaacagtaatatatggcgaaagctgtttttcctatcatagcaggcaaggcaactatagctgagtccaagccccaggtctgaaagtgggagatttagactcggttgtctgattctcaagccagtgatttccccagccattcattattcatttgtcccccagacacttcatcacccatccgcaggactttcctaagcacgtattttgtgccagacactcttttaagttgctaaccatttaatggtatgtgagactgatgaggtctgtgcatccatagaatacaaatgcttttgagggtaggcaaacagtacatgagtttgaaaaacaaaacaacatgaaattacaatgtggtaataaagaaacaggatgatgtgtgagtagctagaaacagccctgggtaggttgatcagggaatgtctgtctgcagaagttacacctgagtccacgtaatgattctagctgcaaataagaaaacaaaaatatagtaggcatctggcagtgagagaagaggcaggctaatagtaaacaagaagggcagataggaataaaacaaaactaatggccatgtgtggtggctcacacctgtaatcccagcactttgggaggctgaggggagcggatcacttgaggtcaggagttcgggaccagcctggttaatatggtgaaaccccatctctactaaaaatacaaaaataagctgggcatggtggcgggtacctgtaatcccagctacttgggaggctgaggcaggagaattgcttaaacctgggaggcagaggttgcagtgagcccagattgcaccatcgtactcccgcctgagcgatgatcaaaaaactctgtctcaaaacaacaaccaccaccacaacaaaacaaaacaaaacaaaaaacaaaactaagtgtgggagctctaggtttaggaacaatgaatggccccttttagcacacatgtctctcatgacagccctgtattacatcagggtacattaattgatgcttatgatgattaaaataatttatacaaaaagatgcgtgaattctgttttaaaaagtaagcactcctgaacaattttaggaaaagtactaaatttgaaataagttttggtgcttaaaatgggtaaagaaccagtagtaaaacattcacctcaaaagacaattacaatattggggatgacagagaagagagaagggaggcctaactgtaacatttatatttcttagtttttaaaagatatccagtacatatggatatacaaggtagggtaaaattttttgttatttttttttaaaaatcgaggtataattgaccaacaaaaggcacaggttttacatgaacagcttgatgggttttaacaaatgtagtcacatgtgtcaccaccactccaacagagacgtagctgtttttcattatttcactaagttgccatgtgcctctttccaattagttcttccccacccctgaggcaaacactgctctgatttctataatatcaccctagcttggttctacaagtgcatataaaaggaatcatagttgctattttgtgggacttgggttctgtcattcaataatttttgtgaaattcatccatattgttgcaggcatcagtggtttgctccttttttattgctgaatagtattccactgcatgaatatatctcagtttattcgttctcttctttagctattcctgtggtcaagagatgataccttgtgtttttaatttatatctcccttatcattcatgatttgatctttttatgctttttaaagtttaatcaaggttttcaacaattttactaaaatataacttacataccaagaagttttcccattttaagtatacaattcagtggtttctggtatatttacagagtggtacaaccatcaccctaatcttaggacattttaatcacctcagaaacaagccttttactcattggcagtcactctccattcccaatctatataattttaacagtcttataattttgtatattctttatcaaagtcctagtaaacagctctctcggctttatatctgtacaccttaagcatagtgatggtgtgttgccttctagttttcaattcctttgtggagcatcttgtgaaaatctttagagggagtcaattagaacagtactctcaaacttgaatgtgctttcaggtctccttgataaaatgcagattctgattaggtgggtctggggtgggtctgagattctgtatttccaaccaattccgacatcatgcccacactgccagcctggagaccactttgagcagtgtggtaagagactttggttggcctgccttgaaagagaaacggtgtcacaaagactgtatgttgtaactcttttatctgacaatttatgtgcacatgaagtttttgttctcagagcagttcttaatctgttttgagtttttacaagttcgttacttctctttgtaggtatgtaaaaaggaaatggactttgagagttttaaaggtaggattaagaaggcggccctaaaaatcttacagtatgtcattggtttgttgataactcactgaagagcctgctgaagaataaataagaaacatctgtacagggtgaatctttcgggttctcactggggacctgctgactctgagtaggctttcgtcaaagcctctttgcagggtcttgcctcagtttctggatccactccttcactggcttctccgaaagcctttttaggacctggatttgaagagggaattgtactcctgtttgcagaccatggcagtggagccagttgtaagctattggcctgagtttcggaaacagagtggtgtatccatccttgtaacagtcagggagtggattatcaatggaaacggaagtaaaaaggacatactgtattcagtactcacattgaaaacattaattttggatttaatctttgcctcataaaatgcaataatccaaaagctcatttccagaaccctctttccaaatataatagcttcaactgaatcaacgcttggtaaacgtgatgtatctctagtttaaatgcaaatattttcttaaagttggctagaaaggacatttttgtagagcaaatcaaatttttccactgttcatcatgtaattggagatatgcttctatagacaaaactgtcgttggattgagttgaaggattttgattttatgcaaaaaatttagaagtgacagacaccccatgctactctaagccttagcagatgcctaggcctaacaagtaagatgcgaagaagactgtacatcttgatttttttgtttttcattcttttaacatgttggaactctgcctctactcagggagttgctccatcacgttcatatagaaccctcttttgaggccaagtaaccccaggcactcctaatccagcttccttgttttccctcatgtccaatttttattgggttttaagttgtattaaaggtatattttaccagtaggggcctctgctttatattgtctgacgtcttgactgaaaagcccttaattaggaggtataagttatgtaaatcaaagcgctccactgtagcaatttcatataaccattttatttaaactgaagtacagtggacccttaacctgtgtttgaactgtgcaggtccacgtacacatgtattcttttcaaccaaatgtggattgaaaatacagtactctagatccctgaggaatcgccacacactctagatccctgaggaatcttcctcaatggcacatatgcaccatggaatactatgcagccataaaaaatgatgagttcatgtcctttgtagggacgtggatgaagctggaaaccatcattctcagcaaactgtcgcaaggacagaaaaccgaacaccgcatgttctcactcataggtgggaactgaacaatgagaacacttggacacaggaaggaaggggaacatcacacaccagggcctgttgtggggtgggggtagaggtgagggatagcattaggagatatacctaatgtaaatgatgagttaatgggtgcagcacaccaacatggcacatgtatacatatgtaacaaacctgcacgttgtgcacatataccctagaacttaaagtataataaaaaaattaaaaaaaagaaaatacagtactcagtgagatggaaactcacatagaaggagggctgacttttcccatatgtgagttatgtgtgcctgactgccagactagcgtatgtgcagtttttgataactataaggtcctggaaccaatgcctatactgagagaagactgtatatattaataattcttactgtccctctactcttactgtccctctaccaaagaatttcaccaaagatgccaggattcacaaaggctgaatataccatgactttctgaattgaaacaggaaaacactggtaattttttcaagtactggaggggcatcaaattaagatttatttagtgatggtaatttcagtaagtttgcagacaggagaactgtgtgtttctacttcagtctagccaaatactgtgtgtcagtttggcaataccagttaggagccctacattgttgttcatttcagagagaataattctggctacagcaatttaactatggtatgtatgttcttagaactgagtaactaacttcctcagactgaacctattaaattagtttcaatttcctgccaaaatttatagacaggttgtaaatgaaaaagctgcctctgcccttcattatcactatgtatcatagtttttaaaataaaaatgttatttacttgcatctactgtcagatattaaactacagaggcatccatcagcagttttgttggcactgtaaagaaaaaagtcatgtaacagcacacctggctttagtgttatagcatagagttagtgttgcaaggtgactttgatatgtcagaaaagctaattatgtgccatcaaaggactgaagaaattgccttttttaatgaaaagtattttataggaggtgacaatgatcttaagcaaagcagtaaaaccgggtgtataattatataaattctttaaattcttattagacttagctaattgacatgttactgttcaataacacagaaaaaaattgttaaacataaaaaccagagcaatgattttgaactgtagagataaagtctaatcttaaatggattcttttgccatttttccttccaaatacagtcacaatttttccttgacattatttatggtaatgcgtgtttttattttgtattaaaaaaagagtatagcaaattttaataagaatgaactgttagtaacatatatatgccccttcaaataaaaatgcaattttcttagctaatggtgataaagtgcccgagtctattttcagttttcttgatacgtatagatgtaagtgtgtttatgtgtgtcacacatatatataaatttaatttttatttctttgaggagccatattgagggggaatgtgaagtgggtcctgctgtttggtatatcaggattaagagcagaactttttattgttagctctgacagaatgtatgtgattattagtgatgtctttttttagaaaattgtaaattataggaatgctacacaggaagaaagaaatgaagcatacagtagttatgtaggtttacaagattgacaattttttttttccttcacagaaagttcagtacttaaagcagaaagctgtaattgttggttgctgtagatgcccttagctatttggaatgtggaaagatgtatgctataaatgttttactcctataattgtcatcccttcagaatggttcaattatagctattttgtaggaaaggtgcatgaagaaacaatttctggcagcattctgtaatgaccattcaagtttttaaaaaattgcaaatgtaaaataaacaaacccatttttgttactggacagggagcacagttcccaaagcctcctgtttcacatctcagatgacaggtcaagcaggggccgtgacaggcaacccacaaagtgtagttggttttggtgcttggggtaagaacgtctcaggacatgctcaaggctatttggatttatgaaactgaaatgtcttgatttaaagtgaatctttaaggtatcaactgagccaggtcatagagctctggactgtgaggaaggagttgggttcattaatcctcatgctaacccatgtgtgttgacactaatcaactaacctcacctctctgagcatcttacaatgacatggtcagctctaagactgcttagattatatggcaatgctacactcctggaggaaaccaatgtgaaaatggataatctgtaaattttcttgggaaccaaatgcctgtatgggttgtgggggtatagtgcaagattctgaaataactcctgattgttcttaggtatatgccctttgtaaagctattaaaggttgttaattaccagccttaaaagattggggaattgaatgtttggttggaggcggtttggcctgtattcttacttttggctagccaaattgtgtacttacatctgacagcttaattctgaaattaggtttgcaaagcccggatatcagtgggcttattctttttgccagtgctggattgagtatccaacagaagtcaagtgccagagaccagtcagattgaaatagactctaactgatgattagtagagtttcagtgggaaagtcagagttctattcattttgattgttttattaagtgtgaaatagctaagcatccttttttattgatcagacataatgtaactgttctaaaggattgtttctttgatatacctggattgtgcttcctaaagggaaaaagactggatccatgattttattttccagactaccaactcctgatacatgaaaattgctctataaaataatctctttctcttagttgtttgtgatttaatatagtttagcatgttggaattaccaattgttccctatctctgtctttgactaattgccagaagtttcatttaatagtatatgatacctactattatgtgttatataggtatatcatacatatatagagagagagcatgcatatatgtacatgcagtttgaaatgcagcagagtggtcgagcgcggtggctcatgcctgtaatcccagcactttgggaggccgaggtgggcggatcacgaggtcaggagatcgagaccatcctggccaacatgttgtaaccccatctctactaaaatacaaagaattagccaggcatggtgatgtgcacctgtagtctcacctacttggaaggctgaggcggggaatggcttgaacctgggaggcagtgattgcagtgagctgagatcatgccactgcactccagcctggtgacagagcgagactccatctcaaaaaaaaaaaaaaaaaaaaaaaaatacagcagagtatgcagaagccctgttatctccaagaagtatccagctgatgtggggctgcacacaaatgacttttgcatggacaggatatctggtctaactactctaaaaaattgcataaccctatagggagccagagctaactaatgcagtaattacctaggagtagagccaacatcctgcaattatattagaacaaacgtgctacagtgtttctgtttatatatgtctcttggcatcttgaattaatattttatcatatttcattaagaaaaaatcagagatcagagaagtcatggaaacaagatcactagaattacctgttgtgtagggttagaaaatttctatgaaacttctcccatcttgacaaaatcatttaacactactgaaaacaattgatgtttacctcatagttaagtagaggcaagcatttccttgaggtctgtgcgttagaaaaccatgagcgtattagatattatctttagctactcagttttttcttttgttttcaaagtatgccaatattgttaatatgtactttttatgtggttgaccagtctgtatgtgtgtgtatctatgtctatgtaaaatgccattttcaacagtttaattatattacttaaatccctttcggtggggggtgctgaatacagagtatatcaacaaagtcaagatctacacgttgataaatcttaattgaaagctctttcttcagcagattgctgtgtattttatacattatatgttgacaacgtaacatttaaatttttgcttaataagaaaacaatgagggagagttaagctttttttttttcttttttccttttagccctgaaggactcaccagtgttattttgattgtctgggaaaattagttgttttgagttatagatctcgttctgaaaaagaagaattgctgaacttggtagatggttgccaaggggcatgctgaagccaactgagaaagggcttctttgaaaggcaaatttctgatggattccaggccaggctaatgaaggaaactctgaagctctatgtgtcttggagtagtgggaaaggagtaacagatttttcagagaaagattttgcaacccagagtcaggagtgctgctgctgtgtgttgtgcatctgctatcaaggactgcctagtcgcctctttttctatctgagagctgcacaggagtgcttttgcactgtccctgaatcgtgagtgttctgggagaggcaaagctagttccaagaatcagcattaccttgtggctttcacttttagagggtctggagatagctgacacccttgactgaagcatcactaagacacatcctggcgtcaggcagcacagtcgccttcttacacatgtatgcttccttttttcctgtagcaagggatagaacaagatctcacctgaactggagcacaaagctataaactgacttttgctacctttggaatacaatcactggagttgattttaatttctaaactggatataacaagaaaagcaattttctaaattccccatatttaaaaatctgtaccatttctctgtttcccagaagtacaaatccattgagaaacctttgttgctgggcaatatttgaggcctattgcatgcagagttattatcatttagtgttaaattctttaaatattttttctagattacctcttttggaggataataatcagataatccttctataatcctcctaaaatttagcctaatattgggtaatctacaaatgccaatagactgctttaccactgaattgatttcttttatggcaagtgtctgactgcaaaagctttatttgtatattgcctcttttatttacctcccctccttcatccttcacaatgaattgcttaatgtattggtaatcagactccttgacaaaacatgcactttgaaagctgcaggctggttctatgggctacaaacaaagagtcctactattaggatcttttcaatgtctttaccttgatttagaaccttggtactcagagtatagcatgtggacagcagggcatcacctgcaagcttattagaaatacaaaatcttgcccttcctcctcatcactgatttagatggcttttcggagaggtcaggtgattatgaatctctaataaaggttttaaactactgcaatagaacctcagagggttaacctacaataccatcaaataccattcagaatgagcttggcagtcctggtggaatttggggattattctattcctactctgcattgctttacttggaaaaaggggactggatttttctatgaaaagaatgagcttcccgtgctcctgtaaagacaccttgtagtctatgtctagaaagcattccttaattttcttcaatctgtttggaatatcatataaataaaaatttgtatgttttctttgtaactctggaaatgctagagaaaataagttttcaaatggttgttgaatcaccatggttgtcataattacttacccaataaatagtggaaatcatcatcgacaccatccttttattttccttttcctcatcgttttctcctcatcactatcctaacagttagtctctgtcattgtgttaatattttatttttcaaagtactgttgagacctaaattgttgctgattgtttcatttttgatcagttatgtgttctgtattcagatgcattaactatattttctttttttattttatgtgtatgtatatatatattatatatatataatatatatatatataaaatatatatatatatatatatatttttttttttgagacagagtctcactctgtctctgaggctagagtgcagtggcccaatctcgctcgctgcaacctctgcctcccgggttcaagcaattctcctgcctcagcctcacaaatagctgggactacaggtgtccgccaccacgcccagctaatttttatttttagtagagacagggtttcaccatattggccaggctggtctcgaactcctaaccttgtgatccgcccaccttggcctcccaaagtgctgggattacacacatgagccaccgcacctggcctatatatattttttgagacggagttttgctctgtcacccaggctggagtgcagtggtgcaagctcggctcactgcaacctccacctctcggttcaagcaattctctgcctcagcctcccaagtcactgggattacaggtgcgtgccaccatgcccagctaattttttgtgtttttagtagagacggggttttactatcttggtcaggctgatcttgaactcctgacctggtgatccacccgccttggcctcccaaagtgttgggattacaggtgtgagccaccgcacctggccactctattttctttatgggaataaatacaagataatagctaaatatttcatctttttctaggattaaagtgaggcttcttcaccttagggagtagcagaaagatgatatctgagagcccacataaacctagaaaaccattgtaaatgatattgtcgccagtgagagaagagccaatggggtgaaaatattaatagattatgtctacaaatttgaaatgttaccattgaaataaatgaatcaggctcacttgactaagaaaaaaggaaaagctttataatttgaatgctttcaaatagaatagtgtgtttataatcaatagcatgttttctttttaaaatttcctatattttatttgaagtcatcatgaaatgtaaatggaatagaaaatttccttttggaaatagcagaatgttctctttttttcaacttttgagttctgaggtacgtgtacaggatgtgcaggtttgttacataggtaaatgtgtgccctgttggtttgctgcacagatcaacccatcacccagatattaggcccagcatccattggctattctctctgatgctctccctccccctggccccagcaacaggccccagtgtgtgttgttcccctctatgcatccatgtgttctcatcattcagctcccacttgtaagtgagaacatgtgatgtttggttttctgttcctgcatcaatttcttaggttgctagccacctagtttgctgaggataacggcttgtggtccatccatgtccctacagaggacattatctcattcctttttatggctgcatagtattccatggtatatatgtaccatattttctttatccagtctattgatgagcatttgagttgattccatgtctttgctattttgaatggtgctgcaataagcatacaaatgcatgtgtctttataacagaattatttataatcctttgggtatatacccagtaatgggattgctgggtcaaatgatatttctgcctctagctctttgaagaatcgccacactgtcttccacaatggttgaactaatttacactcccatcaatggcgtaaaaacattccttttgctctgcaaccttgccagcatctgttgtttcttgactttttaataatcaccattctgactggcatgagatggtatctcattgtggtttttatttgcatttctgtaatgatcagtgatgttgagcttttttcatctatttgttggcctcatgtatatcttcttttgaaaagtgtctattcatgtcctttgcccactttttaatggggttgtttttttcttgtaaatttgtttaagttcctcgtagactctggatatgagatctttgtcagatggataggttgcaaaaatgttttcccattctgtaggttgtctgttcattagcagagtgttctttataaaaataagacaaattgtatgtcattttttaagagagaactaatattaaataccatttattctaatcatggcacatgttttgcttcttcttcatgaaactcctgtgaggcagattgtgttatttatattttaaagataagaagatagactcattgataaatggaaactttattcaagatctgtgcttattatacttagatattgactgttaaaaaggacatatagattggaaacaatttgttgagcctgattagttattatacagaatatattttaatgtgtttaggtatctagttgggggcctatatgtccagtttcaaagttaaatggtgataaccctgaatatttgtgaactctagttttatatcctcagtagagcttcacatattttatagttgctcaagaaacatgtgtggaatacatgctgaatgagccacacactcctccaaccgcctgagaagggggaagagcttctcagcacaatggtcaccacaaggtgggccacttctcccacttttctttttctaagtggcatcagcatgtatttggtcacctgcagagaatagctgaattgcaaactcagtttcccatcgttattttctgttcacaattttggggcttaatgatctttcagactatttgaacatgttcaattttgtttacaaaacccacaaagcatttttcaagctgagtcaactatcaaagaagaaaagactcggtcatctagtggatcttctctgggtggattggttccatctaccgaatgggatatgaggaggcaaaccttaccctcccatttctccataaaccagagtcgaaaattaggttgtgtgtttccagtctatttttatgagttcccatcataagtcacaccatccatcatagcataagcatttgaccctcattatgagacatcaagaaagctgtcaccattgccctagcaccagtgtctccagtaaatattggaaatgttaggagatctcatttagtaaattcctgagtgttgcctgccagcgcattgggtcttagtgttttatgaattattctttagtctatgtacttttatcacacttgacagttatcataaatggtctttaggctgaatactagtttttaacaaaggaaaatactcaacattattaagaaggacctgcctggatctgctatagggatgcagaatatagaaattaaaaatatttgagatcgatgtctgtgcaacatatgaaatcatgtaaacagatacaatcaataatttctcttcagttctaacagagccccataaaaacgatttggttcagtttgggctacctgggatggctaaaaaataaaaatgttttctgtagacttagaaccaatctggagatgaggacacttaaaagttcttgtcttctgagggattgtcagacaggtggtgtgtttaacatcagggtgtcatacaaaggcattttcttagatgggctttagcctaatgaccatgactgcctaacagtcactactggtatctggcaggcaattgaggtatttttcaaaggcccacagggtatgtatcattatactgagtgttttatgcagaaaaccctttgaggcatttttttaaatcagttttttttaatcagcttttagttccatctgttcaagaataggtaaactgaatctctttggttcctttgttttttatttagggaagttatctgttcaattgagatgaatggtaatgggattatattactgtaattcatttattaaaggagtattagaatccatagtagtatgtttccatctcagaacccacaaattaccaattaaacacaatcttccaaaacaatgtgattattttcatttaagcctattttggaagctgagtcacttgccacctgcatatatctttgtttaaaaagcattagtggaatattactgaagccgaagccattacttggttgtgatttacacagggaaatggtgatagctgttcatccagactgcagcccagtcactttcgagatagcctgtctgcatgttggctagttgtagcaagttttaaaagcaaaacactcaaattataccacgttgaaaacatgaagaggtgtttttattttttaaaaagaacgaagagatggcaaactaacctataaattaaaagaagcccaaactgctgtagatgaggatgctgctttctttgatttaacagtattaacagagcactattctatatgcagcgccatttcataccctttgggtattttagcaatttgaaatcacatcccttccctcaagcagaatgcaaggtaactggagacataaaatgagcacacatgtaaaaccaaatagcgatacaaggcaaccctaccagaggcatacgaccagacagtgcatggtgcaatgccagaagttgacactgtcattgggtgctgtggatttatggcaaagggctcactatggatttgagaagccagaaaagtccttagagaggaggtgaaatttgagctgattcttgaggaatgtatgagaactgttaagaccccagcattccaactgggagggatcattggtgaagtgtcaagatgtccatggcaggggtgcaggagagaggtgagcagcaggagaataatgagggggctgagatcagaagagtggaagtagaatggcaggcaaggcacaagcaccagttttgcagggaggagagaagggtagaggtattgaaaaacctatgcttttctagaaatctatgtggaaatagctactaaacatttgtggatgtgtattgagatttatcaacaataaggctgaggataccaggcttgaagtgttcccaacagagaatattgggtggcaagtgacagtgatgcagagtaagatatgcagtagaccaagatctggcagagaagacaagagagcaaacagaggagaaagggagagagggagggaactgtgttgcacaagccaaaggaacagatgaggccttgaagttgacatcaaatgggacataaatgtgttagaaggtgtgaagagtgactcatccctataatcctggtactttgggaggccaagccaggcagatctcttgagctcaggaatttgagaccagtcttggcaacatggtgaaaccccatctgtacaaaaatacaataattagatggatgtggttgtgtgcttctgtagttccagctactcgggaggctcaggtgggaggatcatttgaacctgggaggtcaaggctgctagtaaccaagattgtgccactgtactccagcctgggcaacagaatgagaccctgtctcaaaaaaaaaaaaaaaaaaaatgtatggagggaccaagatgaggaggcctgagaaaagttcattttcatgacagtagaaatctcttgagaatccaataaaatggtaagaaaaacaaacaaaagataggataggagagactaactaggtattttatgaaacataaggctggtaaattgtatataagctaaagaattatagatgaaacttttgataatagactgtttatccctagataaccaaggccagatgaggaatattatgtgcagtgccagggtgagataagtagagagataagtagaggtgctattgctggactcccagagctcaatgccttatgcttctggtgttgttctctcattgtggggaaactgagtaagccgtgcgtctttttcattttgcctcccagttactctagattggttttctagatccattaactcttaagggtcattccagtccagctctgagcacatcaaatctattgcttctcatcctttacaccaataagcttgactccttctaaaggtcttctctgctcttcatgatctcgattcttcctgcattcctaagaatgaaagacacaaatagcttttatagagaatgccctgtgatagataaagcagttgtctctctactatatataaaagggatgctgatatttgccatcttcctcaatgagcaggaccagttacatttgcagggcccaatgcaaaatggaatgtggacccattattctcaatttattaagaatgaagccaacaacaacagaacaataaaccaaacaaagtagggggtcctctttgtgcattacccatgaagccagccctggctccagaactgttcaagtccagctagatggcagtgccattctgccattataagaagcagcatgatctaaaggaatattacagatgtttaaacaaaaaattgaatatgtgctgagtaaaattcatttatgatgttaaatgatttccaacagtcagcaggcatggctgtgtatacctctgatagtcattcacagtgtcaaactacttaggcttactttttacatccagttcaccactgaaccttcaactgattcaaggctggtgaagagaaaactgaagatgttaggactcttccagagtaacatacggaaagtttcttttccgtgaaataacaaactggttttctaatagctgtattctttccaactggaagcattctaatcagttacccagaattgctgattctaaatccatctgaattatataatgtgtttctccttctatagaaagaggtatacagtgtttttttctggaaagttaattttacttttggcatatgttctctgggactatcggttttattgcaactggatgcagaatttaccatgtctgctttgccttctccgccttctccgcatgccagcaggagcactcaccacactgcaatccatctggcccctggctggcagtctaggcacagtgtcaatgctgtggtggccctagtgtgtacaggaaggtatgctttggttcagaactgcatacatagtaggcattttataaatacttactgaatgaataaatagaagatgacaaggcatggaacagcataatggtcttgggaatgcttgtgttttcctaatatatccagaaggagaaaataattttcagcccctagtcaagaagtttcatttgcctccacattcaagggtgggagtatctcagttgatgaaatatatgcttctgaccaaaacatgtatacattgaatatatattaaatttattgggtaattatttaaaggaacagtatgttaatggattttccttgttttgggtaccatcattgatttccacctccccccaccacatccccttatagtctttgtctgaggatttcactataaatgaaattagctgaagaaaaccaggagaaaaccaggacacatgcacaacggtaagtgtcacaaagtgacaactgagctagatgtacacatggcctaaggcctgctagccacagggaggcagggatgtcccctcttgctcagcctcccatcctgtgttccctcactcatttttattaagtgatagcacgtttcactgcagctactacagcatctttgctgtctggagggtattgttttggatgcggatgttgtttaggatttaaaacaactgtgacattgatccttttcaacaggcaagagataatatctcttgccatcatccactgcctccatgaggatattctaggaatctgtatctaattacctgtgcagctaattaccacttccatgttaagcagcagcagtaatctctttttcctttcaagtccattttatggcatcaaactgtattatattctcttttcaatggctgctgacaaaattacaacagcaccacccaggacccgatatggaatctgcctgcccgtgattcaactgcacgctgtgtgttttctcttaagtccttttcttttttttttttttttaaccttgtgctattaaatacctatacatcggaatcatctccccatagctccatttgtttgattagcattacgatactgtgacaagacactatatcagtagtaatcgatctgattagcatggagatgatatgaacacagattgtattgatgtttaatagtgaaggcatccaggtgctgtaaacattatagatgtttttgtatgctgcgtgcaaggtctctgtattgaagacggcaaccgcagcagattttagagctcgatgatttattttatgccaagtgccacagtgggtcttgcatagtgtatggcattcctttgctttatcttgcacaaaatgttttaatcagtgttcaaaataatgcaaatattttcactggagagattctaatattgctttattaagagatgcttgcaatactgcagtaaaaagcttactgcagtctcattgaaaaccagccacattcttctctgaactcttgtctcttcccttactcttgtcaccattatacctggagagctaccatttgccagctaatattcagccccagatgttccccctggacaatttttctgaatttgcctatcctttggctctcagtagttaggagtattttcccctgggcagttctagagctttgtgctcctgttctggtacccctggctctgtgtttatgcatccatgcctctttactttgtaattaggatgccccgaaggtagtcattgaaaattaccatgtctttgtacatggcaaccagtggaatgcttagcattgattattcatttatttatttaacacatatgtattgagtgcttcatgacgcttatattctgctgagagggagagagacaatataacattataacacaggtaatgataagtagatagggggagccagaggggacaaggtgaaatggagaatactgtcttatttgtagagaagaggaagagcttacattgctatgaaggtgcaatcaaggtggggagagagcaatgagtgtgaaagccatagtctggagtgtgcttaggctcttccagcaggagcaaaggaacacctgtgcctggaggtgactgtggagagagttggaggtgaagcttgacaggtgcagtgggtggaggaagatcttattgtgggccacattgaggatgttgactttgacttggagtgaattgggcactcattagcttagaccagaggatttactttgaataatatgaaacagtctcaataactgatctattcagtatggtagccgctagtcatgtgtggctgttgaatacttgtgatgtggctaccttgaattgagatgtgctatatgtaaaacacacatggattttgaagatgtcgtatgaaaactaagaaaagtgaaatcatctgatatataattacagtaataggatcactagctgctgtactgagaaaagatataggggtggaagtgtcaaatggtttggatcagggtgatgtcagtggagatgaagagatgtggtcagattctgggtgtattgtgaaggcagcctcaaaaagattcattgatggattagatgtggggaaacaaaaggaagtctaagagtcttttctgtgcaactacaagaagggagtccttttcttgagatgagaaagactggttgaaagatctgggctggggaaagggagaatcagtaagttgttagtgtatgtgttaagttagagataacaattacaaatctagacaaaagatgatttgacagttataaaagactggagtttatagaaatggctcatatggagaaataaatgtgggtgtctcagcatggaagtggtttttgaatcataaaactggatgagaccacttagggagtgaatgtaggtctgtgacttagcccaggacattccagtatctatgtgtcagagaaaggttgggaaaatgcaagaactggcaagggaggagaaccagaggagggtggtgtctaagcacccaaatgaagaaagtatttcaagaagaagggaatgatcagctgtaagatgagtaagatgaggactctgaaaaatggtaatttgatttgacaagttggaggtcactgatcattcccaggagagctatttcattgaaatggggagtatgaaagtggaggcagtgagtggagccagtgcttttaaggtgttatgctttaaagtttaacaaagaaatgagaaagtgcttggaggagaatatagagtcagatgagggatttttatgagatgaccacaagtataactaaataaatggtttttttttgcatgatagattaataaataagcaaatgcatgtatttaaagattctaaagctgtgctgtccaaaagaaattgcatgttagccatatatgtaattttaaatattttagtagcctcattcaaatgtgaaaagatacagcacaaattaattttaatagcatagtttatttaactcagtatatccacaaacttgaatatataatggaaaagttatggaaataaggcatgttttgtctcatagtaagtcttgaaaacccatgtgtattttatgtatagcacatctcagtttggggtagccacatcacaagtgttcaacagccacatgtggctagtggctaccatactgaatagctcagttcttaagactgtgccttatgaatagaaaagagctgttgttgaaagtaaagcagaataacttttattatattattaattcaaagtatatattcataaaagtttatgcaaaatgaatgagaaattaattaaggctctgtaatttgttccatttatgtgattacataagtaaatctattttatatagaaaatatgactgtgtccctttcaaagacactaagaccttatcttaaactctattttagttaaaaaaaaaaaaagttaattgccatttcaactgtgtggtttgtagtaaaatttgaaatgggtttaatgtcatttataacatttgtaaagttttgggtgatttaaagggcattaagggtttttttgatgaattatacatgttggtattcagagattaatggtgtcctttgcaaagaatgtgtgtattctacttgaatctgttgaaattgtagtaatggaattgcatttttgcaaggctgtatgttatacagacattttctttaaacaaatagtttgaggtgaggaaaaaacagaaaaaggactataaaccagggctggaatatgttaaatctcattttttaaggaatattaacaaaacatgaaagatattatagtgacaggcatttttactttttttttttcatttcctgtcatgggcaagtcaaacatccatgccccagcttcctcattattaacaggagatatattaaatgctccttaaaatacaacacttctgtgattctctgaaatggagcttattatagtaaattgcaaatttctagtaagttataactgctgaatacaaacattttgcatctaataatgaaaatatgaaataaagaaataaacactgtaaaacccaacccccaaatgcttgaagatcactcctgggctgagttgttggtgtttcagggttggacatttaaaggggatttcatgaaaattaaatttcttgggtttgttttttcaaagttttaaaatatatgtttatagatgacatggataaaatgaactaaggtaatataaatagtgcctttcaaagagcaataaaagaatgcctttggtccataaaaggagagattatcaaaaagaataaacttgattagaagaaataaaagtagatttattttaaaagggaaaatggaatttattcctttaaaatacagaagcactaacttaaaaatgtttggactatagtaatagattttttgaaaagtagagaattaaggagaaagacctaccaaaaaaaaccccataattcaagtgtacatggagcaatgtgaagggaaggatgtgcaaatgtgcatttatgttgggaaaaatcaaggagcctgtttaaaaatagaacctacttagagacaaaaactagattaggaggcattaggttatgttagaaaagtagtttattttccttctacaagctgtatatggtttttgaatcatttttaaaaggctaatttgaaatgtgttttgcaattttaaaccaaaagctttttatgcaactttaagaaaaggatacttatcctatttttataaccatgaaatatctataactttgcattacctagccctttaaaactcagaatataatttagataatttacaaaactgatgttataacccagccaaagctagtgtttttcagttatcaggtatttaaccgatatatatctatgagatttcttaaatttatattaatttattctatgaacatttatactatcacatatttttgtaataacaagctaagaaaattattattgttgcattaaattgtttactgaacatttattgttttatgcaaataaatgttttcaaacttagtgagctcccccgccaaaaaaagaaccaatactaactgtattgtgctttatctttaggatatattatcctccttattcagattccatgtacatatgattccttatccctatttacactcacttttcctgagaactttttgactataggaactgaaagagtatgtgcatgaaagcaagcagttggaaaggacttaaaaatacttaaaagaaatagtttttagagttagatgggggtctacctgaaagcagtattgactcttattttttgtaaacaatatctgaaaaggtagacaggatataaacaaaggatagtactattgatttagctgtatagtaaatactccctttcaataaaatctgagcataaataattttctgtgacttttcttcaaccgtaagcactttggttttggaatgtacaggttctctactcagacttcccttaaaccaaagttttctgctgtgggacctctcacactgtattctctgtacttgttctgtgaaatgggattctgcaaatgctagctattattattcatcactctacttagaataattaacaaatgagataactagaggttaggttttataaaggaggatgaattagatgtcagcaaagtaaggggctttttgcattgaatcaataatgaaagtaaataaaggtaagaggaagttggtcttggcctccatgtcatgcttctgtttctgggtattatctagaggcgctgtgctgcatattgatgatgtgaagctcaagggctctggagttaagctacctgggcttgactggctgagctacctctgcccgtggtggcacctcggacatgtttatcccatccatctaaacttttattacatatatatgaaatggaggtaacgttttgaatctaccatactgtagagattgatttgagaggacaaattgaaaaggtgtatatgagtccctttattcagttcctggaacattgtaagagcttaataaatgttagcaattaaaatcatcatcagtattgctttttattatcagtacaagtactccttgtaagagagactaatgacaagactctacagtcttatcatttagaaagggagtggacaatatctatttagctaggtccagtacactaaataaaggctatctaatgctttaaccattgttaacttccttattctgagtctctaagaccaaggcagaatgtcattgtttggaggtcacagaataagaaagcctttgaacttttgtctaaaagtaaaaattgcctggtatgcatatgatcttgaacacataaaaatgattatattagtagtaaattgcatctgtacagcagagcggggttaaaaagattttagcaagtgaacaataataaaaggaaattaattgtgtgctattcttattgacttgtgtacaataataccatagatattcttattttaagtgtttttcccttatgttgttcatggaaatatttttaacaaattaatttataaggtcttcacaaaattatttataatttagctattaaatccctggtttctataagggcttagacatatcagaatattttgatttgtgagggactggtatacttgtgtctttattttataagcagtttctcatttagaccttagtaaaattgccctgaatcaatgttttagaggactaagagttggtaaaaagtcgcataaattgtgtgtagctcagtgtgtaggccgtaataaatatagaactattaaacctgtaggtactgtttttttttttttttttgagaatttaaggggattggaaaggtttactgaaaggagagaaagagcaacaatggactgtctcccaaaactctgattattttttttcttaaaccttttcatttggagataattgtagaattgcgtatggttataagtaacataggaagatcctgtgtactctttatccagttgcctctaattgtaacttataaaactgtgcaacagtgtcccaaccaggatattgacagtgatacagtcaagatacagaacagttttgtcaccacaaagattccttgttaaaattctcatgtttgatggttaagttacctcaaagggattaacttaatactgagattagttcaaagaaacaagccacaaagcaagcaagggaacattgatcattgctttctgcctcttaatcggaatgttgtggtagtcaatcaagcagcaactgtgagcagagaacaaaagactattaataaacctttaaagtaaaaaaaaaaaaaccctaaaatacctgataggccttggttgagtcaacaaacagaaggtttctgtagttaataaaggactaaatgaaaaacttcaatgaaaatcactgaccagtttggaataatgaaaagctctgaaggtggtagtaatgattggtgcacatgttataaatgtacttcacaccaatacactgtatactttaaaatggttgaaatggtaaattttatgtatattttaccataataaaaaaaaaacataaatgaacaaacaacaatgacaataaaaaccatggaccatttctttttttttatttttaatttttgtggttacataggtatatatatttatggggtacatgttatattttgatacatatgtacaaggtaaatggagtatccatcccttgtagcatttatttttttatgttacatacaatccaatagtagttattttaaaatgtataataaattattgttgattatagtcctcctgttgtgctatcaaatactagatctcattcattctatgtacttatatttttgtacctattaaccatccacacttcccccatccacctctagttttattccattgtggtcagggaagatatttaatacaatttcaattttttttgaattcttaaagacttgttttgtggcctaacatatgatctattcctgagaatgatccatgtgctgaggaaaagagtgtgtattgtgcagacattgggtgaaacgttctgtaaatatctattaggtacatttggtctgtagtgaagattaactccagtatttctttgttgatgttctctctggatgatctgtctcaagctgaaagtggggttttcaagtcagtagctattattgtaatgggggctctctctctctttgtatctaataatatttgctttatatttctgggtgctttgtgttggatgcatatatatttacaattgttatgttctcttgccgaattgacctctttatcattatataatgacctttgtctctttttatggtttttgtcttgaaatctatttcaagtctgatataagtatagctactcctgctcatttttgtcttccataggcatgaactatctttttccatccctttattttcagtttttgtgtgtctttacaggtgaagtctgcttcttgtaggcaacggaatattaggttttttttttttaatctatgtcttttgattggagaatttagcccatttacattcagtgttatcattgataaataaagacttaatcttgccattttgttatttgttttttagttgccttttggtcttctcttctcccttccctcccttccctcccttccctcccctccttccctcctctccttccctccctccctccctccctcccttccttccttccttccttcctgtcttccttcctgtcttccttccttgctgtcttcctttcagtgtaggtggttttctctgctgcgctgttttaatttcttgctttatattgttcgtgagtctgttgtatgttttctgatttgaggttgccatgaggcttgcaaataatctctaataacccattattttaaactgatgacagcttaccactgattgcgtaagcatacaagcaaggaaaaaaaactaaaaaaactctacactttaactttgtcccttcattattaatattttgttgtttctatttgtatcttactgttatgtcttgaaaagttgttgttattatttttaataggttcatcttttagtttttctacttaagatacaggtaggtcacacaacataattacagtaatataatattctgtgtttttcagtgtattaccagtgcattttataccttcagataattttttattactcatcaacatccttctctttcagcttgaagaactccctttagtgtttcttgtaggacagggtctgctgttgatgaaattcctcagtttttgtctagggaagtatttcttcttgattgaaggataattttgctggatatactatcctttgataaaagttttttttttttctttttcttcagcagttaaaacatgtcttgccactctctcccgacctatcaggtttccactgagaagtctactgccagacctattggacttcgtttgtgtattatttcctttcacttgatgcttttgggatcccctctttatccttgacctttgggagtttgattgttaaatgcctttaggtagtcttatttgggctaaatccgcctggtgtttcataaccttcttatgcttgaatattgttgtctttctttaggtttgggaaattctctgttggtttcactttgaataaattttctatccctatctctctctttacatcctctttaaggccaataactcttagatttgcccttttgagggtattttctagatcctgtaggtgtacttcattgttctttattcatttttcttttgtcttctgactgtgtattttcaaatagcctgtcttcaagctcactaattatttctctgcttgatcagttctgctcttaggagacaccgacacagtcttcagtatgtcagttgcatttttctactccacaatttctgcttaattcttttaaattatttcaatctctttgttaaatttatctgacaggtttttgaattccttctctgtgttatcttgaatttcattgagtttcctcaaaacagctattttgatatctgtctgaaaggtcataaatcttttaaaaggtctctccgggatttgtctttggtgccttacttgtttgttttgtgaggtcatattttcctggaccttctttatgctcgtggatgtttgtcattgtctgggcattgatggcttaggtatttattgtagtctttgcagtctgcttgtttgtacttgcccttcttcagaaggctttccaggtatttgaagggacttagatgttgtaatctaagtttttggtcactgcagccacatctgcattacctaaaagtaacactgtgacttttgcagacttttacaggtaccatcttggaggtcttggataagatctggaagagttctgtggattaccaggcagggactctttctcttcccttattttctcccaaacaattggagtctttctgtctctgctgagcttcctggagctggggggaggggtgacacaaggacccttgtggccatcattactgggattactgggactgcgctgggtcttgcccaagacctgtgataaccactgcctagctagtgcctatgtttgctcaaggccctgagactgcagtcatcaggtggcagccagccaggcttgtgtccttcccttcagggcagtgatttccccttggtcccaggtggatccagagaaccagtcaggagccagggcctggagtcagaaaccttagaaatctacctggggctctattctatggcagctgcactggtactgaagccacaagacaaagtcctttcctctcttccttctctttccaaaggtaaagtcgtctctccctgaggccaccactgcctgaggcctgtactacctggctactgctggtgttcattcaagacccaagggctcttcagtcagcttatggtaaatgctaccaggcctgggactctccctttagggcagagggctcccctctggtatggagccggtccagaaatgccatccaagtgccaaggcctggaatcagggaaccctagaatctacttggtgctctaccacactgtggcagagcttgtatctaaggtgcaagacaaagtcccctttgctattccctctccttgtctcaagcagaaggagtctcttgctgtagccatcacagctgggaatgtgctgggtcacacctgaagccagcatgtctctgagtctcactcaagggccacagtgagaacggcctgggtactgctgctgattattcagatcccaagggctctttagtcagcaggtgatgaatccttccaggactgggtttttcccttcaaggcaggtggtttcccttctggctcagggtgtgcctggaaatgttgtttagaagctatgccctggagtgggggtctcaggagtctgcctagtgccctattctactgtggttgagctggtatcccagttgcaagacaatgtcctctctactcttcccctcctctcctcaagcagtagggaggaacctcccggagctgcactgcctggggttggtggggtggtggtgcaagtactcccttgctgcctggctgcatggaccgtttcttgtccttcaacttcaattcagaagctgtattttagataataacttttctttcaaaattatcagttaatgttttacatagaaaaggctgttttcttttaaggagctgttggaaatttaaggtttgcttcaagtggttctggaaattaattggtctttgttctctactcacgattttaggggttaaagttgagactcgagattaaaatatgggttataagcatgagtgtgatcgcttctgaatagctagacgtttttaagttgtataaagaatgagtttcagccaggcgcggtggctcaggcctgttatcccagcactttgggaggccgaagcgggcggatcacgaggtcaggagatcgagaccatcctggctaacacggtgagaccccgtctctgctaaaaatacaaaacattagccgggcgtggtggcgggcgcctgcagtcccagctgctcgggaggctgaggcaggagaatggcgtgaacccgggaggcggagcttgcagtgagccgagatcgcgccactgcactccagcctgggcgacagagcaagactctgtctcaaaaaaaaaaaaaaaaaaaaaaaagaatgagtttctgtttgttcctagagttatctcctaagcatttctttaaaggaaatgtcctattttttttctttctcttttagaaactttaatgagttcatttcatcccttcctagtatatttggacaaaatgaagttatcttgccagcaatggctcctgaattctatgtcctcttcttcagtgcatctagttttatgggtacgactggtcagtgaattgctggtcactgcctaaatgtcctggaaatggtaggtggtgatgacacaaagaacatgccaagatatcctgtggctgtagcaagagtttcagagagaaaactcaaggagtgaactgtgtttgggttgttgaggtaattgagtgagaggaaaagatttacatttctatcatacaagccagagaagccattttcccatgtaggcctttatggtacttctagttttaagtgggtacttacattttaaaatgagaaaggttgccattctcttagcttaccttgtagggcagaaaacatactaggattatgagagatggaatagaattttgaatttcaaaccaattaggaacagcttgaataaaatagaactttcttatgactcagagtgaaagaccatgcaagggctaacatttgacatttcagcagcaagcttttagagacattgtgttatgtatttgaatttcttcttctctgtggggagtaaggccttaggacatgccatttaattacatgtttaatgtgttttgttttatattaccacaaattggctaaaaccattataatgtgctaaaacttatccatctcttcaaaatctaaccatgttgtttatattgataacttcttgatattatgaatcccacaagccaagaatacttacatgttgcaagagaaaccttcctaatttgttcacaaattttctgttttttaatttcctgaaaaatttcctcattctctttttatcgatctggaataaaatgaagaattaatatgattgagactatcttcatctcttcctctctaccttttcattaaaaggcaatcattgcagtgtccttttatatgtaaattttatttttgcctctaactatcatttagctttgtagaagctaaagctttaaaatggcaaatagaggaaatttacagagatgtattttcagtttctatagaaccttcttaaaattagatgaccaacctctactcaatgctgagattattcattatgctgtcaatgtataattatctgtcggtctactatttgtaatttctctgtgctgagatatcccgtttgctattgaatgctacttgaaagaaaattattgatctataccacacataagagttttgaaatcttcccatcagagtatattgcacctttagcataaaaaaggctctgatttattttactttatttttttgcaaatagctgctttatagttctttaagttcaattcaatattactctttgttaaactttaaaaaagtcttcattactttcctttgttaaaccatttctgcattcttcagataatccaggatggtttcagtaattaaaataatttagcttcatcactgttcaacataatcactgttaagcatgttaattcagatactgatccttaacatttttgactgttatgatggaggcctggccacagacgtaccttgtgcatgtttttaaaaaacctaacctgttaataatctactccaggttctaccagtaacccaggggatatttgttttcttttgtggcttcttccaaggaatcatatcaaattcctttggaaaacttgtattatttgcatccatcgtctacccttctattttataccccctaaatatttatatctactatgtacctacaaaaattaaaaatgaaaaaaattaaaatttaattttaaacatcttgtagttgagaagcaagtcgtccaatatcagattatacttatatatacattatagttatggcaatgcctttaatttcaatgcttttttttttagaaattctgaactatccatgaaagattttgttttttataattttccattaagagtgggatgttaaatatgttctctactttttattttaaaaaggacatcactacatgtcgtgatagtttatgtttcatgtgcatttatgttcttcacctttatgttattcagaatttatttttggtccacatatgtgatgttaaaatcttaagatttttaaagtttacaatatgtagaatgtaggtgtgttactgaatcactgttgtactgcatttgacagcttatgtatttctaataaaattaaagacttgggaaggaagcatagaggatcaagaagagactaggctttggaataagataaatttgggattgaatcctggcttattttctttttctgagctctgggaaaaatcacaaactctaaattgctggattgttctaagaattaacagagataacatggagagatccctaatatatagcagtacttaagtgtttcccctacctccttcaaggtcaactaagtgaaagaaaaggtaaatatcagaaagaggcatcttggagcagtgccccgggatgtgatgttatcagcaggagttaccaaactgtgtagcagaatggaccacttggtggtgtttgggacctggcatggtgggagaggagaggagaaccagagagcagggcttcagaccaccccttccctggtctccagtggtatagtgtgctgtctctcatttttctttaaatgtgttaaataaattgtggtttattctgataattctttgaaagaaaaatggctttatcatttaaagggaagatagtcaagtggccaaatataaatatactctggatcactaaatgtaaccggttttaaaactttgtgtaggatgtattaatacttaaaaaaatgatgagtttttccctcttgagtttttccctctggaatgaccttcaaaagagactcaaatctctgctgtaggtgagggactgaccaagtgggtgggcacagtggcaaaatattggtagacaaagtgaacagaggaagagtgggggttaaattagattttactaggcagctgccctctccttcctacttaatgtgctcaagaggaatgaagccaacataccacttaaaagggttagtcgggggaaaatgactcttgaggaccagtagcaaaccagttagaaaccagtggtttctaacacctgaaaacattcctagaaatgaaaagcagttaagtcagtggaaagagaaaggagagtaacacgtctaagactaagatgttcttggggttaatctaggaagttgaaaatccggatttggaaggcaaagggaacaggacaacaagggtagttgtagccattactttattttgggctagagtaatttttgctaaataatggcttattaaagggttcctgatggtagtttgtgattgatgtagtgccaactcttatttctcatctggactgggtagctggttaaataatttttctgtgacttaagtaattatttagaagtcatggtaactatttgtcaaaaagtaaaatgaacccagctctctctgtatgagattctggagtaggtgtctccttcagaatgcaacccatttagactcagacttttcttgctttgaaataccataataactctgtcatcacataaacagtgaaaattgtagttagaatgctaaagcccattttccccctttgttttctcttttcattggtgtgtgtgtgtgtatgtataaatgaatgaatatgggaagagagaattctcctcccgtgccagttatatatatgggcagtagaccttattattaactagagaacacatggtgtttggactgttattgttaatcatttcttttgctcagtgtggtatccaagctataattttgatgccttcccttatgttggtaatttagcaaccattgttctgtttgataaccacagcttgacagatatattagcagcctaactaatatttgtaaaaagagtgagttcaaaatttgtttttacatttagcctgacttccagccatggagaaaactttctttgtaatgtggtcaccaggttgtgtttttttcaggcttaattttatgttaaacattttacattggattatttcatctgcgtggttttgtacaccatttgaattgggatgcttatggtgatatcttggagaatgtatgctatttgcagataatgaagattgctgggaaattttagcatttttgtggagaattgggtgtattaaaaagtagaagcaaagatgctgatttttaagtggaaaacatgaaagcttttttttttcttttcagactgagtcttgctctgtcgcccaggctggagttcagtggcacgatctcggctcactgtaacctccacctcccgggttgtagcaattctcctgcctcagcctcccaagtagctgggattacaggtgcccaccaccacacccggctcttttttcatatttttagtaaagacggggtttcaccgtgttatccaggatggtcttgatcttctgaccttgttatccacccacctcggcctcccaaagtgctgggattaccatgaaagcttttatttagcaactgggaaagtacctgtggaggacaatgactagggctgtgacagatgatgtgaatccatagggccatgcttctaggtcttgtctttgaaagttgtaaattttagtacaccttcatttacatttctatttgaatgtaaattatattatgtgataaaattcctctggaggaaaattcccaatgcagctaatttctctggagccccctgctactaatgcagaataaattattcttttcagggaatttcactgtgtcactctgggtggtaatgcaaggcacattgggggctcagccaaagccttagtttcatggaattcggagtttgatcagtgtttggtcataaaattgtgtctctttatagatattataagactttcttgacatgttacttcatgggcttgtttctataaagagtggtttttttgtcttgttttgttttgtttttgacacagagtctcactctgtcacccaggctagagtacagtgttgcaatcttggctcactgcaacctccgcctcccagggtcaagcaattcccctgcctccaactcctgagtagctgggactacaggtgtgtggtagcacgcccagctgatttttgtattttttgtagagataagctttcattatgttggccaggctggtctcaaactcctggcctcaagtgacctgcctgcctcagcctcccaaagtgctggaattgcgggcatgagccaccgcacccagcctaaagagtgttttttaagttcccttctaactatttttaacacccattggattcactacaaattacattgttaccagcctctctatcataataatgaattttctaagccccttggtgctatcctataccaaatgggtgtaaactgatataatatcttctatctttgaacttgtaatataagagaataatgataatgaaggaaatagtaagataatccaaaaatatgaacacacgttaataattcttaataattgaatcataaaaattttcagctaaaaggaaatctaaatatacttaaatataattatcacatatcgaagatgaaattgaatcccatataaatgagttgtccaaattcatgcaaaaaggaagtggaagaaattgaacccaaataccacatttatttcttgaccattgtttttgtcatcaggcttagtgaaatgttagcaatatctttaaaactcttctaccaactgggaatatttttttaagtggtatctggagttgcacattgggggaaatcactactatacttttctttgtatgaaaacaagtgacttagcatttgcttaatgctctacaaaaaacaaaagtctatgagatacaaaagaatacacgagactgaaatggagcgtcgaaatggaaataatgttgtactggagcctagactctgttgggcttactgtcatccttgcataattttagaatcctctgtgaaccaagtgaattagtagtatctaaaaagaattgatgcccagtagtagatactaaagacccaaaaagattaaccagaataacgtttatgtaaaaagaagagatgtttactttttctgtagttctgttagattacttgaccaaggggtttccataaatatagtgaatttgacttgggtaaaatgtattaaaaataaataacaaatagctttcatgagaccttaaggcccatataaaggcataagtctcagtgataaaaacattgagtggtttcatactatcaatagtgtccttcagcagaattgctttttattgtttgtaactcagccaaaagggaagttattaccaggagtttagggatcttaagcatctgcaggagggttcagaggttatgcagtaaggaaccatgcagatcatcaaccttaaaaaaataaggccatcgtcatacacttttgtcaagatattaaatttgtacaaatatttgggaaagtaatttggctataaaattgaaaatgcacataatgttacagaaattacatggttaggtaggcatccattctgtggaaatgaaagacaaaatttaaaaacagatgcacacacacatacagatgtttattgcagcatcatttgttaatggttcaaaaaaaggcaacataaatgcccattcatatcatgcatataaattattggtaatatatgctacatatttactattcatccttgtcaaaaaatatttgtgcattaattttggaagatggccatcataaatatagataaatataaagttcaatgttaataagtacagattctgaagctggattacttggatttgtgtgaaagttttcctacttcttagctctgtgaacctaaaagtgttctacttgtcttgaatttggtgttctcacttgtaaaatgaagataatcatagtacctaccagtaagcttatataatcagttgttaatactgattaacagggttggcatggggtcattgatgagtggagcacagagtttcggaaggaagtctcacttagtttgtataaatggtaggaatatgggtgattgacttttgaaatcatcatttttgttgcacagtatttcagtgcatgaatctgccataattaatacaatatttcctttattgctatgcttagattttttcgaactatttttctcatggaagagaaaggaagtcattccaaatagaagattcagcataaataatgtgtagagtcagggatgatcatgagctctttcattgctggagatgatgtatgacaggattgtgtgtataagctgtttagatgattagatgatgagtaaagaagagtattggtggacctccaatattgagcttagaagatgttccgagtaaaatgtctttggaaggaagcagagaattgaaagatatgattggacaaaggaaatgtgtaatagtgatccaggatgaagagaaagcagttggcaaataagtaagaggttagaaagagaagcaagtttcctaggatttgaaaatttcataaaagaggtttagaattttgattctcttccttgtgtaatgaatgggtagctgggctaagaccttaaaaaaacctagaccttatatatttgttttaaagaacagactgttttttgtaggggaggagaattatctagagaagcaaagtttgggaagcagaaagttgaaaggtaagaaatttgtaataaccaaggtaaaagatatattttgattctgtactttcaagctaagggaaatggtggtataggtgaagcaaaagcaattaaatattggcaggtttcaaagaaaatctgaaaaaagaataaaaagtttggatgagccagaaatgaccctacaatgtttggcttctgagagacaaattaatgtcttgcctattcctgtaaataagattactgttttttttgtttgtttgttttttgttttgaggatggagtctccctctgtagcctaggctggagtgcagcggcgtgatctcggctcactgcaagctccgcctctcccgggttcacgccattctcctgcctcagcctcatgagtagctgggactacaggcgtgcaccactacgcctggctaattttttgtatttttcagtagagactgggtttcactttgttagccaggatggtctcgatctcctgaccctgtgatccacccaccttggcctcccaaagtgctgggattacaggcatgagacaccgcgcccggccaagattaatataatcttcttccccttacgctgagtatgccataaaatgggcacagaactaataatttgatattaaatgaaagtgactattttaatattattacattgctcataaattaccactttattttatgatgtttgtgttaacacccttttttcctcatgtgtctgtgaacttttctagcaccaagcacatacaaatgcccaataatccctgaataaatgaaggaaaaaattaacaagcaagtgcacaaacgagacagcatgtgagagacagctgtttccagttgtgctagagcagggagagcaagttgatgtgcaggtgattccagattaagaaggaagcttaaataattcaatacgataatgctgtgtgagtgcttagtgcttgggagcagccattatcatcatcaacgtacttggccttaagatcatcagtggtgttcacctgactaacaaattgtatagaaaacactagttgctggaaaccaggataccacttgtatttttagtttatatatcattttcagagacagaagctcatcaaacatcttcaataatatgaaaaattttctattgtaaatttccaaggagttctccatttcataaaggtagagcattaaccagaaattttcatccagacacagaaaccttcatttcagtctgcaacagtgttgttctatgatgtgcttaatggcgtttccatccttggtacttgtatcttagggcatatgtgactgtttgccagggtcaacagaaggtcacagttgagaacagggcatctgcccatagcaacaattcatttgcagatttaggtcaacaaaatagaacatttcatgtaacggtggctatgttaactggcttgaaagtggttattatttcccagtgtatgcatatatgaaaacaatgttgtatactttaaatatatacaacttttgtttgtcaaatatacttcataaagctggaaaaaatgaaactaaaaaaaacaaaaagtaatatgtgaaatatacttaaataatgtttcaattatgcaggtataaagtttaagaaatatttaaacaaacatgttattagctgtaatggaaaatttgcatgagtttgtaggttaaaatgtcaaagtgcaagtacagttttggatcataaaaggccattttagaagtgctccaagcttctgaatagtattcatttgggttattcatttaattttctgcctggaagggacatgtagggtattttgatatacatattttagaaacatatgataattaaagcaaatttcatagattaacatgcagcctaaactgcatgaaaatgcgtaagtgatgctaattcctgatatattttggggtaaaattactgaagacttttaatcacatgtttttatatctttggatcttccctacattgctttcaagaagtaactcaacagaataaagtacacagctgaccttaaatttgcatttgttatcatgtcatattaaatatttacagatcatttatatgtgtgtcttgattctcatagtgattttatgtgctccaagaagatatctcttttagcataaacatatactttactaacagtttcatcaaattttaaaagtgcgaagtatacagattttaaatgcatttcaagcagatttcttttaaagaaatatgctcattaagaacaattgagaattgatcttgtagcatgcccacagtgtgtttgcctgtcgatattgagtattggaaaggttatcagattgttaagcaacaaaggaaaataaattttgaaagtttcattgggaaatagctaaaaacataagactgtataaaaaaattaagaggtattagtaagaaatgtgtggattcttccttctcttaacattactgtagatcctgttttatttcagctgtttgttcccttatccttacatttatcaggattcttctgtgttcaactggctaatctgaatactaaccataacaaatagatgtttggaagcattaaagtgatgactttcaaaggggttattatcatttatcatgaaaatgaattcagcccactgatggtaatttagcctacagataaaatgaacgtcatatgtttataaaatgaattttcaaatgtttaactttctcaaaataatatttcctaaagatgcgatattgcatttaatatgttcacaggagacactttacctcactaatccccaaattctatgtttaaccattgtagaaaggtggtagtttatagactggttcccacaaatattcaatggacagaatttcacaagcttttatggaaatattctgttgtatccctcaaatgtatagattgtctgcattatagcttgatggtgattctgggctccagaatcagattctctgggtttgaatcctggccccaccaattaagtgctgtgtgatattgcttcagtttcctcaattgatgacagtgctgaccttatatgacttttgagacgattgtgagataatgcgtgcaaaagtgcttagaaccacagttctcatggttcccaaatgagctgtagtaccgctagcactacaggaaactcagagggacactgcacaatattttaaacttctgtgaaacactacatagacttctgtctcatggtagtttggtttcagtattagattatacttcattccttttgatgtcatatctttgcaaagctgagttttcatcagttgctatgacaaaaagcaataccttgtaaaaatcatcatggaaaaagaaatgaagctgtttgtgtctagtttaagaagttttgcagtgccccaatagacacatattggtaatttgtgattatttaagaattaactaaaaatatacattttgttcaatgtatgtgtattattttctcaaatggttactaagttgttaagacagaaataattaaattgcttagacctgtctacttaacggacagaactgttaggtgttttgtttggtctaaaggcaccgtgaaaacattaccaagacactgaaggcactactggaaagtttggaaatgtctgtgctggcttagcttttgcgtgtgtgccctcagtaagggtcagttgtttctgttgatggtagtgatgagacagctaagtaaaaagggctccctaacagaacctccaactggcctgcacgctgggaggagtgcacaatggggcggagccttgggaagttcacaccatttgcagaggggaggagccgggcctctcctgatccgggatggtacctgggattcagtctgtgagatgagggtctgttaacaagaacctctcttgctttgatgagttgttttttttccttttcacccaataaattccatttttctcacccttcaatgtgtctgcaagcctaatctttcctggtcatgtgacaaggaccccgtttttagctgaactaaagagaaagtcctacaacaataatagttaggaagtcaaagccattttcttaagcttaactcaaattcctctgatcatcattttaacccttttcttcttgtctaatgacagtgagggggaaagagagaaagaatggaaggagggaagaaaataagtaaatctgctgatggaaattgggatgtgtgactggaagggcagaaatgaaagcaatctccaatgaagggagtagaggagctgtttcctgtgaaaaacaggtgagtgatgtatcatgtaggaattgttcgaaaaccagtaagaaacctcctgtggaccccagccctcaatccagcctgaagagtaggaaacatgtcctggtggtgaagaggttaggagcagctgtacagagagagggaaagaaaagaaataaagggaggtttgagggcagacagtggggcagggaatgaatttccagcaggactgtggagtggcccacgcggtggtgcctggagcaggggaccacatgtgctcaggtagagaagcctccaagctccagatccccagctgcccagatgctcgtggccctgcccacagccaaggaggtctgtgaagggagtcattgggctgggttttaatcctcagaacgcgagccagatgcttaaccagagagattcccaccttcgcaccccactttcctcacctatttaggacttcctggtggatcggcggggaggaggacagagaaaattgttccgctgttaatctgcacccttactgtacctctaagaggatggtctggggaaacacttgtcacatctggaaaacatttccttaatggaaagagagaacattgttagctattcatgtgtgaacatacagctttttacctcccttctctgagccatttttttcctccatgttaaattatagcactttcttcttgtcaaagggcctgcgctatacttaataaactatctaattaataaaatttaattttaattttagaaaagtcccctccctagagaagccttctcccaaaatgaagctgtatttcattttaaatttatgattaattttcattattcctttggtaataattctaatgctgaaatttgttatgcatcgtttaaggagatttttgaattaaagatatttgaatagtcattattttgccatataaatttagttttatgtatatatactaaaatatataacattttcagagttatatgtgacaaaatacctctaaaatttagttgttaagtatattaaaactactttcaccatggaaaaaacctacaagtaaacataaagatattttagtgagcttaactttctcagaaatcacaagttctgagtcacatatctgaaacgatgctaacaatatttagggcttccacaaaactccatcttgagagatttttgtcaagtctttggctaattaatactcgaggcaccctgttcactaggtttttctgtggtttcattgtcactgatgcatattaatgacatcagacaaataaagtgtctttcgtaattgcttgtctcaaagcattgtaaaaatcaaatatggaataattaaaaattcatttacggtttgtggctgtgaatttgactgctggaaggttgagtcgaaggcccatgagtgtccttgataagtctgtacagttgattcccagtccagtagctgccccagtcatattatatagatggcttcagtcaagggagagtgggatgttttgaaatacagcgtgataactgtgcatgttagcacaaatagccattgaaaagaactgttagaataactgttgacaggaaagacggttggctgtttattttccaagataaaaaattagggtcaggtggtattatctatgtacttttcattattcatgcaaaaccaaacaccttcagcagtaagaatattttgtttgtgaaacagaaaacattatttcactgactgggccacttttgttaaaaatatctaatagatacatggttgttttgaactttataggtcaattttagatttaattacctattaaattcccaatcatgtatagcattttgtgttgtattaacaaaatagtagattctctgaaattgtttaatgttttaaaattgtcttggttaactcaagaatggataaagtaatataagaacagtccaatttatatggtagcatattgaattttaaattctatagagatttattaaaatttacattttttacatgagtgcaattacattttaagtgataaataatccagaagagtgtattttataaggaaaataaatgagaaaatattttcattgtctaaagatgtagtttttttttatgataaaaaagattcactgtagggaaactgtaattagaactaatttatccatttgttcatggagttcccttaatgagcaagaatgccacatactcttaattatctgtaaattttgaccatttacataaataatcctttttaaatatgagtaggacttatgatactaagccactcttgagcttttacaatatgaattaaatttcagattcttcatttgtctgacatgtgtttattgagtaccagtaaactttaaagtatttttctagatacagtggatgcatagaacaatgaatgaaatggataaaaatccctgttctcttggttttaacattttagtgaaggcagcccaccttaaaaacaaggaaatatgtaaatatgtagtgtaaatatatagcatgttgcatagggtcataagtgatataaagaaatatggagtagagagggaagttagagccagaggaggacaatttaaaataatcatcagggaagattctaagaagaccatagtcaaagcctgggagctaatgaggagttggtgggtgggtggatcagatagggccttgtaggctattctaagaaatttggctttcattctctagtagaagcagctatggaaggatctgtagctgaggaatgacaaggtcttgtggcactgggaggttgtgcagggtagaagctaggagccagtgaagaaacgttagatgtaattgagggaaaacagaatagtggcttctattttgggtattcaggatggattgatttatttcatgtgaggagtgagaggaccagaactaacaataggaccaatttttttatcctgggcaactagaggtatgagttgatttgctgagctggggaattctatgggagttgcaggtttggtgaatgctatcaggagtttcgtttgggacatcttgagaatgagtctaaaatttgaaatagagatctggactgagatgtaaatttgggagttccatttctttgtaatttaggaatagaatactaatgttttataatttttatttctaatttggatcagaagagttttaactgacagtgtagccaacgacaagtattttccttttattcagagcatttcatttgttgttcaaataaaaactaattgttttaggatctgaaaggctattggggttattgttataaattatttctggctactgattaatacaaagtattatttttctttaattgtaaactgacaatagtaatagtaaaagtgattgtatttttattttaatctgattaaatattagaatttgcagtttggaatagtgacaggttttttcttagattagttcacaaaagcttgcattattggttatagtaattaaagtttacaaaattaagaaaagctttagagtactttgtagcctgatatattcttattaagttttgatgggcattctgacatgaggagacagtttttatggaatgaagttaaaccaagaagagataaatgcttacttaaatttgcagaagaaaatgtaaaatatataccttcaaatttctcctttgaggacattcttaatgtaagatgaaagctgttggattttaaacattacaaacaggcaacttgttttttccacattataatgcttgatagtgttctttcctaagggagaaatttctttgctagacttgctttgaaacttcacattgaaaatgctttttttggccgggcgcagtggctcacgcctgtaatcccagcactttgggaggccgaggcgggcggatcacgaggtcaggagatcgagaccatcccggctaaaacggtgaaaccccgtctctactaaaaatacaaaaaattaaccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaagaaaatgctttttttacttgctttttgctgaggtgtaaaatttgcaaaggttatagaaaaataatagttttaagatactcgatgtgcagtttgttctttttgagggatttggtgatttttctgtttccagttgatgtggttatttgtcccagtctgagtaatgtttagccattgcccatgttctatctagtcccaagtacttgatagttcgtctgtgtttctggtgattttttttttttctggctctgtgatccttgtgaatcaccatccttggtcccattatacccagtcttcatttaaaactaacactcaatacatcttcaccccaccctgacttttttccacattttatgaaaaattttaaatatatagaaaagttgaaataagtatgcagtgaagacccatctacttaacacctagatttggcaaataacattgaactttatttgctttattaagtatctatttctctgtttctgtaaccatctttcaaggcgtcttatttttttatgcatttccaagtaattgcagacatccatacacttccctcctaagtactttagcatgcatatcattagcaagagtttcatattatttaaagatctttataaagtaaaatttacatatgatgaaatgcacaaatctcaagaacttttgatgagttttgacaatgtatgtatctgtgtcatgtaaactcctatcaagatatgaaacactgcaaccacttccgaaaatcaccttttcccagtcaatccctgaccctcaaacctcccaacagcaaccactgttttgattgttttctaccataaattggttttgccttgtgtagaacttcatgtaagtgaaattatatggtatgtattcatttgtataaggcttctttgttcagcatgtttttgagattcaccgtttagtatatttgtagttagctcctttctaatgctgggtgatattccattgtatggaatattccaaaagttatttatccttcctcctgataatggacatctgggatttttccagttttgatttattaatgaaatcaatatgaccttctccttttaaaatatgactcttctttcatctaataagtaatcctcttccccttcaaaacagtcttattatcacccattcttgtttaaggcaagccatacgttgtagcttatttctagaaacactgtgtatataagaggcttttctcggagacttgaaatgaaaggttttagaaacatttctgtgcatctccgagttctctttagctgtctgttccagacagtcactttttttttttctaaaagtcttccatttagacagacacatgaatttctcttgcagagtctgccctttacatcttatttattcctatagtcatgttaatttggagacaatagaaaaatttttcctctttcatgcataatggatggaaatgtgtgtaaagaacaattacggtgttccaggtaattctgtatctattgcccccttcagttgagagtatggcaaaacaaaaagtcttaaggttcaacaaagccttcaccttgaggctgtggcccatcagggtatgtttgctcttttggggttagtaaatgtatacactttcgagcattgagcttgatgttacctgtggcagtcactttttgtagagagaggctctgcatgtatttgctaaccacttggtatcagaagattccaatcggatttttgtatttcccctcagagttttcaagaagcaaaccaccaagggcattatgatgtgtccttttgtctaaacaccttttggagcgaaatctgagtacacaaccatggccttatgccctggagttttacagctctacgtttgaggctaggaaagaagatctcaattgagggtagtgtaatatattctctttgaaaaaattcccttcaaatacctttgtgctcacaccaaagaattattgtatttgattaaatgtaaggccaagcattcaatttttgcattttcttttctcttgcttgtgttttcagctaatattgcagagcattttatttactcaaccagattgacaagattataactgggagctgtgtgtggaagcctctaatttttcataagtaaatgaattaatttatcatcgctgttgtgttttattgctgtctctgtgcgagactgccctgctcctttcttcccccttttgccttctaaacattggatccatgtcatcgtgtttgacaggtttctgattcccctgtcagatgcaatttggtgctaatcacatttcctttgctcagtgtcaatgatacaagccatgcataatattcctatatgtccactcactcacttgcagtgcagctggaatatcttgggcattaatctgagagaatgctgcattgaaatgcaaaaatgatgcttgagcactaagataatgtggtcaggcagatgtgcaatagataagtgaggctaaagtggtgatcttttcctaagctttgatgaattttatttcatttctgaatatctctttacaaacctgagactatgtaatcagtgctggttcattagaccttccgcatttttaatagaattcattcattgtccatgtgtgaagaaataagaattatttttcccattaaaaagaaagttataggtggttatttttaatgttgaagagtatccctgtctagatcatacactctatcaaatgcatgaaagtagctaacaatctagagaaatctgttaataataagccagtttctaatctagatgaggtcacaaacaatagaccttatgttagatcattttagacaaatataatcaaagtatagtgggaggatttggattgatttggaatgagggtgattgtttattttttgaagtctagttaagatgttttgacaattagagtagggtggaagaagcactcaaaaaagaaaggaataaaagcaaaattagagacaggagagggtggtgtttatcagtgaaatagcagttatccattttggtggtaaataggactagaaaagcatttcaggagcatgtgagagaggtccttattttatagacaagagggaatctttttctgttattgttggagcaagcctgtgtcatgattatatttgaattttagaaagaaaagtttcatggtagtgtggaaaagaattagagaagaaacagaaagagatatcaaataggggactattgcaataagtcagataagaggtgagggcccaaagtaggagggtggcagtggaagtacaaaaggtgtgacagatgcaaaagttattacaaactaaaatctgcagagttgtacaactgttgggatgttgcaggctgggggtgtggcatggtaaggagggaagaaagaaccaaaatgcttagcaagtttctgcatggaacagggtactgtggattctgatgccttttaagtgagaagaccagcagaagtatgagtggggtgagatcatgaatttagtttgcattatgctgaatttgagcttcccatgggatatctaaatggcaaagaacactggttaggatgtggggagattcaacggccattttcgtttatgcaataaataatagaaatcatgggaatggttgctgttattttcagggagagaatataaagcaaaaagagaagcaaataagcagtgaaaccttggaagtaaggctaaaatgaagggaaaagttgtaccaaagtgaactgagaaaagactgaaataagcaattgtacagaaaagggaaggattgtggaagctggtggtagaaggtagtcaacactatcacatatggtagaggaagacttaggtagtactattgaatgaataaatgtaagaaatttttttttcttggtattatttatacagtgtttaacaagttccaggcaggttcaggggagtagtagaacgaaaagtcatattgcatttggttgaggagcaaatcagtgttgtcacattggaagctgctcattgttcacaactctttgaaagaaattggtggtaagggaagtaggaagaccattgggattgtagcttaaaggaaacgtgactacaaaaaaaatacagtttttttttttccttttaaaataggacataccttctcaaaggagttgagatatcacccccaaggggaaccaaggaagttgattctttgggaacaaaaatatcttaaatattacaatgtttgtgtctctccaaatctcctcctacctgacaaaaatcgtagtatttaattgatcttgtttggtttttatttgggtatcacacaggcagcattgactgagttcataaacgatataacataccttttatgatatgagatcagtgttccaaaactatggtgcatatacagcttagttgtaggactccatttattgctagatctcagagttgaaacctgagaagtggcctatgtctgtctgcctcttagctacctctgactgctttgtgtttatgtgtgactcagattttgaaagttagattagtttatattttattaattgtaaaaattattcaacccattattaattatatcaagtgctgagacgagaaagtattgacaatatctgaatgattatccagtagccagttaagtgaaaaattactttcttgtattcatatcaaccaaaggttaaaggtaaatttactgaaaataaatttaaaaaaataatttaattgttcagttgttttgcttttgctgggaaataattttgaaggactgaaaaatttgattatattgtcattattatgtatttttgtatatttatttgtatattaaatttgatacagcacaacttatgtaaaataaattgcattaatagctttttaatttttaattagattttaacttaaaaatatattcagtcagccttaaccctatacttattctttttatgtattatataaagcctagatatatgtgcagtacatcagcaaatatacaatatattaaaatttcatatggaggtggcaattaggaaggcaatgtcttaaaaaggctctggagattgggtggaagaaaaaagattgagaaatactgggatagagcaatcttaattattgttcctatttcaattaaataattttttacctgtgagagtcactaaacaatatgacaccactgatgctaacttttagaaaaaagcaagaaggtagcctacttttgacacaggtgcctatagaggatatacttttattgataatttttatacacagaggtgattgtgattcacaaaaaattatagtcaatttcagttgcagtatgttaaattggaagtcaaattttagtgatccgaattgaatttcaacataatctagaatttgtaggacactaaggacatgttacaactgtgttatttgccttagtgatatagtatttgatgcatgatatttcaggaaatattttattaaactcagattctgtaaaagctgtaaaatgaaggactaaaaccactgatggtgaaataggatcttgagcaaatcagatcttatgagtcttgttttgaaacagttaaagggtgtaagatgtgtgctttgactgtgcaaccaaaacagtgcaatcccaataaacattaatctgcagggaattttcaaaaaggagaaaggttacccaaggataacatagaactaaaacatcatggctttcactgggagaagatactttcttcttcatgctgttagaatgttaagagaatgaaatcttcccattcatttggtaatgggacattgattataacattggtagctgcttgtagcttaattcgatctgaatctttgtaaaatttcaaactagtattaaaggggcattaattttacagattttttctttttaaataaggaaaagttacaagcatatgtacagcaataccatgtattaaaaatatatgaagatatcaattagttactactaaaattgttaaaaagtcatctgtgaatagtcttttgcaagatttggctccctctcaaatatcttctgaaaatctttgtgaaaaattattattcaacagtatcagtccctactgcttgtacaattctgtaatagaaatgctgaatattagaaaatgaaaacaaaaagcctctcccagcttttggggagctttaaatttaatgtaaaagttggaaggtacacacatctaaaactgttcacaaactgaaataagtgaaaatgcaatgcaagtgatatatgtaagtgccgaattggattcacagtaatggaatgatcagcgaggctaataaaagacaactctgcaaaaactgtatattgagcaggattttcaataaagagaacagtgtaaattgaaagagaagaagaaattctgccaactgtaacatatgtacctgagctatacacacacgcaatctgatatatatgcatatacatgtatacatatgcatatatgatatacatatatatcaggtatataaatatatgtgtatatacaggtatctatgtatataagatatatatgtgtatctctctgtccctgtctcaggcacaggtaaaagaaaacccatagctgatgcagatgtgggaagggtaatcaattatctctgagtaataggtagaaaaccctgggaagaaataagcatggaaaagtgtagttacttactgtgtctaagccttggcagctagatagcttgagactcaaggaggaattttatctttcctatgatgatggtggctatgaagagaaataaatcaatttttattgttttactgaatgcattgtttaactttgtagctgggattgagacaatgccaccctccatcaccaccaagcatcccaccctctttgatgagtagtagtcaggttttgaccttgtaattgagctccttgagtccatgtgacgaaaactgactaccctaaacaagaggaaatatattggaaaaaaacaagggcttataaaataaatagggtgatgattgagaatttaaaaatgaacaggaattacggcaagatgaggaaacgagtcaaaactgtttttcagaaggaataagctagtcaggatatagttctgcaagcagacatcagacttttctcatccttgggtcatttcagtgagattcacacctccaagagacattattgactaagcttaagcctcattcttacccctactgatatggtttggctctgtgtccccacccaaatctcatctcaaattgtaatccccacatgtcaagggaggaacccagtggatggtcattagatcatgggggcattttcccctgtgctgttttttgtgataatgagtgaattctcatgagatctgatggttttataaggggctcttctacctttgctcctcactcctttctttcctgcctccatattccccttgccttctgccgtgattgtaagtttcctgaggcctccccagccatgtggaactgtgagtcaattaaacctctttcctttataaattacccagtcttgggtagcacctttataagagtgtgagaacgaactaacacacctacattttaccactccagagatatatgcgtatctagcaactttggctttggtagtgagcactaggcacctggatttgtcacccaggcaagaccacacacaaagtaatcccccagagaaaatcacagggctgttaggaatggggaatggatggtgcttggacaaataaatgttgagaaatgtccactctgttatctcttgatcttgagtggtggataggagcagtttatcttaaagtccttgacatctgtagcagctaattatcatttcttcaaattctcattatattttcaagcaacttcttttctcctaaagaagttcctaggtgaaattgttctctgaggaaaatagcacacccctcatcactaagaatagaacctgagtgttactaattaagtcccaattctaattatgttaatgaaactgcaaggggactacacagctagaagccccagcgcagtactatgccatgccatgcagctgtggatctcctcacaacatgtgagttcgatccgtgacagcattttacccttattatttctctcggaagcaaactaggtcttcatagcagttttgaagtttcctcagttaatattctgttttctttggaccattgacctcttaaattctggtacagtataccagaacccaaggatacactctagcaatttctaaatattcaattgtatagcatactcttcaagccagttttgaaattataagaatggcaaatacaaatacatttgccattttttgatattaaatattagtcctatgttaaaatatgtaaactgtgacatctaaacatacatgacaaaagatatatatgtgtcacctaacagctaagctaacacaaatgatttttatcactggaagaggagcaagtaattccaatagtatgtttgggattataggcagaattatgatacccccccaaaaagaaatccaaagatgggattagaaaaagagtttgagtttttaattagtattttagcaaggaatgcatagccctctttaggactaaagaataatacatttttggtgatactaaaaaaatactgaagatgtaataggactaatgcaatggactgaatacttaggtctgccctccgcattgccaaattcctatgttgaaatcctaactcctaaggtgttagtattaagaggtagggcctgggggaggtgattaagtcatgagggcaaagccctcatgaataggattagtgcccttataaaaggcaccccagagagatctccttctccttccaccatgcaagggtgcagcgagaagtcaaccatctatgaaccagaaagcaggccctcaccagacaccaaacctgctggcacctttatctcagacttcccagcctttagaagtgtgagaaataaatttatgttgttcctatgctacctggtttatggtactttgttatagcagcccaaatgaactgagataacaataacataattctgttttggaaaatgtactactttggctgctttggattataattataacgttaaactcatgtagtaatggtttgaattgatacaggaatccattctattagagaggagttataggcacaagatatttcaagaaggaattttgaaaacgagtcatgactttttctgtagcccattacttgtgctccttaataagacctggtagtctattggaagctatgtggttgaagtattagcagagcatttagatagatagctacgtaggtaggtaggtaggtacgtaggtaggtaggtaggtaggtagatagatagatagagattgatagataatatatgtatactttgtaatttaagcttgtatctagaagaaaaagcatctatcaattattactacaaaaagatgctgtttaataaataattgcaaaattgagtgatttaaaacagtaagcatttttcattgcccatgagtccacatgttagctgagcagttctggttttggctgggtttactcatgtatctttgggtagttttaggtcaattaggcagctctgctgatctaggccgtgtcctctcatgtgtttggaaattgataggctattgcctggtttcatatgaccttggctgggacaattggactctccttcataggatcttttatcctccagcaggctagaccttgttctcatagtagtgggagagttccaaaggagcaagtagacacatgcagggtctctagaggcctcggtttagaatggcacaatatcaattctatcacttctgttgggtaaaataagtcaaagttagcctagattcagggagtggaaaaatacactctgcttttgatgaaaggagtttcaaaattccattgcaaagggaaagactacaaggacgataattggggccattttaaacatcaatttaacacaaaagacatataaacgtgtatgcctaaaactctgaaatactatcacaatgtgacttggtgcttaaacaagtggagttctaaatcatttgcagggcaataaagaaaacattgctcctggataggacagtcatcaaagacgtcttggtcaatctcatttaagtgccatagttgggtgaagatctcagtgcagaagggagaaaaaaacagaactttaccttcccttgctgtaggtgagctttgggcatgctgatttagcattctcctctgcttctttcatacttctttctgagaacatgcctttaacttttgaatctctctcctgccttaataataacaatagttggagtggaatggctgagattgtagctgaccaactgacaaaatggagcaggtgagggtcatgctagccttccacccatggacagtatcttagatgaaaatactccactttggaattgcaaattgacctgcatggtctctgccctggttgccctttttagagtggaaatatttaacttgtttttccaatatctgcaaatggttctaactcactaaaccactaccatcctggttaatagctattgcatgcagttggttttcttaaccagaatactttttttttttccatttcagcattccagaacttaaccaaaagtattttcaatatgattacatggacttcttcccaatatgcttctcaaaagaatttgctgttaataaaaggtcactatgtatatcataggtaagcatgctgtttttggatgcagctatgctagtgttcactgctagttgaataatctgccagtggacacacgcttcactgacattgaatgttaaggattctcagtaatctaaacgtcaaacccgccaatattagtaacttgaagaatggatcaagacagcttatttgttgttatttcacatttataaaacgtcttaacattactatcttatacttaaatacagtttgtaaattgataacaaaatgagttaaaaattactgggaaagtccttttaagtaccaaaatgaaataaatattcttccatgcttaaatttttatgaggaatttttatttccagcaactgtaaggctgggcagcaatgtttgaagaagtttcaataaatgtaaattgaataatttttttttttggttttatagattgtcaggtgatcaaccaagtgagaagcttttataaatgtgttggttcttctctgagacatgagtgtttgggagaaagtcctcccttaccccctgccaagaatcctggtaaaacagaaaatgaaaaaaaaaaagtgttgttttagaatttcatttaaaaaagatgctactatttagaccactccagacaatttaagtcttcctgaatccaactgtatttctattccgtaacagtttgcaggaagatactaacctttaatttagttgataatattgagaccacctttgagatgaaaatctgggtgtatttttacttgtatctatttacttgtagtctaagtaagacatgtttttcctctttgccaagcccaactattttattatttttttaataataattctgtatcttcttgattctctgggacttctgttcaaagaagtacttttttgtcttttatgttttcaattcctctctctatgtagtccattctctctgtacttgcaaacatgtttaatttttttattcttaaaaaaccctgtgttcatttacattctatgttttttttttccttttcattttctatctaacattttggagtacagtggtcccctcagtattcccaggggactgattccaggaccttctgcagataccaaaatctgtgaatgcgcaaatccctgatacaaaatgatgtagtatttgcatataacctaagcacatcatctctaggttactcataatacctaatacaatgtaaatactatgtgaagagttgtaatactctattgtttaaaatttttattatttttattatttttacttttggtctgcaattggttgaattgatgcagaatccatagatacggagggctgactatattttgtactcactaacaccaatttcgttaccatctactagttccttaagtcaataaccctaacttcagacctgttacttactggctctgtgtctggttaaatgtccttgactgccctaaaacttcatttttaacataatcagtccccatattctgcaacttgttttggggctattagagccctcaaaccatttactatattcatctttttctgaagctctgtcttccagtgcaaaactatctggtgctccttcttgcttgttcagacagttctttcttcactggctgcctgcagttgtctttattcctctcttagatcaatagcttgtcttacgtctggtttccctattactgcagaacttatctaaaaaccacgatgaacacttgagtatatggtttatctcttcaactaaattataagatctctcagggcacagatgataatacaggcttttgcctttctgtttaaacaagaaagtaagacaagttctctaggctgatgtcacagtctttgactgaaagcagttccatttattggctggatgccgatagaaggaatggcttaggtttaatatagaaaaaaaaatgaatcaaccttgaaagatcttcaaggacgtttgtggcatcaaattcagtattttgtagataaggagttagcactttggagtcaaattgccttacttcaaatcccacacccaacacctgtaagctatttgagctcagtcaaatttcttcaccattttaaggttcagtttccttgtttgtgaaatgggaataatcatagcatgtactattagtgtttattgaaattatccatgcaaagctcttagcatagtgcctggcatatgaaaagtactcaataaatgttagcatatcaactttcttatcaatttatgtgtattctttttggggtttggagaaggcccatttaatgatagtttattttaaaataatataccaacatgaggttttattaaaattagttgagtttggaaaactttgtaagatagccattgtccttgtaacatggggtataatttactttgaagtataaatgcttagaaattaacaattgttttttttttttctcctaaggaaaaaaatagtattggcaagctttccagcttttgacattcttttaagatctttaaaatactacagatctgattcagccttcagacctgttacttactggccctgtatctggttaattcacataaatcctctttgggctacaagttacttttacttaaatccaaactaagagtggggggcagggaagagaataccagtctaattgctaaagtttcaaaacagaagaatgaatttgcacctcaagcttggcatctctgagcatgtgaatcagtctcagatactcataatcattgctttgttttttaaagacctttgattatgagcagtatttaattacacagctgcaaaattcttaagacatttgatactagaaagagacaatctaatagacatatttaccatccctttgtctacatttgccgaattctagttgcatccttttaggtcaaaaggtaagctacacatttggtattatcttagagatcttttcatcattcatgctttcaatgggttacagtgtaatgtgatataatatttcagtatagaggattgacacaaaaattgttcatttaagcagtttttatgtgcctttaaaaatcatggctcaaagtattgttgaagcttgggctgcaagcttcttgccatagtctagattttaattccagttagtattctctacttctgattatgtttcatctgtaaaatgagcttaatgctcttatttcatttttttctttagtaaaagaaatagccccatgtaaattctcctttaaataatctgcctttaatggtctctgttcaatttatatcctaaaaatgtattttgcatatgaccaagttgcatttctccctaaagtaggtgaaatctaattcttacttgaaaaaatggtatcctttctccatatgattgttattcagtgtttattgaagtatatttgttgattcaaaatgcaaaaagggagttttttaaaggcagagaagaatagatatctaaataattttgtcaagaaagaatgtgtttttgattaacgtaataaacattctttggaagtaaatgtgtctaggaattggacagtagtattgtgtaatgttttatggtgaaaataagtatgtttatcaaagaaaaggtagattaaataaacagacaaaaccatcagtcttgaccccaaagaactgtggctaaacctggattctgcatttttacactagtcagtgacagctcattaaagggcttacacttgtttgtcaggttattggcactggtagtggtaaccccagggtaatgccactatccctttgcctagcttgtttggctggtgaagaattaattgtagagggttatgtattattcaattacccaaagtcttaaatcctgtatggcaaaattcaagactccccagactgtaacagcctctaagtgacctctgtctcaaacctcttaggaaaatgttggtgtgaagaactgattgctctaaggtgtctgtagggacagtacttgaaatagtttaaatgagtaactgttttcatcgttagaattaatagaatttgtagggccctgtgcacatcctgcatatctgcctggagtaaaattactttacaagctttagataaatgaaagctacccagaaactctcaaggaagagtagaatattagctgatgaaaattgtgtgtggatgtagggattcagagccacaattaatttacatttgattttaattgatgacactctgatagatcacagggactttaattaagaaataaaaatgtaggcagattagaatattggtaattggaaatagaggagttttaactaatgaagtgtggctttattaagtgttttgttcattttatagaaaatgttatgtagaacatattaacagttattttcacttaaaagaaacactgatatttagaggatttagattctttatttagaaatatgtgctgtgttagaaataatggttgtgactgtaaagccccaaattgcttgtaatgttgtgcatggacttctaaaccactgtgctttattgcaagctatcagagttcatcttttagggacttttggttcaaacatttaataaatggctgtacattgttaagttttccagggtagctacttggatctcttgcctctgttcagcatctcacttcaagttacttctctctttcattgtctctctaatttatttcctaaaatgataagtgtcaaaaatgacatagattgtaatttgcagtattacctttgccattgtggattactctcccttataattacagcttatacagaaacttgcttgatgcttccttgtaatcagaataatactaccttgtatttatgcagtctttctcttgtgacctcaaagcactcttgttaattgtcaccttattcctatgagcaaaggagacagttgaagaaagggaggcttaagtgtaaccaggttaaatgacttgcctagggtaaagccataatcagtgacatcgatgggaaggaagccaggtctcctgattctggaccagttttctctcttctgcatcactctgccttgacattttttacttgtgacatctgtttccatcactgtcatgctgttaattacttaatatcattttactgcaagatttgctaaagggaacagatacactctgagtgtttaaaaatatgtttaatgcagcatgagagaaacagtgacactttgtggggaggacatgtagattcattttattggattttggttgcttgatgaacactgctagtttcggggggaacactggaggtttcatgttttacctaaatggtgtttttggaacaatgcaaatgcatagaagtcactggtctggttttcagatatgcacctaataaagcaaaacatgatcaattcattgattactcaattacactcagtgacgtgtcccttgaattagcagatatgcctctttatgctcagttatagaatgtatagctaggcttttaaggctcatgcatatttaaaacctgcttattaaaatatagacactattacaacctattttccagaccttttttattattaaaatgttctatttccctttacacactaacatgtaaaactagatctcttgtctgaacattccacatcccgttcttctgaaaaaaggcagggtttagaaacaaagtgggaacggggtaagtatttattagtcagtttgataatttaggtatacttagtggaagggcaagagacttgaagggtatatccatcaaagttttcccatgatgtttggggctaatatatataactcattgatttaataatagaagaaaactgatttaattgttctgagcacagatttattgacaatgaagtataatttggtgactgatagatcttattatttctgccctcatgccctcatttagaacaccttatttgttatatgacgcttgattataacctgatacccagacttctgttagtcactgttatcccacagtttgacttttttactttttgtccatatttactatttttcattcttgttttccctactttttttttttttttttacatttctctatcctgttcacataagaacacttaagtttctcatgttagagtcttctgagaatgtgttaagaatgcaaaaaataggctgtgcgcagtggctcacgcctgtaatcccagcactttgggaggccaaggcgggcggatcacaaggtcaggagatcaagaccatcctggctaacacggtgaaaccctgtctctactaaaaatacaaaaaaaaaaaaaaaattagcctggcatggtgacgggcgcctgtagtcccagctactcgggaggctgaggcaggagaatggtgtgaacccgggaggtggagcttgcagtgagccaagatggcgccactgtactccagcctgagtgacagagcaagactccgtctcaaaaacaaataaaaaagaatgtaaaatatatatatatttatatagtacatatatagtatgtattatgtgtgtatacacacacacacaccaaattttatccttctgttcttttaaaaagtattttgtcaagtatatcatgtgtaactgatacatatttgttaaaaataagctacttccccagtcacagggcttatcattgaaaccattaggctcataataatgtgaagacttattttgaatggaacttgtcccttctctgttttgaaatatcagtattttaaataagagcattcctgttagttctgataattacaggattatagatggaaaatcagagctgatggtaggctattgtgaggctttttctttttagttcccagaaagcccacctaaaaacaaatttccaattatttaatattaattgagtatacattgtgtactaggttctgggaaggccctaagtgtctataaacatgtacagaatgtaagattttgttcaaaattttctttgaagatggttatagatagtcagtttcagtggtctgtttcccagtgtgctgtaggagagcacttttgggctgttcagcctgaaatcccagaacacagttttactccgcagccaggaagagaaccctgtgcttcatgccactgctccagctttctcacccagtgcacggcatgggccacgtgctgtgtggtcggggagtcatcagcggaaactttggtgacttctctgcctactggtagcaatagcatttgagtaagaaggattcttcagttttttttcatccatggtttgaaaacagtacattacttataaataaattgacaaaggtaaaatattgttgatcaatctattaacatgccggcttatcatctttctcccttctcatgcactttggactgtctccctacagcatttttttccctcttgctttttaaaaattacagttaccaacaactcataggatggcaagtactgcttattttaatcctcataataatcccattgaaaaataatattattgtcctacttttacagatgatggagcatagctgtagaggttttagaaatgttccaaattgtacaagagatcatgtagaaccaggatttgaactgaggattctctgagttcacagtcaatctcttaaccactgtcatatcctcatattcttgttttaatatgagtttagtgaatacaaatctgtctaatgttaaccatgattaactgacaagatgaggtcttatcagaaaggtacataaattaaaatagtgaatctttaaaactgccatatgggcatgaaaccgatgcagcaactggtgtaaaaacacacatagaatttgatatataagaaagatggactatgtaccagtaaaaataattttaaaatgtgtattatatacttgtaataggcattgtgataatataatactgaaatgtgaaaacagttaaaggtattgagtaatattatccccatttgatagacaaagaagtgaatagacacacagtgcttgagtaacttgtacaaggtcacatgaacaagagctctttggggggtcccaattattcttaattgtctactggaaccattgacctcggatgatgccaggaccagggtagagagaaagactgagacttgcttgcctaagtcctcattgaaggtactttaacttttgcagtttactttttttcctccctttggatgacttgcacatgcatcttcttcccaactctttttaattttatgaacaggacgttttcagcactgttgcccctctgacacccattcagcttggtctggggatccttgactggtacttgactgtagttccttggatttcttttgcagaaagactgcaaatgtgcgtttcccttctcttgtttgttagtttaacaaccatttaactcttgatcatggttgctggtgtgtgacattatgttgtgtgttgcggtactccaggatcgagtagcttcatatgctctataagctcttcagtggcattgcccaagatgttattatcaaaaaattatgtgtgcatatttcttgattcttgaaatataacatcattctcacttcctgactatgtattactgattagtatgtgtcagcgccactacagaactgctgtgggatcaacaaattgtttcttcttcgctcattatgcatatggctcctctcttgatgttagcagctgtaacagtgtatgcccttcttttatctttgcttcttcgtttgcatgatactctaggcaattttataaattttaaatcctgggtacccaagtaaatatgtaataaatgctaattctccttcataattagaaactatgaacagttttagttttaacaggattgtcttcggggaaatctgtcctactgaaaggcagtttgattggaaaactcagggttatagtcaaaatcgtaaagagcagagaacttcttggaatagagagcagtgacacgccagtggctgagtcctaggtgtgccctcaggttttataactgctgttatcactgccatctgccagagggagatgaaaaccatgcctactacttcttggagtcttgtccatttttgtctggctggatgtccagatttttaatacaatttctcattggaaatattaaagggggaaaaaagtcattgtgacaaaacagtaatgtatcaagtggctttccacttcaactaaactaaaatccacagtccttcctctaccctcctgtgggccactgagttctggcccctgcatagcttacgcactgtattacagccacaatggctttctaaatgttctttcaacaagccaaagcctttgtaagccctaaagcctcagcacatgctgttccctctgcgtggaattccacccgtagggttcttccacttttctgactcccagtcatcttttagctctcagcttaaatatcaccaattcagagaggcccttcttgactaattttcccaattcttcggtctcattgatcactcttataacttcttacacctttcctttcaacacttaaaaaattctatatttgtacatttatctcatacttttcttattcactagactagggcttctcaaccatggaagtgcattaaaatcatttagggaaattttaaaacataccattcctcaatatcaccctagacaaattgaagcacaggttggagcctcatcatcagtgtttttaaacattcttcagatgattctgttgtgcagctagggttgaggaccactgggctagatcataagccacagaaaggcagagatgatgtctgctgaccagtgtatacccgtagcccagtgtagtgccttggagaccaaagagctcagtacatatatctggatgaataagtgaactcacagagagtaaatatggatgcccttgactatctcaatgatttgtgatacccagaaaaatacaaaacatcacagctccaggactattccatatttatatggctggatggcatcaaatgtacgaaacattaatgatatctttttatactcattaggaaaatgagtattatctgacatggtactcctgaaaacatgtcagttacttgtgaaatcacaagtgcatttttttttctatttcttactcttttcttcaagttaactactgtagcaatatattaccctcattttgataaaaacttaaaatatgcaagatccataacgtattaacgctccaaccaaattagttatcacccccacctcaccataaacaattttttaaagactgtttttaatacctcacataaaagatattaagtgccagaattttttgtctattaacccaaatataataaaaaatgggttatatatttccaaggggaggtgacattgtcctttagaggaattgttgtgctatagagtagatcactagaaggcaagtggtagaatttaggacaatgtgttacagaaggctttttattcatgtctgtgcttcaataaatcaaggaataacagagaaatgaagacattatgctgtaaaaacaaatgccgtgttctattttggtatttagaaaattaactttttgtggtatgtacatttcaggaatcaatattttttaacacgatttcttttttgcttattccaaaagctgctgaaatctgaggcaaagtatatcaaattcaacaaagaggggtattataaacacagtattatccatatctataatttaagtgagttttataaacagggccttgtagctttttgcaaataactgataaaatatttctttagggaaaccctaccacctatcccaaatgtataatagtcaaaaatgtttcctatttattatcacaccattatttctcaatcagaatgcttttctcaagccattggccccaaatgtacttaaattaccattatacctgaggtttactgatatctcctgataagagcatacctgctattttactgtagaaacaaattggtaagttgaaatattgtactttgtttctgagagaagaaagataagcattgctttcacaatgatccttttggaaaaatattcataagagagcttaccggactctggagagcttactaggctctgtggatatttttaattcataccatagtgtctttagaagttaacgtaggaagattaatgctcttggagaagagttcaaagtgtttagtgccttttccaggttagtcaccatgccagttgttggacaaagaactctggctcctcttccgacatgttatttcatgttcatctaaaatacagtcccttgtttcttccctgaaaaatgtgataacatcctaggaagaggtggtgatctgagagttaaagggataaatcagaaagtagtgacaattctctgggagcgaactggagtctccagcctccagcattgacaggtaagtgactgtgcagaaggacaggttgtttcattatgttaatgaagtaacttgagagttttttttttttttctcagttgtttatctagaagttctgtgtctggggttgatttcactgttcatgtacatgaatatcattacaaaaaaaattgtagaaaggcaattctaagatatgcagggaaattagtactattattagcaggtactgcttgggagttctgggaacagttcactagctgtaaatataaagaggtgggacaatttgaaggctagctctgttgtcgcagtggttttgagtgcagcttgaaaattagagcttaggtctgagttgctaagaactgctagttgacattccaatgacaccatcatcatgtattctaggagtacccctgctctattttcaagccatggtactcaatgttgcaggagtaccactgtcaataagatagtgtccttagcctaaggagcttgttatttattaggaataaagattaaaaaaatacagtacaagaaaaaagtaagagttataaaagatgtactacaaagaaattcatcatctcaaagatagttgatggagtagcagatattcagtgttgtatgttctattcaattaacgtgggagagttaaaaaactaacatcctagtaattgataaaccttggtgtttgttatatatataaatttcatatgtgtgaatgcaaaatattttttaaaaactttgtttctattgctaaccatagattaaatcactcttcttaccagtctgtccaacatggccaaactccgtctctactaaaaatacaaaaattagcagggcgtggtggcacgtgcccatagtcccggctattcaggaggctgagggaggagaatcgctggagcccggaaggcggaggttgcagtgagccaagatcccaccactgcactccagcctgggcgacagagcgagactctgtctaaagaagaaaaaggaaagttctaacaccttaaggatggcaattaatgccctgataacataattaacaacctggctatgagtggcataaaaaagttaattcacaaatactggaattttgttttgttttctcctcttagacttcctagcaggattagatttattactgctgcacctttcccatgaaaatcaggttttctaaatgggaaagttaaactcattataaattcctcaaggtaatgttggagttctttgtgctgtagggtttccaatgtgggtcttttaacctttgcttccatttgaaggaaattttccagacagatatattcttacttcaatggcatttttagatgctgtacatgatgagcaaagacagtgcagagtgttgaagaaataatttgtgtttccttgaaaactgaatttcattggttttttttagagttctcattattgcaacattctgagtgtgtgtgtatatatatatatttaaattatatctttgtgcatgttctaaatgtcaaatataaccactagaatatttggtctaaaagggagaacagaacttgaacttagtcattcctaaattcatatctttaagctggttttatatcattttgattccagaaatattcacttgtttagattttttaatgttcctttcaggtaatgttcaatatgtgcaaaaatctgagtagctaatcagtaattactactttgtaaaattgaactaagttgggtttttcaacatgtaaatcagccttctttaggatatagtaatcaaagcagttctatgatgcttgttacaaaccaattgctaaaatgaataactaagactaaaggccttttttcttgttggttaaagttaaaactgactagctctggaaatgtaacttttactttccctgtttttatagtaacgcttcattaagatgtcaagtcaaaatatttttttctttctctttctgttttgatatttcatctgagaaccaatatttcaaaaatgtagtgatttagtataaattccttagttccagtcagataaataaaccttaccagattctgtgaactgatttattgataggactctgagggaccacaagcatttttgagaatgtttgaaacatttctgaattctgaattttattgaagttttatcccaagagagaagtagagtgagaggaaaacctctttccacaaatttggacatcgtaacaaagctttaactttctttttttaaaggtcatacaggtatttaaaaaaaaaaaagacaagtagttatacaaacactttggtcaccagtgaactgataataggagcaatcttttgtgtagcaaattttctatgttgtgtagtaatgcaattcaagactggtataaatatttgaaataggaaatccctaaacttattttcatacagtgattttgactttttttgcaatcaagtttatatctctttctgttaaagaaaaaaattaagaaatactttttgtgaaaaaaggaacaacagaaactggggcttacttgaggagggagaggaacagaaaaaacatctactgtgtactaggcttagcacctggatgatgaactaatctgtacaacagacccctatgacacaaatttacctccagaaccaggctgcacatgtccccctgaaaaataaaaattaaaaaagaaaagacaagaaagactttgtgtaaaaagacaagaaagactttgtgtaaatacacctctttttaaaattacccctgacttaagaaagaagtttttcacattcttaatgtgtgtatgtgtgtgtgtgtatgtgtatgcatatatatatatgtgtgtgtatatatatataatatgttaattttcatagatccaaacagtttctctctgcttttctcaaacctaattattttctctcctaaaaggacggtgactggaaagatcgcataggtcacgaggatcttcctatgacctatgatgagaaagaggttagaggtagactggctgctggaaaagagaagccaagatcccagcaatgagccctttcctctgcttctcatggagttcttactggtccccaggttaacctagggagttgatacagtgccctttcccaagcagaacatctggtttactgccccttgcccagtggttatatgtgtgccaggtttgaggatcctgcaaattgctcgtaatggaggtaaatggcttgtgccatgagaaaccaaactgtgattactagggaagatttcttaagttacccagtttggaatttattttgttttattgtattggattccatattaatagaggtgcttggaggaccagttaaggagcataagaaaggctggttttggcaagcagaggacaaatccatcctctcttccttgagggaaagttcgcctctccattgccatccctacattgcctttcctatctgccatgtgcaaattagggagactgaggcaacaaagttatatataacactagaaaactgagatttcagaggggaaacaaagttaaagcccaaagagtaaaatactaaagggaaatttaaaataaatgctagcaataagttagtaaaagtagaaaaggggactaaacattcaaaattacatcacctcagggaaactaagttaagaacaactcaaatgatttacaaaccaagatttaaaaaggaagaagaagagaaatagtgagacaagagaagataatctgaacactccagaaagaatgaaagaaactggtggcacaaattcaaaatgaagtaccacttaaacaagaaacagcagtgaaaccaactaacctttaatacattagtcttgtaaagaaatgtgcatggggaaaaggagaaagcaggacacatttttaaagtggtcctctgaaatgaggcagcttccacagctggaggctccttggagacctataaggcagagagagagagctgagctgtagagggtaggagatgactctctggggcctcctgtcaatggcttctgtcccccagctcccgctaggatacctgaaagggcaaggagatgtgccctttggtaaatagcaatccatcaagctgcaagctggtagcttcccctggctggctttccacaggcatgaaagcttctgtggccatctccatttctttgtgaaagtcctgtctgaggaaagggatcccattcagcctggtgttcttcaggcatgtggtcaaggcaaggcgcctggctaatcagcccatcagctaatcaactattttataattttatattttaatgcagctatttaatccaatgttgatattttataatcagttacttttaacttaaaaatagtgagttttctaaattttagaaaagctttattttgaaaaggtttgctattttggttgccgacggagtgattttgttctaattgtacctgacctcacctgattaagactacccacttgccctcactctttcttcctccaccatggccttctccctttctttttctctccagcttacctcacagggcctacgttagagtaacacttccattgcccacaaatttgggggagtgagagaaaaaattgcacaaagtgcatttgtcagataactcaaattccaagtgcccaaactgtattttaatcttttgttgggaatatcctgggatggggacaatgagggagatctgtacattacataccatttttgcatagtgtgtctgtttacatcagaaaaagatttaaggtagtgttacagtaccatcgggttcatatgctcactgtgcagcaacagaccaatacactgagtcagcagagtttgcagcagagaaggagcttgataatggcaaggccatcgagcaaggagacaggaagaatcttcaaaccttaactttgttttcctgaggggctctgggttcctaaggggatcatggagggtgatggactagaaaattggggtcattgattggttcaggtccgggagatgaaatcaccaggatatagaaactgcatacttgtataagtcagatccttgctgggcccttcagaccagctagctcgggtagttttattgctatgcagaacctgaaggagaagctcctcaaagggaaagcttctcatctcacagtgtcttagatcttatctatagaacagaaaaggaacacagtcttgtgaaaagggctatgttattctggagtgataagcagcaactagctacaaggaagtgagccaaagggcaagtgggcttagtgaatgcttctgattgcgctgcaagcctagttgaatgttttcttcccttaactgattttataaaattttattggggatggcttcagtggccttcttcatagggttattaggatggaaggtctaacaaacacaagcacaaattataggtcataaaacccagtacaaatattgggaaaaatatccctgggcaagacattcaaggtcctttgctttctgtctctaacctttcagtttagccttaattcctgtatttcttttcctgttaacctccagagacctacactcaaaacacatcctgctagttggttggctttttgcaaatagtgaatttgcaatttcgtgctcccatgcgtttgtgtgtgttgtttcttctgccttgaaggacttctcaatcccattgtccagtgaaatcacactaattaggaccagcttaaatgtcatcttcccctctataccttgcttaacagcttccctgcaaatatagaatgcatctttcctcttgcttttctggcctggtattttgctccttcgactatttcatcacatgttacaatatttatattgacttgcatattcatctgcccttcctgttcctgaattgataggttcttgaaatgaggagttgtatgctcagttcttaacacagtgcttggcctgttacaagtactgaagacgtgtctcttggctgtaggaattgaagtacttcatctagtttctcatccagcattactaaacacattttaatccttcctcatttattgaggcacagtcaaggctgggatacatagttctatatctgcttttaattttgctctgtttccttttagctctgctttttctgttttaaatatatgaagtcttccctttctttccattttttctgttaaatcaactctagcctgcagattccatcattgaccatcttacaacctctatgtaattgtagggaacaccgaggagatttattttgcttctaggtcttggactttgttctaatgcttggatgttgccagttgcttgacctctgcgtaaagaggatgtactgtcagggttctccagagaaactgaaccactaggcttgtgcatgtgtacatagataaataataaggaattggctcacatgattagggaaatggagaagacctaagatctgtagccaggaaattagagacctcgaagagctgacatatgattccagtcctggtcagatagcctgagtaccaggagatctgacattgtaaagtccagtgcagaagccagcaacctgaagacccaagaggagctcatgttccagtccctatccgaaggctggaaagaaaaaaacaaacaacaccaaaatgttcagctcatgcagtcaggcagcagagacagattctttcttactcagtctttttatttctagtcaggccttcagtgggttggatgaggcccacccactttgggaagggcagtctgctttactcagcctactgactcaaatgttaatctcatccagaaacaccctcctagtacacccagaaataaggtttaactgaatatctgggcaccctgtggctcagtcaaattaacgcgtaacattaaccatgacagagggagtgctctgcatatgtattttgctagtgatgccaaacagttgacttaagaagggaattatgtctatagagagtatcatttattttacaaatgataatgaatttacagtctttttgagaatttcagagtctagtctcattttgtcaatgacattttattcatggagtaagtgtagagtgaaaagaactctacatattctagttaaacatagggcaggagtccaggagtctcatattaaataattttaggagctaagaaagttagtaaataagtaaagtatgttgggtgtatgccaagccagaatagtgggaactacagtacataggacaactctagaactattttcaaggtatcccttcccttccctcccctcccctccctcccctccctcccctccctctcttagcctttggctaaagtattttccttgtttacttattaactagccacatgtctctagaaattcactgactttttccaggccttagttgttttatttaaatagatggcttatctacagtctgaagattctttccatgcattttacctgcaagataagtttgagaggttatgaaataacacctttgttgatttaaagagatctaccgtgagttctaaaggaaagtgacatgtcatcttctaaagcaacttaatttgcttcccagtaatgacatgatgaataggtctattgtttgcaaaattcaagagcagaaatatcataatcataattttgcaccaaaaactactttgtatactcatgtgcttcatgatgtaatgtgaccagattttttcataattaagtatcaggtctctacaggtgttgccaagtctgtatcttgctatgtttgcacatactttgctttctaaagacttaggaatacttcctgttgtaaggtaggatgacttccaatacatatgtgttggtatgtgttgatttttcttgtttaaaggcttttcatagggtcctggagccttcaaactataaattaatgtgagacagcctctgaggatttatggagtcattttccctttggctaaagccttccatggtcacagaccactagatttaaaaaggcagccagacctgtccaaagaccaacataaattttcagaggcagagaaaatggtggctgcttattaaattagtgagaatatagtatttggcagctacaaataaataatgttttctccccataagctagaagcaagacattgaagctgtgtgattttggacctacatttgtcaagtttagctacatcagttgagaataatttgcatgttacatggagcacttacttgagacttccgtttagatttgactagataaatgggttcacctttgccaaaaagctcccagttctgaccacatttaaaacatttttccccagcacacagagaccgaacatgagcattaaaacaaaaaaaggaacctattgttccagcagactcttctccagttccccagtatttatcttacagggttttctaagtgcaatatcaggtgttcaccattggttgtccgcactcactttctattttccctcttgattcagagaaattatttgtcttagtccaataaaaatagggctttttcttttggtgattcactatatgaaaccattttcaccgacttccagggtttggggaagaaaacatgtttatccttgacagataatggtatttttccatgtctcacaggacccttcccaagtcttttttttcctatacaaacaaaataaattataggactagagactttatgaactaaagttgatgaactgtactggttttctagagtactttctgagaaaatgctgtgtagaatttccagtcatgaaacttgcatgaaaggataccacagaatggcaggcatctttacttcctcatactcagagatgtttttatgagataaaactattgaaaacagattacatttggagatatatttccatagcagactattctgtgtttctatggaaatgggacttatttctcttaaccccaatatcaatatcgcatgggtagaaactctaggtacaaaatgtaggatggatattatgttctaattggtatctttttttctcctctttcagttaaaccagtatctttgtctttgtcttcctttctttttctctttctttctttcttcttttttttgagacagggtctctctctgtcatccaggctagagtccagtggcacaaacacagcttactgcagccttgacctcctaggctcaagtgatcctcctgcctcagcctcccaagtagctgggaccacaggagcataccaccacacctggctaatttttttttaaatttcctgtagagatggggtcttaccatgttgcccaggctagtctcaaactcctgggctcaagccgccctcccacctcagcctcctgaagtgctgggattacaagcataagccacagtactcagcctttgttttccttttaatttttcatgtgatagttatcatctgacattagtggtatgcctactaatagcattttttaatttaaaactacattttataaatttgttgaaaatttatacacattctgctggaaaatttttgagatgttagtttatttaaattttataaattaagtctatcttattagtcaaatgttcagtcacctattggcctgggctgggagttgcttggtctcttaaagttgactttgattatttctaattagaacatagtatgataaatttattcattagatgcccacttattaagcactctctagatacaagatactgtccaagatacaaattaagttgggtcttaaaggatgaataagacttttgatcaataatgatagtgatgattacaataatagctagcattaaatgagcaattccttcatgtccaagccctatgcaaagtcatatctcatgttatacaacaacttgagaggtaggcacagaataatgtgaagatgctgatgttttactgatggcttctagtcctggctttatcacttactggtcatgtaaacctaacctgcccccctccccattttgaatatattgataggaacttcctcctggcactggtaggagaaataaatgagataatacagtctgatactatgtgctttgaatatggtaaacattcagtaaatgttagctgctatacttttctttattgtatagatgaaattgaagctcagagaagctaaataacttccctacatttaaaaagtggtgtgagcccagatttggactgagtcagtgtgactgcagagtctaggttctcaaccttgaaggattctaagaaagagtaccagtagatgcgagggcgtgcggggtgggaggaggccagtgctgaaaacacagctgagtgcatgcagggaaaggaggctgcattcagttccaggccatttgtgggggccttgggagaccttggaaagaaactgagatgttatcctggaaatcaatggaaaataacttgtttttcagttctttcgtatttaaatgaaacaagacatctctgcatttacctttgacttaaactgtcttctaaggtagtactatattttcagtcaagaaatatgaactagacattcaaatgggagactcctcaaagatttgggagattgcagaagatatctcataggcgctaaatactgaaaccctgtttttctttgtttgttttttaaaccacaatctggaatccaagcatacaactctgtcttctcactgctctggaattttttgattcaagcattctgatttcaactagcaaggttccactgggactataaggtgtataaaacctactaaggggactagagattttatatcctctagccagcctatcttctccttgctgggcaattgagggaagaagtcaaaccagagattgcttaggaaatgtgaaaccagaataagcatggagagtcatataattcaagcagggccaacttgctatgcacatgacctaagggttccatgcttataagaggcccatgcttggtttaatcctctactgtcatcatcttgaagtccttaacatttttagaacaaggtctagacattttcattatacactgggccccagaagttatgtactcagtcctagattcatgaatttgatgatattacgccatgatttttcatatgtctgtcaactatttcatagtatgtagatctctgttactgggacttcaggtttgttccttaatccagtggatcccttcaactgaacagtacctaaaatcgtcctgccagcaaatacacctctgacaccattctcctaactgtattaccatctgttatctcattgaaacaccacttctgtagcctgtttatctggtcatttaaatattgttctgggtgcatatttttaagttcactttgtgtatttataattagaacattacttttttaatagatgaactctctgagagaacccatgtttcctgattctttgagaagtgtttcatatgttacctacatgtaaataaaataagtattaagtttgaaatttacatgagagtgggattgtcagagccaactggatgatagaacagaaccaaaaccattttggtaggatagagaaatgtggttagaaagcaagcagtcatcagggtgataaaccagctgaatcctggcaaatatgctgttcaagaaatgatgaaaagaggactttggtgagagtcaaagacgcatgctcacagacacatttttatttttaacctgtcactgtcactggtcagatcctttctagagtttttaatccttggtaatttgaagaacaaggagatagtttacaggaatgcaacaaagatgattgatgactggatagtgggggattgtggaagaaaagctaaaatacataaaatgttattttttctggggaataaaaaaagtaactaatggaagcttagagtctttaagcacatgaaagtttttaaaatgagttttgtgagtagatttaccccgtgctagtaatggacatattatatgaaatttcaacataaagaattttcagaaaataatgatagacacttggattatgcagtcatcgaaatattaaaattttatttgtgcatatttttattgtaatagcttttatccatctgtatttgtttagaatatgaatgtgtgatttaaaaaccaaaggcccatcaatcaaaacacttcccacctgctctctcttaagggactatcaaagtagtaaattaaatgaaaccaacattgttttactacttgcccatcataaaatattactggttccaggtgagtgcctatttacaagagacctttgaagatttaataggggttttaagtgaatggaataccatgtaatgaaaaattttacatcataaacaaaattgaaaggtaaactggcaaaaaataaatttgcaaaaataaaagacaacttcagtatacttaaaataaaaagtacttatacatgttaataagaaacactaaaaacaaagtgaaaaagaagggcaaagagtatgaacagacactttactgaagaagtaaaaatagctcataaaaatattgtcaatatcacggtcaggcgcggtggctcacgcctgtaatcccagcacttcaggaggccgaggcaggcggatcatgaggtcaggagatggagaccatcctggctaacatggtgaaacccacctctactaaaaatacaaaaaattagccgggtgtggtggtgggcgcttgtagtcccagctactcaagaggctgatgcaggagaatggcgtgaacccaggaggtggagcttgcagtgagctgagatcttgctactgcactccagcctgggcgacagtgcgagactcagtctcaaaaaaaaaaaaaaggtatatatatatatgtgtgtatatatgtatatatgtatatatacgtatatatatagagagagagggagagagagagacagagtcaatgtcactagtaataattgaagtttaaacagcatataattttataggcaaaattagtaattattagaaataacacttagcattgggactatgcagagacaacctacactttcgtatgtctggaatgggagaatgctacaacatttacaagatggctgaatataatgtgaaatgttattcaaccatatgaattttctttatttgtctttatggattacaattagggaaagttgctcataagaaaaatagtaattgaaaatatcagaaacaaaattgtgtgttatgcattgtgaattgacatatatatgttaacatacacacacacagagagagagagagagagagagagagagagagagagagagagagagaaggctggagggaaagcaccagagtttaattcttttgaagttttgttcacttttttctctctgtaacacacaaacacactacagacacaatttgctggagggatctgggggagttatatcatcatatcttgcccctacacttttctttttgaacttggaaactataaacaccaaaagtggtaaagtacaaaagtggccattaggtctgggagtattagattgaggactggctttggaaacccagtattgccaatggtcacagcaacctagatttttgggtccagtcctaatttcaaaacttgtgttccgttatttgccgtaataattatgctcaacgtatttcactttttgatttagaaacaagtcatagttttatgtgcttatattttaggtgcttttggaaggccttttgtgctaaatttataaatctaaaactaactcgcaaagactgtctatgattagagacaagacccagaaagtcaactgttcccagaaaagaggtgccacaccacttatgacagtgaggagggagcgaggaccccagccttcttgtcttcgggccccagttagcgaggcatcattctatgttggtttaatacacccacaatcataattacaaatcttgacatttagatgctcccaaagtcagcacccatcccagcagggttagccatattatcactagttaaggagatatagagcaattagaagctaaaggaaaaggttagcacttccactcagacagaaggagttcagcagctaaacccacctgtagttgcagtgttaatttttttaaatatgggctttgaagccttgtcatccatgacaagggaggtctgagtctaaatggaatatttaagagaagtgcttcctcatcctccaatcaggctatatgctgacctttctgtagcctccaccagttgctcagctgtcatgaaatgctggagaaggtagaacatcattggacctgtcatgaggtcaatcagcgggagctcaggccaatttgctaaacgtgttcatgctaaagagtcagttccctaaccagtctggtgaaatgtagtaccaattaatcaccagctaattttcaggggattgtgaccttctccatatttgcagtccactcgctaccttacctggccttgggggatctctggcctggaatatgaggccacccccaggacatatgaagctgtcaaaacttgtgttataggctaccagggtgacaggccaggagacaggtatgcccattgcacctgctccggccagcactgacctattttagtcagaacattcagtgtggtttgcaaaccctaaagatattcatacagctcaagtatatgcaaaatccatcactttgaaatttttaatgatatagtaagatactgttttttctatcaacctatcagttctttatttgtctttagaaggtggtggctttgtcaccattctctgcagaggtttattatctgagagctgttgggttgtcttaaaagcagaaaggttccttttttttattttacaaaataggctgctctatttgtagccaagtctcataaattagaatacttgtcaaaataaatgaatagtatgtttgttatattcatgacttaaaatcacatttgattgcttactcattaatccacaaaattaagcaatacatgctggattgcagtcattagtacaaataagcagcgttcttctaacagtcagccatcgtagagaatactgtacagttgtgtttgtttcaaaactaggtctgttaatgcacaaattagttttacaatttcaaaataattcctctggaagaaaatcaaatacatatatgtagtccaccaggagacaaggttggaatcataatatactaagtagattttagatgtgtaaattgttaaatgcaattttgcattgaacctcaaggatggatggaagctattttgctgtgcataggaacgtatgtggcatgaaggtgacctttatccctaacaggatggaaaagtcaggagtagggagatggtgtccacaccaaagtgaagatacccatatggcagaggctttgttctcttgcttggatatagcagaaaatgtagatcattcatttacctaaggaattttttcccatgtgccaagaaacatacttgcagcttggaatataaagtcagttgtacttcagtttttttcatctgtaaaatgggaataacagtggatttatcataggatttcttatgagtatgaaataaaataatacatttcagcacttaatacagtgcctagcacatagtaagggctatataagtatttgataaatatttttattgatgtgacccatagttttaagtagcttactgttgacatataggtagggacaagtataccaaggaccctcgtgctatgtgacaagtgatgatacagtcatggatatagcactgtgggacactggagggcctggtgcagataattatggcagacttaaactttatttcaaaagtttgacaatgtatgatgaagaacttgaagctgggccaagaccacacccagatctgtttgctggaaagaccactttggcaatagtgttatggttaaatgtcaggaggccagattggaagtcagaagcaaacccaggcccttgccatgctctttgggcttatttaattgttggagaatgatctttgcagaaataaaccaaccttaggttccaataagttattgccttcaaggatttattgatatacctatggatggtggtggcagcattatgctttggctgagagattgccaaggagtatgtttctgagacgattctatctttgctttggctagagagaagaagttgtagggaaggagggaaaatgaaatggagctagttaaataatattgaatatggatgttacaatattgtaaatgtatgtagtgctttatactttagaaatattttccatatactattttatgtcttctagtgttggatatacttgcttcaaatagaatattctttaaaaaaagcaggtaagatgtgtgtaatttagttaagattaacttgaagaaaaactacttgtgtgtgtgtgtgtgtgtgtgtgtgtatgtgtgtccacacattttaaatatcccagcttgttttgtgtctccatttcctcccaagatagtcaaagcccttgagattggaaaaaattagtctatgtagctagtgatacattgggcaaatggcaagtgaggccacctagtagattgggatcatctttgagaatcttccagacagtttaactcaagttttttatttccacctttgcatgtgtctggttttttaaattatgcgcaattcatgggaagcaagaatgttattgacaaggcaggtatatagagtttttaaactttctgaaaatttgtgttattctgtgatgcttgaaacttctccctgcttttgttctggcttgctttttccatagttaatccctagatatctctaggagaagggcttcatggatgccacttgacctccatggcaccctttgccctaccactgctagagatggtgaagggcacagagacaagggctcctcaggcctcccctttgtgtattagatgtgagtcgtgaatgttgtttaatgaatcatgagtgattgtccctaaaagtaaataatacagcagacacaaattcaaaattctctccaacttgtcaagggataacatatcatctttgaaattttaattcaagtcagagaaaaaaatgtgattcaatataagatgggtttaatgtgtatctggcttctttaggaacatactacataatttcaaagaaataaatgtatatttggctgaaatatgggtggttatttaatagggcatatttttgttattatgggataattcaagcagatgcatctttaaaaagtgataaggataaatagggttttcagtacagttgaataagtcatgttattttcttcagaataatgcttaaagctgtaaagtttttaaaggttcctgttctgaattttcagtttggggaggaaatgaaaataggtttatctcatttactgactgtcagttgaactttatgagaatcagagctgttatgtccctgctttgaggatgctggagctgatgcttgcctctgatgaagatgctaatgtgagcctgctaatttttaaaatccggattaaatgcttttagctagctgtcaaaatcctgggaaggaagagaacgtactttgaaacctttgtttaaagtagcataaaaattagctcacatagccaattgttatttagttacaagcagatgcacacatacatttaaatgaaattctgcagtttcactcccttcccaaaggtgataatgtgattttctctacttgtgaaattgttgtaatttcacagtcttacttagatttaattgtgtttattaagatttgagacaaacgattccaattttattttataggatactgggtttttttttgtcttttaatttaacttgatagttggtaacacagaatatgtaggaaacagtaaaaaatatcaatacattgtttagttcaacagtttaacccaaagaactcaatgtggcaaataagcctttcttagtaagtagtacattagttcacttgacatgtaattaaaatagagccacatatttctcagtgtaatcactaataaaaatgccattataaatacagttgattttactctgtagcatttggatgattcttttttattttctacataggctaaagataatagcatcagattataaaaattcaggctataaaaatgacagaatgctacaggttggcaacagaataaaccacaccatgaatattgagagactctgcaataaatgtacttcatggcatttattgttaaaatatttacttgtcggcatagaagttgaaggcattggtatattgcttcaagttatggttggcaaagaccagacagcacaaaccatgtactgctaggcagaagagtgatagagtactgtattgtctaagggttgtgtgttcttgtatgatgaagaacaagaataaaggaaaaacagaaattacctattggttgtgtttgatcttggtactttttgtgttcctctgtcagtcctgtgatgaagagattaaagagaaacaacaaagtgaaagcaaaatacggataaacaagtcaagtgggactcagtctggaagccagagaaggatagctatggtaggaaaagaaattaaatttaacctttcattgtgtgccagcctctatgctcagcatttgggcatgttagggatattatcaaggaagttagtattctaccctattccttctcacccccaaaaacactcacatgttcacacacacttttactagtgatattgatcataataaccttagtgttttaggataaaaacagatctgagtcctggaagggatactgatggagtgaaattgcagagtacatggctctttttatcagatctgttattcagggtcatggatgttgtaaattatccaaagttcttttttattgtttttaaattttgctttaagttctgggatacatgtgcagaacgtgcaggtttgttacttaggtatacatgtgccatggcggtttgctatacctatcaacccatcatctaggcttttacctctgcatgcattaggtgtttgtcgtgatgctctccctcccctttcccgccactcccccgacaggccctggtgtgtgatgttcccctcactgtgtccatgtgttcccattattcagctgccacttatgagtgagaacatgcggtgtttggttttctgttcctgtgttagtttggtaaggatgatgatttccagcttcatctacatctctgcaaaggacatgaactcattcttttttatggctgcacagtattccattgtgtatatgtgccacattttctttatccagtctatcattgaagggcatttgggttgattccaagtctttgctattgtaaatagtgctgcaataaacatgcatcttcatgtgtctttatagtagaatgatttatattcctttgggtatgtacccagtaatggcattgctgggtcaaatggtatttctggttctagatccttgaggaattgccacactgtcttccacaatggtagaactaatttacactcccaccaacagtgtaaaagtgtttgtttgttgttcttgttgactttccttttctttttatctttacaaggtaaaggaatgagaaaaatatggaatgagtttctaaaataaggtttatggatatcactttttttctaggagaatcctagtttcagatgttcctttcagatcgcccctgggaacataggagtgaatgcatacagttaatgaagctagtgcctaatctttaaattgggaacaccagtcagccctggcaattaatatctacatattgaaaataattcacacataccacgttaatgtatttatttccatgtgttttcctaactcctgtttagaaggtagatatgttcctgtgaacctctttctctcaaacagggttacccaaatcatgagataaacatttcactttcctgatgccttaatcatgcaatcttttcatattgaaaagaagtacagaaagctgttagggtctaaaatgtgaaattttcacgactttgaaaataaagctggacacatcactgttgagcttatgacgtgcctcttcaggctgcatctccacttgctgtgaagttttattcacatttgtccttaagctactttaagggacacttttaaaaagctttacaatagataaatcaaagtggtgtattggcagatagctgggtgagggagtgcctgggacagactgcgaactccaccacctctccattcagcctgcatcctgcttcatccagtgaccaaatgggctgactccccgttttgaaagtgagcctgaaaaggaaagagaagatagataatctccagttttggagtatgatgtggcagaagcaatttcccccagtgttgaataaaaaaggaggaatttatcggccataatttccaaagccaaaccaacaataatgatgatgatgatacctagagcatcttaagattaaatatggatcatttatacacattcatttaattttttaaaaaaatatttgaatgtttattctaaaaacatgtgaaaaatctaggtgtcttttgttgttgtgttaggttttagtatctgtttgcctcatatttcactaatttttttcagcaaatttacattgagcacctatgatggcatattcactcttcgagccaatggggatacacaatcaataacaaactcagggttctcatggagcttacattctagtgaggtgcggagacaggcaataaaataagaagagctgtgatgctgacaggatgatacacatggtataaaataaaacaaaggcggagaatacagagagtaatgaagatgctgcaatttagtgtagccagagaaaggctggcatttgattaaagatctgaaagatcgaggaagaagccttgcaggtgcctggtggaagactgtttctggcagagagaacagcaagtgcaaagaccctgaggcaggtacaaagacaatagtgcagctggatggagtcctgagaacaaggggcgggatcagcagaacacgacgtcagaaatggaacaggagcaagtgaccttctgggccattgcagagacttaggcttttcttcaagtgaggtgggaaagtattaaaggagtctcatcagaggagacaggtgatccaattcatgctagcaaggtcagtctggctgctgtgttgcgcgcaggggaaagaggcagtgggtagaaacaagggaactagtcagggggctgttaagaaacacatggtagctgggtccaaagtggtgacactggaggtggtgagaagtggtcaaatagagtgtatgggagacagagcaagaggggagagaaagagagttgaaggattgctacaaggtgtttggcctgagcaacttagaaggatgaattgccattaattgggatgtaaagagctatggaaagagctttgaaaggtcactttttccatttttgacatgttagattaggaaatgagcctggagttatagaaggtctgggttgcaccacttaaaattttgaatttatcagccgatagagttatattaacccatgaaacagatgatatcactaaacaaatttagacatatgctcttcaacatttttagagactaaatgtggaagatgacgaagaaaaaccaaaagaaaacttgatgggggcccagagaaataagggtataccaagagactggtgccctggaatccaagtgcagaaagtactttgagaaggcagtaatcacctgtgtcctgaagtaaagccagagaagcacctttggatttaggaatctagagattatttttgaccttgataagagcagtttcagtggagttgaggggtgagagcctgactagagtggcttcattaaagaatgggaggagagatactggaaactgctgtgtagacagcactttcaaatttttgctttagaggggaggcaaaaaatggggtgggacctgtggtaagtggatcctgagaaggtcattggtttgtttgatgggagaacttctagcatattcatagactgaccttcctgtgtctatctggggattagatgcttaaatactgacagagatcttgtgggaacaggagttttgactggaagtaaagattgtgtaaacagatcattttggattatggggtctcctggaaatgccagcactgcagtaggtggcatgaggacactggcatcatagaaggagactggagggcagaccagaaggagagagaaggcagcagaggaggaatcatccaatccaacattgcctgtttgtattgtgtagggtgtgggttactgcagcccctgaggtgtcagtggaagttcttctgcatgccatacaagtttactctaagcgaaaccttaacacaaaagctttttaaatagaattccttctttcatgttcagcgcatctctgtgggaaagataactttgaatgggtttaaaggcaaggagggaaggccatttccatgcactagattctttaaaaaccagcatgcattctgttgagggactagaacagtggtttatgttaattaatgagtctctgtaacactgtcttctggggagtctgctaccgaggaatgtaggtgttcagatgactgaagtaatttagttaacaaggacctgcaacatatgatttaaaccagttatcaatgttgaaacaagcattaagtctgtgtatattgtagatgttgagatgaagactggatgcagagtctctgttcagcaagcaaccatgggagccatgacaggtcaggagctggtcctcttcttcccaggagtacagactttttcatccattcaccataactaggtgctaattgggaaacagtctaagcaattgattttaatcaaagagcttatgagatttggggagcatcaggtcttactattatcatcttcaagaaaagttacgttttgcctgtgtctccaaaaagtggaattcacattctttagggtataacacgctaatggacaaattacagacagtagacagtcttcattgtagcctctctttttacagctttctttttggaaaacagctacagtataggaaaatactttctctggattgaaaattaaaaagactagattccactaccagctaccatttagtcagtgaccttgggaaacaaaacttcggagctactctgttctaccatttgataaataggtataatattcttactgcatacactgtattcttatgtggataaaatgtatggaaaacagcaaagtatcttaagaaaaaatatttatcttacgagttatcacttttaagcttttgtattatacttctagttgatgttctattttttctcgtttttccagtatttaaggcacatgggttatactgagttaaggatatcatatgaaagaagagtaagatataacttagcttacactaaactgttcatagtaccaatataatatgccattgcctagttgattggtatgttaaatgttaaaatgaacattactaatatatgttagaattaatgaatacacaaaattgaagttattatataacagaaatagtgatgaaaatcacacatccaccacattaaaaagttgatttcattttccttttcaagatttaaagtgttaaactcattctggctggatgatgagaaagatatcgttctactgatttttttatactagaataatctttcattattattaatatatttaagtcttatctccaataagttcatcagtgctaccagttacaaatagaaaatgcatgtgctcaatttcaagaattaaaaataatgccttgggagtagcatttcttttctgtggcaagaggattgttggattttccaattaaagaagtctccatactggaaatgagtagtcagttatgaaaattatttttgaatggcgaatttgcatatccttaattgtattcatttcttttgaaagatcgaacttgaaatttatgatgttttgattggttaaccctgcatttctgttattaataatattgccaacagggttcccctatgactggggctctgagtgtctttcctgaataaatgcttgaatcataagtaggtttgttttacttaatgaatagaaaatatctaaagatgtactgctggttttcacatttacacacattgcactttttggaatgacagtagcatcctgtagctgcctcatttactcacatttggacttttctacatcagctgatgagaaacccttgaagtttctgaatgttggtgctgtctgttggccaaaagtgcagtttcagcagagccgtcgtcactgtctatacagtagtgtctgtgtgattacttgaatttttaaagataccttgcccttattttaaggaaaaaatgacttggaaatgaacaatttagagtttttatattaacagtaaaaagcatagttctcacgtaaaataagattgacatataattagattaaaagtaaggatgtcgagtcttattggacttagcattccattggacttaaaccagtcaacacagagtcagtcatgaaggaaaagaacaaaattaaaggcatgtacaaaaatgggatacctatttatgcaagatcagcacaaattgtatataagtattcacacaatgtatgtatgtatatatgtatgtagagtgtatctacagggacagatacaattaggcatcttgtaatgtgttttaggtctccgagactggaataacctccctatactatttaagtctattattcaatgcatattcaactttcatttttggaagcactctttaataaagagttaatgaagtcattttaggcattttagggaaggtggggtagtgggaaggggaagcagccatttcattcctttaagagagtgggccaaaattggttctatttttcagtaatagacaaaataaacaaatgaataaaccagtatttattatttcttgaccatggtgcttatagacataatattattgaaaaattaagagttgtggtatagtaacattaacattttaagtttgatgaggcgattttctttgcaaccaaataaagatcacgttcagctagatagtgtccgtgtggtatgcatgtcctacaaagtaattagtgttgttggatttgtttgtagctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggtatgtgtaatgtttatgatattcttttcacctgactgaagatccgtcatcttgttgattaggcattgtttcttctttgtgactttcatcctgttaatattttatatcgtggtttatcttttctttaaattatttttttacatagctctttgcagccactgctgcttgggtaagtggatgcagctttttcttgaactgaaggtgaagcagaattgtatgccctcgaagtaacacgggggagtcagatgctaaatgatgaagtttgcctgtatcatatgagtataactttttaaaaaattcctgaaaaaaactcatttgggaaaagccaaggtttatcaaagaatccatgctagaaataaaggtcactttattttcttagcctcagtctttttctgcccaaactataatctcagaatctgggggaaatgttttgaagttagttttgaaattcttttctgatgatttattcagacaagacaattcatccagtaattttgcttagaaatatttttcattatatttgtagaatgagaaagtaaatattattctaaagtttcaatcagtttacaactccaagagaaataacatgtctgttttggtgatacctcctaaagataaatttagctcaatttaactgcatgaagtttttgaaaatccactaatatcttggtatttcaaacaactttttatgcctgtggaatgtttgtgcaacattttgagactacttagagcacctgttatgagggaattctcaagctagaagaacagaggcttattccactttgcaaaggtcagcttcttattctttttaaagcaaaacatatgcttaaaatggttagaatcgtacatagtactcattttcccatttgaaataaaatatatactgtaaagttaaatttacatactctaatgctgacaatccatattttgtactgatttttggaaaagcatctgtagtgccccttttaaaataaaccaaatggaaattaatgacctatggtctaagtgggttttcctgtatcttttggaaccgagctagtgaagcagtctgctggaacgtggctgctggagggctttgtggcagcttctcttcatctggagccagccttgtggcttcagcaaccttacagccccatcattcatttgcataatggatgcctttttatccattatgcaaatggtatgagaggaaaattaggcaataagggaagacgaaaggagaaaattgctcttgcttattttaatattctatttataagcaagcactgtggtcttcaaatggccgaacctcagagtacttctgtgccggagaatttgttttcacctctctcttatgagctttgtcagggaaaaaagattgttttcttcagcttttttgttggaatattgaaacaacataatatcgaatgcaagaaaaaaaagtcagccgagattccccttctttgaaagtgtggactgtctacttcttccatatgatttttgataagtcagagaaaacaatatttattacatgagtacacaccatctaaatcccttactcataataactcatttatttaagcctcgtcatacttaattagtcggcttttattatttttatcgtttaagagttgaggaataggtacagagaagtttagtaactcagcagaaatcccatagctattaggtggcagagccagaatttgaactgttgctggctgtggtgtgagaaaccattttgctgtgctgcctctgacatgcaattcctaaaacaaccaactaatataactgtcttggggtttactttgagaatatatgccaaaaccctgaaaatactaaactccttggtctacaatctcatttcacttagtaccagattaaatgatgagactagctcactgttaggtgggaaacattcccttccaaccatttggcctgaaaccttggcatcacctccagttccaccgtttccttctacctcccccactctgtcagctattcagcttccttgtccacagccaccacagcaggccagagctttgccatcaattagactattgcagaggcctcagactgacctctttctttacactgtgtgctttctccagtccctactgttgccagagctgcctttctaaatcacaaatctgattatgtaatataactcccctgcttaacgaccttcactggcttcccatcaccctgagaaccatatctaaactcgttagcaagctgatgcagatggttcctctgaatcagcaggagaaatttgggcaaggatgaatgacgtaaaaaaatcatcccttacccactttcatggttctagcagtttgagtactttgcatttctggaacttaaaaagcaaagaaaaaacatatttgtcaggtttttcagatagcgaagttaaagaaggaagcaacacagccagctttggtctccacccattctgttttcctgttgttggctccggggcaggatgtggccataggctgtgcacctccagatggagagatgtggttggcagtagaggcagtattgatggcacttctgggagtgtgacctggctgtcctgtctggtccaccctgaaagcctgcttaggtgaagaatgggaggggcggtgagaggagttttgcagcacctgtgccccagcagttcctcctaacagggtgctcatgaaatgtcagccattgaacccaggcccttcatctcccttccccagtcagctagtgtagccattggaactggttgtacttttcacagctcattcacccaacctggtacaagagaaatagggcttaattttttactggttttctcactcttaaggccactttcttaagaaaatagcaaatttaatcttcattggcttacattgcttttcttaattaagcagacacaattcaacaaatattaggaatcaagagatttttgtgattacatcacattgagcacccaaaatttatgtttttctggaatctgatatcaaaatatactcagtgttcagtataatttttatatttctttttccaacacaagataaccatcaacaatattctgttaaaaaccaacaaccaccttctccatgtaatgcatacagaggttgactcctcccattctttctttatcttccaggatgtaatacttatgcatgcatattcatattcccaggcccttcatgatctagctgcttcctctctgcccacctttattgctggccagtctttcacagtcaccttaacttgcagccactgtgaaccacttgccattccaaatttaccaccttcaaacctctgtgcctttgcagatactgttctctttagctggctcattcctttgtctctttactgtatagtgaactcatatgcaccttttaagttcaagctcaaatatgaccttcttcatgaagccttgtccaaatctttaaaacagtacagtaggcttacagtaagtattatttcttaattcttcatctaacaatcaagggttacaaagacgaacagcagaaatctactgacataaaggggttcatagtctcatgccctataagctgatggggtatatatttttaattcgtaagatgagttttaaatcaagtgggcaaccacataattccaacctcattcatctaaattatttcctatcatttattttctaatggattttctaatgtaatgctgaatgactgaaccctggggattcagccctaagtagcaaatcactttcacactttaagattctgtggctctgaaatcagccaaagcatgttaccatatagtacagagattgctggcctgagagttcatttaaatgatgagatgtggtaaccaaaatcccaggcgaaattggaaagaatcatattcacatgatctatttggacttaaaaatttatagttcgagaattttccaagtcttctctgtgaaaccccatggttcttctgagcatgtattagggtttcaatggatgcttgattctagttaataaataacatttattgagcgcttaagttctagatgctatttaaatttgttcattctccatctttggacaaataggattggttatgctagtgtggaagaaagggtgaagaagtctagaaagtagccaataaacagaatcccaatgcttatctaccccaaaacctcacctccactcaaaagatgtatgcatgcctcagaaaaacgtttgtgaaatgctgacctagaaatatgcagttccacagaattttataattagcaattgtgtaggtaatcgatattattttacaaatgagcaaataaaagttaaaattcaatgtgtactctgatgttgaataaggaactagaactggaacccacatttcttggcttctagaacagtgcttgttcagttgcatgactttttaaaaattaattgtagatttcaattatccatatattttaggtactatatgtgatagcacctcacatccttttggaattgagtagagtgtaaattaataaatagatactatgaataggtataaatcaaaagctactgagagaacaagaccaggaaatggaggtggagaaaatgtcttttaaatcctatacatttcagaaatgagtttgcttctgtcttcttatcttctcatcccgtgtgtgtgtgtgtgtgtttgtatgtgtaggaaagttccactaaaaccaatatactaatgggatccatagatgtggggttttttttaataacgtggatattttaatagactttctgattttttaagtatgtacatatagggccatctgtaaaaaagacaaattagtgaggaaaattattttgaagtttaggagggtgggagtctcccggtccttcccctgactagtccctacactgccttcatgattagtacctgaccacctactgttccataagaggctttttgtggccatagatcaaggttggcccaacccaatctttgtcccttgagagtcagtgatatggagctagttctagaccctgcagtatttgatctagctgtgtgatcaggataagtcatttaacctatctctatcagaaccaactttttccaaacaaaaaataaatcaggacaaatttgggacacattctagcaaagtaaaaattgaaaaccaaggctatccaggtcactccctgatgtgtcaccaccatatctccctgggccacagtttcctcatctataaaataagctgtcctttctccaatgggccatgatggttccttgagtgttttattaataccaagctgagtttgaatccaactccatgcctctgccaatttccctgctatggccccaattaattagtagttttttattttgtaccttttgataatttttttcagtacttcttgattgaaatttgctaatttgggttcaagctttcatgggaaaatatttatttagttaaattattttagcaatgtaatttaaatagtttttcaggataaaaagtactttaaacttggctgttaccatgcttgtgatctagattaccttgatataaagtaatctaagtttggagttgaagtggtattagctttattctcctcttgtgtgttaaactttgaagatgagctactttctatttgaaagtgattcttgtttttgagacttgaaagctgaaaggtgcctcagatgctttattgtttccatgtgtgtttgtgattcttcaaaaccgaaatggaaattatgattatgtgtttgttataatatcattattttcaaaacactgagttctctttctttgcagtggtgttcagcaaatactgtgtagctatagattcctgttgaaaattgtgaccattttctatctgattttgactaatttactgcataaaggaaacatatgggaacatttttctcaatttttaagcaaaccaaatccctttatggcgctgatcttcaggaaaacgtaaagaaaggggaagtttattcctttaattaggctgctgtgtgtaagtagctgctgtgcccataatgtgagtttaagtattggcatctgatcctagacaaacacactcacaccacacacatagcagaactaaagctcagggatgggttatgcttctgatgaagcctttgaattctgactacaaagcatataagcatgtgagggttccttgttgttggaagctctttgctgtaggctgtgaaacccagagttaaaattacccagagttaaaattgcgtagatgaattcataagttacaatttggtcattgagtttcatcctgtttgtttcctgttgaggctgattattcaaaagttagcagttatagaatagtttttctttctttttttttcctttccttccctgggagtctgttttttttttccccctccatgaaggcttaaatgaataatgttgtaattagctatggtaaccttgctagggtgtcatcaatcagtcatagccatatagtcaacaaagtgtgtgcttgctttctggtgtgactataactaaatcaggactaaggaggctatagtgtttctaacccattttgagcaccactcttttgctactgttgttttgttttaatttttttttttttttttttgtagcaatgggtcttgctatgttgctcaggctgatcatgaactcctggcctcaagcagtcctcttcctcagcctcccaaagcatgagccaccacgccttggctgttttgatttttattttagattttgttttcagagtagtgaaaaagtagctctgtggaagaatgtcacgttattcattgaatatttaaaattaatactttgtaaaagggccagtggtactagttaaagaataaagtcaatacctaaagacaagtagcccctaaaaaatattaaaaggtaattaccatatgggagtaatttttgtttgtattgagtaaaactatgagcaatattttaaatatacaattttgaatatgcctggcattacctccttttgcagatgaatatatataggcctcatagttgatcacttcctaccattttgttaaaataaaatgatgaagtttgcttgagaacatgctatagttttataaatgcattttaaatgagatattacttattaaaattatatagtgttacacttcagaaaaataaaaattaccaccatcctaacagaacttgtattttcatttttttgttttatattcagttaacttttgtattttagtcttatttcaattttctttttttttctacctgcttcagttacccttttgtctctttaattttgtgtgctatatctgatggctaagtttagcagttaaatttatactaagttggttgtactcaaataaaatagaaaattattaaaaggaatttacatgtaaccatttaaccaaaaatataagacagtacataaaaccaagctctcatttttgtcctttttccagctgtattttctaagttgattatgtgacctctaaaaaaacagagttcaccatctcccctttggcctcttaccaatgctggacccacactgagacggagtctgcagatcctctaataaacaaacggaatgaaaggtcacctttcctaccattcacttgatattagacccctgggtttttaagcctcttttgcagattgcttttaatagtaagtccagtgaagtcatgtttgcagaggcctagtccctaagtagtaaaaatattttcagcactgctgtcatattcagcttcttgtagttcccctgaccactgataaaatgatttgcagtttgtccttttaataaaggggaggaaaaaaaccaagccatgcacctctggcctcttccccatgcccccaccagtaaaaccaccatcgtcctcccttgcagccagtccccagctcgctctcttctgtttcaggcactctgaggcagccgaaacacagccacacagaattgccctctgttctctaaatacaagtactgcttttcacagcctaataaggtttaacatgtctattacaaaatgcctttaaattacttatctgtattaaaaaatttgttgaagttatgactcagattttttatttatacatattcatctttgtggccatgaaatagattacattttctcacaaatttctaatcattcctaaataaattatttatagtaaccatgctgattttcttttgcagtttgcaattcaggaatcttgttaacaatttaatatatggtaaagccctttttgtactgacaatgtaaatgtaatgtttagcctttaagattttttttttctctctgagtgtgtatgtgtgattttttaaaattttctttccacccagatgggcaggcaaaaaaaaaaaaaatccactaatttaattatttacagaagatccatcttaaggacaagtcactcagagttggacacgctttcgtgactggctcaggattttctcatttgctttatctgataaagccttatgatgaattatgccccaatatatacacatttggttatttactttttctgtatcttatttgaaattttgctaagatctttatttggcccagtgaaagtaggaaatactgaaacagcttgatctgttcattctcacaccccaaagtgataaggaaaggtgacagcctttgcttagcagtgaccataagagaagccatctctattttgcttaccccttttttgttaaatgtttaccagataaaagacaaagacctcccagatatcaccaccacaccctgtcaatttatctttgaaacaatgtattcatcatatgatacacagaaaacggtgctcattctgtttattcattggcttaatgggaaaatgttgatcgctatcagaaaataccagtaactttctaaaaatatcagaataaattctgattactaatctgtataaatatgagactgtctgccagattcttcaaacatctttacagatggaagaaatttggaactttggggggttttggtgtgtaaaattagaggaaaggaaattatgtggtacatcttattttctttattttctttttgtttatatggaagacttgactatggttatgtaatgtatgtttgtagaatacggtgtgatcggggaaaatgggtaggcttattaccttatcacaacctatttaaaatcataacacttatatttggtgttttaagataatatttactaaaataagccgtaacttcaatgtccattttgttttaaactgttggaaagaaagttgtttttatatttttttatactatttggcctaaaacatggcatagatagcaacaaactgaatggccttgtgtcatttggttctgtataattgtgatgatcaattaaacttactagtgtttttaaaacaaatagactttttaccccagagatctgaaagcatgaggaaaacttcttgttttagtcacagttcagggataatgtcctttgacctcaagactttagcttggtgttacagtgaactgcccttacggcagagttcagcatttgctcagctaacatctgctctttttagatgattggtcttaacgatacagttatgaaaatcagtatatcaagtgtcaatgccagagaaaatggtggcatgcctgtcactcccttcagttaatcaataattatttattgataacccagtagattaaaagcattgtgctaggctaccaaaggaatataaaataatacacatcacagattcattcccaagtagcttgcaatcaagttgacttaaaataaattactggatgagtctcttaacttggctaggattccaagccaagttatatatttttatcatatataacgattgttctaatattatggggtacacagttatcaaaccttatactgaagatcttacctcataataaattcagatgctcacagactcttcatgtgtaccattagtcagtatgtgatgtttcccatagcttggttaattgcttgtcttttactttggtcttcagttgatggggaggttcaaggtattcataaaattttaactttttagtctttgattcgacagtcttcattgactcactagtttggccaactttaattttatcttctattaagcaattaaaaataactaaggtctcaagtctctccatgactaccaacaatgtccgctactccccggacacgatctgcaaggacctaatgggttggtggataaatgtctatgcatccatccatccatccttctccctgaagacactccagtcagatgtactcttttaacggtaggtggttaatatagagacaagccttctacccaaatgagttcagcaggtgcactgtttagaagaatgtgttgtgcctagtctggacgtacttcttacctccttgtgttattttttcactgagtactgtgtaaattactgattggaaacccattgatgatcttttctctaaagctgtaggctgtacctcagactaatttattagcatgctattgagtggtttaagcaaatttcattttcagtccctctattctgacacaaaataccattttccagttgaatgtcaaaatagtgtaaacataattgccctatatgtaaacttatctgtgttaaggggtgaattgagaaggagcaacttggccatcttggaaaatggtctttgagaagtttggagaatgcatttagtgtctttttctcttttcagacaattcattacctttaaaaacttaaatttatttaaagtaccttccttgactgccttgttgccctgtttttaaaaaataatgtttagcatttgtttgatagttgccacaaacttgatgctgtaatattctgactttataataaggtgaagagttatgcgaggttaggcaaaattttcatctctaattcgtctcttgttaaaattaggcttttatcttagtacccaaaatattgtactttatatcttctctgatatcttgatgaagcaagtaggcaatggaatgtttccaaaagaaataaggatggagaaatacatagattatacaatcttacatatttacagcagtgtagtgtagaaattaagagcacaagccctggagcaagcctgcctgggtcaaatatggcactgcaacttacaagctgcatgattttcggcaagttacttaagccactgagtctgtttcctcacctataaaacaagggtaatattacctaattggatagtgacctaattggatagtcgcaagcagtgaatgaattcatacatatatgtacatgtaaaacacagagaatactgtctgccacataataggtggtatataaatctgctagtcactgttaatttcattattatatttattatggatcatttggaggaaaaaataaaaaaactccatgtatttaggtaattgattttttttttttttttttttttgagatggagtcttgctatgtggcccaggttggagtgcagtggtgtgatctcagctcactgcaacctccacccctggactctagcaattcttctacctcagcctcctgagtagctgggactagaggtgcgggccatcacacccagctaattttcgtattttttttagtagagacggggtttcaccgtgttggtcaggctggtctcgaactcctgacctcaagtgatccacccacctctgcctcccaaagtgctgggattacaggggtgagccagtcccacctagccatgcaactgatattttgatctggtcttttgttatccctttattccactttcaactttcaacccataagatcatgttctctctttttcacgaatttagattctggttgtcttatgccttctcctaaaccataaaattaaattttggtttttctctcttcagacttataagttaaatgctaaaatggcttattgaagccaaaacagtagccagggacattaatcagaatagtataattaccacaaaggtttcaaataatgccttcgtgcttgtttttagagattcatagaagggtaattgctttgatcttttttatcttcaactcaagtatttacttttatgtcctcacccttaactcggcatatggttcacaagaattttcttttacaattggtaagtgcatgctgtctatgtttgacagtccatttttacagggaataggaatttgtttttaatgttgttctcctccctcaactgacccagaacactgtattagccagggtgccaacaggaaacggcatactcaaaggtgtgtttagagagaatttcaaataaaaagattataggtatttcagaaaatgagacacccatgttctgaaaagaatagggagccttggtaggccgggcgcggtggctcacgcctgtaatcccagcactctgggaggcctaggcgggtggatcacgaggtcaggagatcgagaccatcctggctaacacggtgaaaccccgtctccgctaaaaatacaaaaaaaaattctctgggcatggtggcgggcgcctgtagtcccagctactcgggaggctgaggcaggagaatggcgtgagcccgggaggcggagcttgcagtgagccgagatggcgccactgcactccagcctgggtgacagagcgagactccggctcaaaaaaaaaaaaaaaaaaaaaaagaatagggagcctttaccagctaaggcctgaaaggggaaagaggagaaaattcttacatatctgatgagggctccagatgttggggagaggcccttagaggatcaaaatctgcaacctatggatggcaagtgcagccactttcaaagctgaagctggcagagagagaacagaacagataaacaccccaagattcctctcttcctacccactggtctcctgctgatccttcctgatggctacattcaaaaggcagccagagggaaaatggtcttcagaaggcactgagccactgaattagagcagcctccagggggccagaacagggcatagaagactggggagtggcattggagagagtaaccaacacaaacatctagtctgtgtgtctctgaggtgagatttttctacagcgctgttttttattaaaattatatagtgttacacagatcaataatgcttttaaaattagccaacagataattattaatgtctattaggcatggagtatctctattggaatataaaaattagtaaaatgcagtttttccctcaaggtgttcacaattctgtgcaacagttctcaccccttttctatttgtattcagacataacatgggtgttattaataaacacaatatgtcagtagggcagtagtcatctttttgtgatattcatgtgcacaaaagttgtacctacctttaggtaatattcctgttttggtgactataattccaccaactttattgctcagtaaagcacatcagctttcagcttgcaaaagtggattgaatgcacttcttttttgcctcctcctttcccaacattcataaaaatgacagattttggctgtgcatggtgtctcatgcctgtaatcctagcattctgggaggctgaagtgggaggatcacctgaggtcaggagtttgagaccagcttggccaacatggcaaaactctgtctctactaaaaatataaaaatattagccaggcatggtggtgggcacctgtaatcccagctactcaggaggctaaggcaagagaattgcttgaaccagggaggcagaagttgcagtgaacagagatcacaccactgcactccagcctggagagacaaaatgagaccctggcctcaaaaaaaaaaaaaaaaaaaaagacagttttaatgtaaaaataaaggaggtggagttagatggataaaatcactggaaatgaatacaaaaaattagccgggcgtggtggcgggcgcctttagtcccacctacttgggaggctgaggcaggagaatggcgtgaacctgggaggcggagcttgcagtgagccgagattgcaccactgcagtccagcctaggcgacagagcgagactctgtctcaaaaaaaaaaaaaatcactggaaatgggaggagaaaatggagagtaaataaaatcagatcaacagatgattcaatctttagactgccctagagtaaaggctgggatgaaggcgggcaaccagcctgtctgtctgccttctgtgtgtgcttttaagacgagacctgccaatgaacatgctttatcatgtcaaccacctaattcagtggagagtttatttcaggaaagacccatatattggcaggaacaactgaagctatttgttgttaatcaactgaataagaatatgaatatactcattcatttatattcaggaatatgaatggacagccactactcaccagacaatatatggaaaacaacaagtcaaagataaggacagtgtagaattgacaagacagtcttgaagaatagcaaagcttaccttaacagatatgtataaaggtatagaaactgattcagtgtaattttggcacaagaacagaacaatggagtagaatagaaattatagcaatagcccctcacagatataatcatttggcttacatcatatttggtattgctggtcaattcaatatctatatagaaaaaaatttaatatccctacctcacactatatacaaaaatcagtgctagacagattatagatctaaaggtaaattaataacaaaacaagcaaaaaacaatgagagacaatgtataagactatcttcataactttggtgttaggcttgtttctaaaacagaacacaaaaagtgatagccatgggaaaaattttgataaattgggttatgtgcaataaagaacttctgttcattaaaagactgaaaagaaaagccatagattctatgaagaaattttaacacatctgtctgacaaaggatagtgtacaggatacataaataactcctaaaagtcataagaggaaagcatcctgctcaatagaaaaataggaaagaaccctaacaggcacttcataaaatggccagtagatttatataaaggtgttcaacttcatcaatcgtgacagaaaagcacattaaaaccacattgcaaatttcagcaacaaaataaacaatgtagtatttgtttataacccaacatataaagtaaatttgcatgagcccatactgatataagtgattgtttgagtaaataaaactagtagtgcttagaggtaagggtaggagttgacaaatctttctagtagaattccaaataatatatatagatagtactttcaccttgagtatgggatgaacttgatgacttacttccaaagaataggatactgaaaaagaaaatgagtgaatccacagtagagaaacctggcaagcactgtttgaaccaagtgatcaagattattatctccaggcataattcagctgataccatgtagtctgaaaatgatgtgatgagcagggcatttcacctcaatggtattcttcctccaaatccatacccccaggctaatcatgagaagaacatcaaacaagcccaaattgaggaacattttacaaaatacctgacaagtcctcttcacaaagtcaaggtcatgaacaacaaggaaagattgaaaaactgttccagaccagaagagactgagaagacttgatgactaaatacagtatggtatcctaaactggatcctggaacagaaaaggtcattcgtggaaaagctggtgaaatccaaaggaaatctgtagccttgttaatagtaatgtataaatgttaaattagttttgacatacataccatagttacataagatgttaacataggggaaactcgattctttttatactatctttgcaagttataaattaattcaaaaggaaaagttggttaatacaaggccactataaattcatcagaaattactaaaatgaaagaataccagctcttggtgagcctgtgaagtaactaaacctcatacattgttggaaaactgtttgagtatccactgaaattgaaactgtacatgtcctatgactctgccatttcagtcctaggtaacctaggtaattctcaacagaaacgagcgtgtatattcactgaaaaaaaaatagaacagcatccctattcatatcaatctcaaattggaaacaacctaaatgtccatctttggtaaaataataaactgtggtgtatgcatacaatggaatactttacaacagtgagattaaactattacaatagcaatagcaagaaaaacccttagaataatttcataaaatagaaggtgtaaggagttaattccctctttcccagtggggcaatatacatctgccttaagttggtgggccaagcatatgtggctataaaaaaattaaaatgacaatctaaaattcatgcattaagcaaatatttattggacacttaactatctaccaggcacttttgtaggtgctgggaatgtagcagtaaacaacaaaaagattaaaactttctattctcatttagtttatacactagtgtgagaagacagtaaccataataaatgagatttttatatagtatgttagaaactgataaaaagttttgggagaacactaaaacatggtcaggagagtagggtgtctgatgacaagaacgaggagtctaatgttaaacagggtggcatttgaggaaaactggaagggagttggggagtgagtagtgcagattggttagaggagagaggaagggaattttgagaaaaattcttcatcttttttagcagggagtctatcaatgctatttaaagttcaaaaaaatcaagacattgtgtgtgtgtatgtacacacacacatatatatgtatataaatcttggagttatgtaaccaccaaaaaagtcaaaaatagaagtgctacaaaaagacaacttctggtaagttgagcctgtcagtgaaagggagacttttattttttatttttatatttccttccttctgcaaggtttgaattgttttgaaaatcacattttaaatggtcacattaggacacaagtaggccaggaaggagtgacattattaggtagagaaccttgaaaccactgtaattatatcttgaaaagataaatcatttgcacaatttagtgcttattattgatgaggaatttcttgtaagattgctgtcagctgcttcaaggagctactcaccctgttttctccaactcacagacgaccaagttctgtggatcaggcatgggtgtggcctagaccagctcagagcacagctgcaaagtctccccagatcctccccaagttaagcacacaagtacaggggcttggccacatgctgcagccaccagttcacactgattctgatagctctctttcttgccccactaatccacataacaatatgttgtccatattgctttgcagcatcgtgaaagtgctgactcatgtttcacaccagtaccaactcactctaacactcacaatctttcagctcaagctaaaagattttaattaggtatatggtgacacaaaacaagtgttctaattaaatttttgaaatgagtaaggaactgtaacattgcccctagataatggataaaagttcagtattaaatagactgcatgtactcacgcttaaattggtatagatgtaaaaaagaattagtcattgtatctgataaaaagtaatctattttatgaatttgtagtatactctgtagagcttgtcttttttgtctgattttacttgaggggaatatttcaaattgcatatatctgaaaggagaacgaatataattacctaaatctagaacaactaaaaatacttcagctaaagtatacaaataattggagtgctttttgtcttggttttctcggattatctggatgattgcctccattttctacctgatttagtgctttctacctgattgagtatttttcaggaggttgttactgctgttttcttagctcggtgacctgaagcattgattctgtgaactgttggtatagccaatgcagtttgggttgtccaactggtaattgggcctgataatttgcagacattatgtaggagtttctttatttggtagtttcattctcaaaaaaattggtgttattaagccttgagtaaatatagttgttaactctgcattgtggtcctaaccaacttataacaactgacatttatgaaggttccaaccgaggctttaataaacaatgcatccaaaaatgtaagcatggtggctgtggggggagtcgggagaggaaggggggaggagagaagtcagtttaaggaaagttagaaaaaaaagacaacatttgatattaaatttaatgtatttagttgagaattaagaggaaacagttcagcctgtgtggaggaaatcttcatgcattttattacctgtgaaggagttaaaaatataccaacctgccatattgactattgaagttaaagggcacttgaaaaacaccaggtgcaaaaagatgactctgaccttcgttccgtttcttaaaagcagaagatgaaattcccatgtgaaagatgccctccatatacttgcaagacacaacatccttatccttaggatcagaagttgtaaccaagagaatttagtatagacattgtaaaataactcttttaagcctctccacataacatagttgcattttcacagcttactattatttgtccaattcagtatataagtaactgactctaaccccttctttgggtcttcgtttccttatgagggctcctgtgcatataaaacttgtattgaagttgtatgtcagtacccgtcccctcctctgtatggaccttccttgtcgcctctctaaaaagaaaaaaaaatatgcatttctcctgttcatctgttttatatctatctaattctcagatccagccaaatactaagagaatagaggtggagttttgccttccctgcatctataaaacatctaaatcaaaattatatatatatttaatatatgataaaattttcacagtaatttcatggtcaaattagcaaaagaattaataaaatatacatttctctttaaaaggtctcaacttacattattggacaaatactagtaaattgctgtctgtaatagtcaagatttttcaatcttctcaatagtcagttgagactaatcaaaatagtttttacgtgtagtttggatgtggaaatgctaccactttatcactgaaattgctggagtttcatattgaaggtggaatgcacttaaaatggggtaacacacaagggaaaatttggcaaaatgatttcatggagtttcagatttaggccagtgatagccagggcccttaggagaagtagatgtttcccttttgtatttaatatgaataacattaatattaaaataaatgtatgtgtattcctttgtattcacaaaggaatgttattggatgtgtgagttgtcagttattctgggagatgtttaattcagtagcaggaaatggagcggccctggaatttgtaggaggggctttctcctctttgaggagccagatgtcatggttaggaggagaagggccatttttgcattgcatgtgtgagactggaatccccattttcacccactttaggcacttagatatgggattaatggtgcagatccatcaactaagagccctgtgtgaataccgagcttaagtctggcagaaggaatgtgaagcagtcctggaataatcatcaggaaagaattactgctcacctttgttccactgcccacccccccgcaccccaccccagatgacttcaaggtatcttaattcagcaagtgttcaagcaagtcattcagtacagccccagctctcacaaaatcttctctaccacgtttggcacgtctaataatgattataggcattgctacaaattcaatggtaatattgtaggctaccaggttagagacctctctaacttagtctgtctctttctcttctttccatttctcctcctttttcttccccttttccttcccccacttctttccttacatcctccttccttccctcctgcctgttttttccctccctttaactatctctctctactttccttccttgaacaattaaaggaatgcattaaagcccaaacaacaaaactgattaactcttaatgcttatctttctgaggaatgataatctatatgaacttgacaccaagactaaaagcttaagtggttgagtggatactaccaatatcaaaggggagaatgtcttctgtggaagataaatatttcaaaattggctatatcagaatgtgtgaggccataagctccaggaaacatacagttctaacacttttctggaaaaacaaagaggagaaaatgtcataatgtttatgttcttgccatgcaccacacacatgaacgtggctggaatttgaccaaatggacagagggtcttactgaaaccgaactgagcatctgccgccctgacttcttcagtggcagagggcccacctcagccacagttgttatatgtgaaaagccactggaaagaagtggagacaattgatgaagccccgtgtaccaagctggtttcatatggggggaagatctggtgagggttggggtgatgtgtacagaatagacaaaggagaaggggagaaacatctggattgtattgaaaaaggcttagctaggcgtggtggctcacatctgtaatcccagcactttaggaggccgaggtgggtggattgcctgagctcaggagctcgagaccagcctggcaacatggtgaaaccccgtctctactaaaaatacaaaaagttagccgggcgtgatggcaggcgcctgtagccccagctactcaggaggctgaggcaggagaattgcttgaatccgggaggtggagcttgcagtgagccgagatagtgccattgcattccagcctggacaacagagcgagactctgtctccaaaaaaaaaaaaaaaaaaaaaaaaagagcttatctgggcccatatgctagggactttcttgggtatggcagatctctgtcatcttttgattggatccctttacttcacttagacctgtgtgtcacctttgctgactgcaaggaaagctcagggcctgccagtatgtaacccaacagttgtatcaaaagcacatagggcataacaatatccaagtaagtttctgaattatccttcttcaaaacatgtctatacgactatgaagtgttatcgacagagcatatcaaccctaaactgtgatttgtctcagcaatggcagttactgatttgtaataatcagtactttacctagtttaaatcataatctctccttgagctcttaaatccacttttgtaatccatcaaactaaatgtaaatccctcagatggtgacatccaacaactagttattgtctttagccagtttatatttttaacgtacgcaattaatactatatatgcctgttagcattccaagatgatttttagatttcacagatgaggattgttcagagtttctcagtcttttctgtgaagtttaaaaaatctctttggcaaaaattcctaatgtgatagcagctagaagagtaattttcattggaatgaccttttcgatgggtaatttgacagacgcttgatggacagcattcttccatctctcagcccaccttttacgtcctgccataaaacgctggagcaaaattttacctcagctgataagattctcaatagtcatgtgttgcatatctccctcagagcagttcctcaaattttgaaagctgtctttctttttgaggtatttttcattaccaggagaaaatgtttcttttagggagatattctaaaacaatagcacaggtactgaacaaacttcccaagtgtctaagggactctctcgtgtggctgtatagtattggtttggtgtattaaatggcactctcatgtactataagagttaacacaacttccaaaggtgcctttcctcacaataagagaacagatttgactttggaaaaaaaatgtgactatgaagtacccagttaaaataccctaaaagaaaaaaatgaaagcacttactggtaaaatgaagacaatcaacttgcaaataaatgtgtttttaagatgtggccctggggtgacatgcaaattcaaaagactaatattttctctgggaataaaacattttggaagatattttatcttgaattctgaaaatattgccagaatagaatgcttgttgattgataaaatatgtgctttcatgaagaatatttcttatggtattacctttgtcaaagaaaagattctgtagtttggggagataaattataaagatgatacatacttatttgtgtatgtgtttgtctgtcttctctttctagaaggtatgttgatgaactcagatcatcatctcttttgtccactgttgtatctgtagtccctggcacaatgcctggtgtgtagtggtcagtcaataattatttgctgaatgaatgcataaacaaatcaaattaacaaattaaactctagattttcatcttcttcagaattttttttttcagtgttccaagactaaggacttttcattgtctttcaagttgggatcttaatcttatttactgcttttcatacaacaaacgtgttaaacatgtatcagaaaaaattagaaacattatctgtgattcttatatagggaggtgatttcattccattagctttttggggggaattcatgggtttgtcactctgttaatccagctgacaagcagaatccaaagggtgacagttagaaggctggaagggaaagggattgttgatgtggaaatgaaaaatagacttcagggaaagaggtagttagatgaaaatatggcaaaagagagagagagagaaacacctagagtccagtgggggtcatcacattgcaggaggaggatgagggcatgaagggggtccttggagaagttctggagagaaaaaagctgagacaaaaaggagatgaagttatggtcaagccagagaagacattggattagcactgcatgcatgataaaccagccatgctactagtataattctgacattttggaaatattgaaatcctacatgaagaataaatggtgtctgtattttctcagacaatgaatttgttcaaaacaattgaactcatggacatagagagtagaagaatggttaccagaggctgagaaggtagtggggggcatgtggaggacaggtggggatggttaatggtataaaaaatagaatgaataagacatagaatgactatgacacacaacatggtgactatagtcaataataatgtaattgtacatttcaaaataactaaaagattgtaattgtttgtaacacaaaggataaatacttgagggggtggataccccattctccatgatgtgcttatttcatattacatacctgtatcaaaacatctcatgtactccataaatatatatacctattgtgtacccacaataattaaaaataaaaataaatgaatttgtgacctaaataagtatgcatgacagaaaaagagaactttgttcaaaaattttagatttggaaattgttcttcatatcatactcctgaactgacttagtttccactcacatttaaaataactgaaaaagagaaatgagagaaatttacaagaaatggtgtgcccatattatagggtgacagttaaatgctgtccacgccctgacaccacacacccaaagaagattagatctatttaacaatgaaaagaatggactgctacaaaaagaaatacgttcatctctttgttcttgcattaaatgagaaatatttatcaggtactgttcatgttctaggcactgggtggtaaacctccagcagtgcacaagatagcagtggtctttgctgtcaccaagtgtactgcctagtataggaagtaatcacaaaaacagtttaaatgtaatgttaaggggggtacaggctacagtcagcactcagggcagtgtccctttacctaagaaaggagctggggagggtaagttcaaggacgatttttcaaaggaagtgagggattgaccaggcaagtggaaatggaaagaatatttctaggattgcatgctcaggaaaaagaaaaaagccaagtatgactgccataaggaatgtaaggtagggaaaaattgggagagaagtatggtgagatttttctggaaaccaggatggaaccagaactggaagcacttacatagccaaggtaaggagccaggacattttactagaggccagcgaaaggatttatttttaaattaaatattgaatttgagagttttctaaaactgtggtatgtatgaagagaagcaacgcagtgagcacccatgtaactaacacctgatttgagaaactgggctgtcattatctttgaagtcccctctgtaccccttgctaattccatctatttcacttttctgtggaataatcattcctttgcttttctttataattttaccatgaattttcatatctctatggagttcattgtttagttttgtgtgattttgagctttataaatggaagtatactgaaaattttttctgtacctttttctccttaatattgcactcctaaggagtatcatgttgttgaatgtagcccattatccattcatttcattgcagtatagtttccttttttaaaaaaatggatatttgcattatttccaggtttttgctcttacatgcagcataactataaaccaccttcttcacatagtcaatgaacatataacaattttctctaggtaaatatacttagaatgaaattgtttgtttatagaatatattacttttgaaatatattagataatgccaaattgcttcccacagtaattttactaattctttaaactactaaatgtaaaatagaattccagtttttacatggtcagcaaaacaatatagctagattttaaattttcgccaattttatggatatgaaatatttcattgtgattgagctcaagcatattttaatgtaattattgaccattcagatttactcttctgtgatgttcctggtaagatttttgacaatttttttactcattgatttgcaggaactctttaaaaacatttttttttttttactgataataattgtacgtatttttggagtacatgtgatatttgatatatgcatacaatgcataatgatcacttcaggattattagcgtatcacctcaaacatatcatgtttctttgtgttgggaacattttgaatattctcttttagctatcttgaaatatacaacaaattattgttaactatagtcaccgtaccatgctgttgaacactagaactaattgtatgttgatacccattaacaaacctttctttctccctcccactttccagactctagtaactatcattctactctctgattcacaggaattatttacatattaagaacactaataatttgtagattgtatctgtctgtgtgtgtatgtgtgtgtgtgtatgctacaaatatcttgccccagttaatgacttgtcttctcttcctgtatgttttttgatgaccaggaattgttgattttaatagagtcaacatttttatgtttgaatattttgtatcttatttaagaaatctttccctacctaaagccatagagagactcttctactttatataaaagtttcataattttgtctgtttaaaagtttactttacataggataactttttattttagcatatggtgtgagataggggtacagcttttccaccatacacgtgatcaattgtcaggcatcatttattataaagcctgtcatttctctacaggaacacacagctattataattctgtgaaattcaaatgtcttagtatttctgtgtctgcttctggatgctctaaactatttcagttgtcattctttttttttttttattatacttatataagttttagggtacatgtgcacattgtgcaggttagttacatatgtatacatgtgccatgctggtgcgctgcacccactaacgcatcatctagcattaggtatatctcccaatgctatccctcccccctccccccaacccaccacagtccccagagtgtgatattccccttcctgtgtccatgtgatctcattgttcaattcccacctatgagtgagaatatgcggtgtttggttttttgttcttgcgatagtttactgagaatgatgttttccaatttcatccatgtccctacaaaggacatgaactcatcattttttatggctgcatagtattccatggtgtatatgtgccacattttcttaatccagtctatcattgttggacatttggcttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgtggtttcctgactttttaatgattgccattctaactggtgtgagatggtatctcatagtggttttgatttgcatttctctgatggccagtgatgatgagcattttttcatgcgttttttggctgcataaatgtcttcttttgagacgtgtctgttcatgtccttcacccactttttgatggggttgtttgtttttttcttgtaaatttgttggagttcattgtagattctggatattagccctttgtcagatgagtaggttgcaaaaattttctcccatgttgtaggttgcctgtttactctgatggtagtttcttttgctgtgcagaagctctttagtttaattagatcccatttgtcaattttggcttttgttgccattgcttttggtgttttggacatgaagtctttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatacggaatcctttccccattgcttgtttttctcaggtttgtcaaagatcagatagttgtaggtacgtggcgttatttctgagggctctgttctgttccattgatctatatctctgttttggtaccagtaccatgctgttttggttactgtagccttgtagtatagtttgaagtcaagtagtgtgatgcctccagctttgttcttttggcttaggattgccttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcccatcccttgtaagttggattcctaggtattttattctctttgaagcaattgtgaatgggagttcactcatgatttggctctctgtttgtctgttggtgctgtataagaatgcctgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtctgtcatagatagctcttattattttgaaatacgtcccatcaatgcctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgccgctggattcgttttgccagtattttattgaggatttttgcatcaatgtttatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattatcgccacaatttcagctcctgttattggtctattcagagattcaacttcttcctggtttagtcttgggagattgtatgtgtcgaggaatgtattcatttcttctagattttctagtttatttgcgtagaggtgtttgtagtattctctgatggtagtttgtatttctgtgggatcggtggtgatatcccctttatcattttttattgcatctatttgattcatctctctttttttctttattagtcttgctagcggtctatcaattttgttgatcctttcaaaaaaccagctcctggattcattaattttttgaagggttttttgtgtctctatttccttcagttctgctctgattttagttattgcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactctgtatctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgtttaatccgagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagaatttagttcatttatatttaaagttaatattgttatgtgtgaatttgatcctgtcattatgatgttagctggtgattttgctcattagttgatgcagtttcttcctagtctcaatggtctttacattttggcatgattttgcagtggctgatactggttgttcctttccatgtttagcgcttccttcaggagctcttttagggcaggccttgtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgagggtaacccgacctttctctctgactgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtaaatttggtcttttcacatagtcccatatttcttggaggctttgctcatttctttttattcttttttctctaaacttcccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtggatgtcctttctggttgttagttttccttctaacagacaggaccctcagctgcaggtctgttggaataccctcccgtgtgaggtgtcagtgtgcccctgctggggggtgcctcccagttaggctgctcaggggtcaggggtcagggacccacttgaggaggcagtgtgccggttctcagatctccagctgcgtgctgggagaaccactgctctcttcaaagctgtcagacagggccatttaagtctgcagaggttactgctgtctttttgtttgtctgtgccctgcccccagaggtggagcctacagaggcaggcaggcctccttgagttgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggtgcgtccgtcacccctttctttgactcgaaaagggaactccctgaccccttgcgcttcccaggtgaggcaatgcctcgccctgcttcggctcgcacatggtgcgcgcacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccctcctcagttgtcattctttcaattcttgtaattccataccctaactttataatactccgtgatatctgtcagggtaggttcctgtgttgttcacagccaagaatggtcaggctgttcttggccctttgttcttccactttaattttagaactggccggttaaatttcagaagcagaaacctatgagattttgattgggattgaattgaatttgtagattagtttggagagaattggcattcttacaatactgagtcttcacatgaatgaacatgctatatcttctctgcatttatttacaacttctttattgcccttcagtaagggttgatgatctcttcataaagtttttgtacctatttggatctattcctaagtacctgatattttgatgctattataaagaaagttactaaaatgttttgtttctgtttgtcactggcttagagaaattcagttgatttttttaagccagaaagtattctttagactttcgtggacactaataatttaactgagtctcttttaggggttttacacaattatgtcatctatgattgactattcttttcaaattattttatttttttactaattcttatacttgtccttcttgcattactacacttagagctccagtgttggatagaatgagtgatagctgattttgttcataatcttaatgaagactagttcatgtttttagttttgctatacatttatagatatataattattttatattaatttatacttgtatacacatctttaaatattataaaatatttacagtaatgtagatatttattatttatatacttaatatttttatttgttatatatagtgagtgtatgtgtatatatatatatgtgcatatatacacatataatcaatattgaaaagttgagtcagctcttattttcttattaaggttatgaataagatgacttgttgccaccaattctgttcagtactggagatcttaacatagtaaggcaagaaagacaaatataagaattagagaagacacggggaggggaacatcacacaccagggcctgtcatggggtgggatctaggagagggatagcattaggggaaatacctaatgtagatgatgggttggtgggtgcagcaaaccaccatggcatgtgtatacctatgtaacaaacatgcacattctgcacatgtatcccagaacttaaagtatatatatatatatatatatatatatatatatatatatatatatatgtgtgtgtgtgtgtgtatatatgtgtgtgtatatatgtatatatgtgtatatatatgtatatatgtgtatatatatgtgtgtgtatatatatgtgtatattatatatgtatatatatgtgtatataatatatgtatatatatgtgtatatatatatgtgtgtgtatatatatgtgtgtatatatatataaagaattagagaagaaatgaaaaactttttttttaggttaaggaagtttcttttaatttctaatcactaaaagtttttgatataaaggaatgttaaattctactaaacatttttccatatccactgaggtggttaaatgtttttcgcttttcatctattaatatgatatattgtattgattgagtaattatagtttcgcagtgttgccaggctagagtgcaatggcgcgatctcggctcactgcaacttctgacaccctggttcaagtgattctcctgcctcagcctcccgagtagctggggttacaggcatgcgccaacacgcccagctgatttttgtattttcagtagagacaaggtttcagtgtgctggacaggatggtcttgatctcctgacttcgtgatccaaagtgctgggattacaggcgtgaggcaccatgcctggctgattttttaaaatttaaattaaactggcacttctagagtaatctcaaactggcaataaagtgtaatcttttttatgcatcgctgggttcagtttgctaatgctttcttactttttttttttttgccaatattttcttcaggatgtctgtatctgtttttaagatcatcctataatttccaattgttgaactgcaaacttcttttcaaccctaaaatccaatggtcctataattcattatcgttgtcatcatcatttacctcattgctacaaaagcactaaggaaagaaaggagatggaaggaatgactcgttttgccttgttaaatggaagtatatttaaaatgtgatactctcttaagaatgatttttttaaaacatttacttagaatttccatggtttcatactgtctgaaattaattcatgaaacctttttctatgagtctcactaacttgctatagaatgtaccaagaaactatttaaaattgaattctgagctttgaacatgttctttttcagtttcacctgataccagttccaagcgcacccaatcttttctatccactggagatgagaacgttttccctgtgatgtttaaacttaattccagagccacaatcccactgataatcattgtccttttctcctatacattaaagtggtcttcttaattgctataatattcacaaggagcctattggaactggagtactctcagatgaagaacagtattgtaggtgataaagataaagtggtattgagaactacccaatttacttcagtgaattcaatctttcttaggaagcaagtggtacctgatatatttacctgaacttttggagtgataaggaaaatgtttggcatgcattcaggaccagagaaactttaaaggtttatctcagcaaaatagtattggaaaaatgatctatttacttatacgatacaagggtatttccagttctttgattctgggggtttgcagaattgttaccaatgagaaatataaggagtgttcaagtcacagggtttttttttttttatcgtgctccttttgcctgtgtggaagagtcatgcatctgttggggtatactgaacaggcagctttgtggcctactcctgaaacttttactggaatattattatataaaacacagactgaccaaggcagataccacatgctagaagagttctgggtagtacaacattaacaatattccctttcctatggtaatgggtgcagtggtgcacagcttgatttgctacattaggcttgttaaattatgttttcagtgtggccacggccttgtgttttctactgagtgagcctgctcaggtgtcacacataaaatctgttgctgatatttattgagtgtgtgtagtggttgggggacgagataaggttagagaaataacctttcttagttctggtttttattagatttccctaaaaattccatgtttgttatattatgttccatgtatgcctgaatatatggcacagtcacataaaaagcaatcccccattttcccaatgagaatacaacccttttaaggagatagatgaaatatccaaacgtctactcaagtttaattgattaacttactaagatatacattttataatcatatgcaaactttatttgagaaatgttgatcttttccatgctcacattttacaggttcattttattcaaacttatcacatgggttgttgatatgaatgccttcctatcatgggagcaattttttttagagtttcaaactgatttcctgagtacatcgtccctacttccatccatattgcttgagacactgaacttcttaaatctgtgcaaggtactgtcactagaagttttatcctgagacatgctttgcataacattagggccttagggttttttggtttgtttctgttttgttttgtcttttggttttgcaggtagaagcctgtaactttgactttactgtattgcttttacgaggtgttttttgtttgtttgtttgtttgttttttagacagagttttgctctttttgcccaggctgaatgcaatggtgctatcttggctcactgcaacctctgcctcccaggttcaagtgattctcctgcctcagcctccctagtagctgggattacaggtgcctgcaaccacacctggctaattttcatatttttagtagagatggggtttcaccatgttggccaggctggtctcgaactcctgacctcaggtgatctgctcacctcggcctcccaaaatgctggaaatacaggcgtgagccactgcacccagcctgcaatgctctttcagtggatagccaatactttcaattgctagaacccactctagggatcctaactctttctttggttcttttattactaattattcatcatttgtgttggaataggctgaacccctgtatcttggtaaccaaatacaacagcatttatttccttttcatacagagcccttacatatcctgatggctctccagaacaatagctttactgggagactctgacccagtgtgacaggcaccgtcagctgaagctgcaccgtccagaatacctggccttcctggttggcacgtgagagtgataaacctgggtggtctcaaacaggcagttaaaaactttgaagcagcacatactgcttttgctgttcactcattgatcagaacacatcagtggaaatggcagggaggcgtaatgtgctcctcccatgtgccaggtggcagaaaactccttgtagggcaaacaccacacggttgcacaatacccagcacttgcactggtggaaagttgttccaggctgatgtgcgccttatgacaacagtagagagcagctccacgatgagagaagctttttagtgttgaggactacattggagacgatgctgtcacctaatatatctcatacatggtattgaatgaagaaaaggagaagtagaaatacactgaaatttaattgggctcctttatggattaaatttaggaagaaatcttgagaatttccccctaaacaaaaatatatttactccattccctaatataagtagctacgattaacattcatatgacacatgtgagtagtttaaaaacccaactgcctgtcaattcccttaaagcttgtcaatagtcatgtggtagatagcatttatagggtgacagtgtatgtttctagcctaccagccaagcaagtcataaataagttttggccgtctctcaaacagccctgtttcatccccttgtagactgttaactacatttaaaaagtaaagtctaaagctttaaataggtcacattctggctctgacatttcagacagaccacatcattgaatggtgccagaccctgtgctggctttccttaatatttctttaagatgaaatctgtcctattcccacccctacccagcttcctctgcgactgacatctttacctggaggaaaacatttcattttcccaagtccaaattatatgcttcatttttcacagagtcatccttgtctcctctctgctgtcctgaagcagtgccttttctgcatcctggtaggctcaaccacttcttatctctgaccacatctacctcaacagctccagagcagcctccatcctctcgcgctctgatgtcctcctgcctgctcttctgcctccaccctgcctgctccacagcctattcttaacttgcaacaagagtccctcttcaaaatagccatcagatcaggtctttcccctgcttcatatcatctagtggctccccctttcattcagaggaaaagccacatttcttacaatgggcggattatttttctgttgatgccataagaaattaccacaaactcagtgacttcgtatgaatttattgtcttacatttctggagtctcgccggggtaatgcactcctcccatgtgctgggtgggagaaaactccttgtagggcaaacaccacaaggctgcacaacacccagcacttgcactggtcgaaggttgttccaggctgatgtggagcttaacaaggacttaacaagactgagttccttgctagaagctctggcagagaatctggctttttccagtgtgtagagaccacctgcattccttggctcctggtccccttccatcttcaaagccggcaatggccgtccggtctttattgtgctgtgccatttcgacattgactgcctttcctccctcttcacttttataggggaccttgtgattacattggactgagccatttagataatccaggacagtcttcctctgctaaggtcagctgctaagcaaccttatttcttctacttgcgatcttaatttctccataataggttcacaggttccagcaattaggagatggacttttttggggggcattgggggtggttattctgcctagcagggtacaaggccttcatgatctagcctgttacttctctgacctcatgccctactactttttcttacaaagtagggcttccccctgatggtgtcaccacctcagagacccatggagctaattatctcgtgacctttaagcctttgctcaaaagtcgccttctcagtaagctctgttctgaccactttactgaattgtagcccacagtctgctttgtgtttttccatagcacgtatccacatctaacataggaaacagtttatttttatgtttgttgtctgtaacataagctcttgcagagctcagatttctgtctgtttttcctctgttgtatcaccagcaccttgaatagtgtctggcacatagtaggcaaacaataaatatttgtggaataatggacagattcttgagagaatggcaaactgttttttaataaacataatttttttgtgtgcatcagatcttccgcatgcctccaagaggggcatgatatggtttgttttggggtcttccaaggtatttagtttgggaattggtttgttgtagacactcagaatacaccaaaaagaattacaaagtggggtctggggcagggaggcatgaagactttttcattttatcagtttagactggattccagaaacaaagttaaggagagtttgaggcagtttcataatcagtgtaattcaggatccaggctaggttgacaaggcaatggaagagtgcctgtattcttattcagagttggggtatcactatactgcttcttgaaattaccccctccaggtctttagccctgaaggctctttgttcttgtctcatagaggaaactagggaagagaatatctaatcactcagtgcattgtcagtgcagatgatgagaaatatcctgtatattctagcctgtgctcctgcttccgcaagaatttttctccctctgagtaaatgatttgaagagtgaggatttagaagaccaggtattattttttttagaaaaataaggttttgttataaaaataaatgaaatctatattttatcatttcaattcaggccctaagcatacacagtagttacctttcataaaacgttcttgcaataatgctattgcactgggctttgtaatgaagctttgatttgcatcgctattctgagaactttctgacaatggtaaggtaatattaggaaggcagaggaaatgaaatgaaatgagggtaatgtatgtccattgtgaaaaatgttaagttgccaaggcaatgtcatatcaataatattttcataaattaaattaagatacatggggcaaataaatattgcatttctctttattatcacttcaaatatgtgagggcaactattaggattaaaaccagaaattagacataaagcatctcagctgaaatgagagatgtgctattcgttggttcaacctgatgtgctctcaagattcttgtcacgtttgtttcagtctttcaatctctccccctcagtatactctagcagtccctctgctgtcctcctctctcatactctgtttcttgagacagaatttctgttgagaattagtaggagagtcagtataattccattaagcatcactttcatactccacaaccaaccttctagttttaaattctgttcttttaaatcaagctggttttcctatctttttctctcctgcttcctccctgtctcatcccctcccttcctaattcaccacctcactcccttgccctgtcttcctcccctttgctccctcttctcctctctagtatacacacacacacatatacacacagagagaaagtatacacacatgtacacaaaaagtatatacacacatatatacagcaagagaaaataatataagtgtgaagtatggatttaatccaaagtttgttacactgggaaagtgaggatgaagaaagctgaaggtggttggtatgaaagaatttgagtcctcattttccattattgggaagacaaaatatgatgtcccaaattgagaaataagtattaaaagggcacaagttttctatttaaaaatagagaggtcagcaccagaagaaacaaccaaaagaattgtgaataattgtctagagactagaaattagaactgtggctactcttttctcatcaagcctttcagatagtactgaacttcttaaggtttgtatacttttattgataaaatttaaaaaatttgacaaaaaggaatggattaagagatgcaaggcaaacagaaagagtattgatatttatatggtgaaggtaatgtaggtttaaaaatacaaagtataaaaaagcagaatgttagctaataaaaggtaaaattaataacccccaccaaaaataaaaaacaacaacttaatgattttgatcttgtgtgtgtcaaaaaacatatcatgttttaaaattattgtcttttattacaataattttgggggtacaggtggtttttgattacatagataagtcctttaatggtgatttttgaaattttagcacaaccatcacttgagcagtgtacactgcactcaatgtgtagtctgttgtctctcaccctcctcctaacttccccgcactgagtccccgaagttcattatattagtcttaggcctttgcatcgtcatagcttagctcccatttagaagtgagaacatatgatatttggttttccattcctgagttacttcacttagaataatgccctccagctccatccaagttgctgcaaatgacattatttcattccttttttatggctgagtagtattccacggtgtatatataccacattgtttttatccactcattggtcaatggacactttaggttggttccgtatctttgcagttgcaaattgtgctgctgtaaacgtgtgtatatgtgcctttttcatgtaatgatttattttcctttgggtagatactaagtagtgagattgctggattaaatggtagatctacttttgtatccttaagaaatctccatgctattttccatagttgtactaatttacatttccaccagcaatgtaaaagcatccccttttcactatatccacaccaacatctattgttttttgactttttaataatggccattcttgcagaagtaaggtggaatctcatagtggttttaatttttgcatttctctgatgattagtgatgttgggcattttttcatatgtttattggctgtttgtatatctttttttgagaaatgtctattcatgtcctttgcccactttttgatgggattatttgttttcttcttgctgatttgtctgagttccttgtagattctgccttctactcctttgtcagatgcatagtttgcgaatattttctccaactccatgggttgtctgtttactctgctgattgtttattttgctgtgcagaagctttttagttttattaggtcccacttatttatttatttatttgttacattcgcttttgggatcttagttttgaattctttgtctaaaccaatgtccagaagcattttccgacgttatcttctagaatttttatggttttatgtcttagatttaagtatttgattcacctaatattgttaggctttgtgttctaacccgaatctcatcttgaattctaatccccataatccccacgtgttgagggtgggacctggtgattggatcatggaggcagtttccctcatgctgttctcatgatagtgagtgagttcttgtgaaatctgatggttttataagcatctggtatttcccctgcttgctcttctccttcctgccaccttgtgaagaaagtgcctgcttccccttcaccttccaccgtgattgtaagttttctggggcctcaccagccatgctgaactgtgattcaattaaacctctttcctttatgtattacccagtctcaagcagttctttataggagtgtgaaaatggactaatacgccatcttgagtttatttttggataggatgagagatggcgatccagattcattcttctacatgtggcttgccagttttcccagtaccatttattgaatagggtgtcttttccccaatttatgtttttgtatgctttactggctgtgagtttttggctttatttctggattctctattctgttccactggtctatgtgcctgtttttataccactaccgtgctgttttggtgagtatagccttgtagtgtaattggaagtcagataatgacttcagatttggatgcctccagatttgttcttttgacttagtattgcttcagctatgtgagctcttttttggttctatgtaacttttagggttgtttttctagttctgtgaagaatgatgctggcattttgatgggaattgcattgaatctgtagattgctttgggcagtatgatctcatttttaccatattgattctctcatccatgaacatgggatgttattccatttgtttcaacgaaatctatgattttttttagaagtgtttaattgttttccttgtagatatcttttacctccttggttaaatacactcctgggtattttatatttttggagctgttgcaaaaaagattgagttcctggtttgattctcagcttggttgttgttggtgtatagcagtatagcactttattttttttgatacatgagaagagcttcaataacaaaaacaaaaactaaaagaagagtggaagaaagagtggtgcctctttaaaccattgctgatcctagattttttttaagggatgagatttggttccacatttggtgcatatcatagtgtgtcaggaaaaaattttcttatccaacttggggcatgtttttctggaagttgagctttaaataatgcatagtcgtgataaaggattgccacactgttttacaggcacaaataatctttttttttttttttaattgaaaggagtagacttttcacttaaaaaccaactcttctaataggaaagttttaggcttcctttaacataactattttattgaagtgatgaatttcccttctgtactttcaaaacaaatttgtttgttttcctttaaatggaaaaaaatgtgcctttcactgccctcaacaacgttgacctttgacattaatataatacttaagaaatgtattttagcccagttcttcctttctgccttccacttgattgctctactattagatttataatgctgaacaataaatgcaattcagctttatgtatctctagactaaataaactgagagataaaaccgagatagaaaacctaagaatctttaagtatagaacagggcaaaaagtctttctctagtaaatcaattaaagacttgacaggatagatgttaggagaagttagaatatttgtttatgataatattctacatacattatttcatgtgatggatataacagtcctcattttagagatgacaatctgtgtgtcaaagaggctaagtgatttccaagatattgcagcttcagagtagcctacacagataagttacagtcaaaaatcaagtacatgagaagagtctcagaaatgaaaattaccatccaggctacactgtgactaatcataataaaataggaattaagagggaaaaataaactttacaaatattaagtgaaataaaagatagtgcccggcatgtagtaagggtacaaatatttgctaaatgtatttatatgaagcaaattaaacaaatttatgcaataccttatttttgtattatatgattaattctgctttgtaactttttaaggaaattgagacatttgggatatttatagtaactaaaataacataaaattggtatcatctaaatatttaacattctgagctgactagagttcgaaatgttttgtgaaaaattccaagatattttctagaaaaaattaattgatattgagtcttagagtatattgagtagagaaaaacataccaagaaagtatgttaatcacatttctgtttaaaaatagaattttatagtgtacacaccagccgggcatggtggctcatgcctgtaatcccagcactttgggaggcagaggcgggtggatcacaaggtcaggagatcgagaccatcctggctaacacagtgaaaccctgtctctactaaaaatacaaaaaattagccgggcatggtggcgggcgcctgtagtcccagcttctcgggaggctgaggcaggagaatggcgtgaacccgggaggcggagctttcagtgagccgagattgcgccactgcactccagcctgggccacagagcgagactccgtctcaaaaaaaaaaaaaaaaatagtgtacacaccaacatattaataagttgtgcttatgtttttagttatgggtcataggttattgtaacatcttttttgttccttttggttaccagtactttgacttttcctatgacaagtacatattatctaaaaattacctgttaagttttttaaaaagtgatggaaagatgtggaatttgaatgttgatccttaagttcagattaaatatgtttcagtatttagccaggcattgtgctaaactctttacaatggtatctcacctgttcttcacttcaacccatgaggtagatattatttgttttcattttatagagaaacagaaaactaaggtgctctctctcatatttgaaagcttgactttagtgaaccaatatagtaatatttttccaagcaggcaattttaaacaacaatactgttaacaagctgaaaagaaatactgagagagagaaggagtggagagagtcgggggagatcagttccttcattatactttttttttgaagttaagtaattgatacatattaatacaaatgtttaatttaaaatttcccacagaaataccaacatgtccacaatatagtcaagcatgtcagttcaccagctgctgcttttccctgtagtcatccctccttgcagcctctgtgcatgaactcctctttcaatctgtgttatttgccctcaagatctatgcacagctgcaatactgaaaattccttttacctttctcttgggctgcgttctctttattgagatttcatagtttctcatttctggtttagtccctcattttcatgaagctgacttctcagtagctttctaagaaagattacatgagagcaaacactttctgagaccttttatttctaagaaatttttcactctaccatcacacttgatttatagtttggctgcatatataattctaggctagaaatctatttgcttctgaatcttgaatcgattgcattgctattttgtagcccccagtatggcttttgagaagtatgcttctattctctttttacattccagacatggatttttttttctctgtggaaacttttagcatcctctatttatccctaaagttctgaaaattcagagtggtgtgctttatcaagtctatatattttcagtgtggttatatatgatattttacctttgtcttcaatatttaatatcagcacttaaatcctcttcacattgtctgttacttccagattttttctactgattattttggccttttattttaaagggtttcctcatttatctgttatcctcagctgtatgtttatatttaagaaggatccccttaaaaagctgattgcggctctctggtgtatggggtttagtggtggaaggtatcccctaagctggtagcaccattaggctaattggatagagatcctgcctattcactcttggctggtagatgttgttatccactggccgtgtattgattatctgcagattatatataacttagcagcttaaaatgacaaacatttattacctcatacagatgattactgtcaggaatgcaggcatggcttagcttggtgattctggctcggggtttcccaagagtctgtagccaagctgtcatctcaaggatgggtcagagggctcactcctcagctcacatgtgtgggtgctggcagtcctaatttcctcaggttgtcagtatgtccctagggctgcttgggacatggcagctgcatcccctcagaacaagtgactcgagagagaaattaagaggggcatgctctaaagacagaagtgcagttttataacctaatctcagaatggacataccagtacttctttctgtcatattttattcatcgcacagaccaaccttggtgcactgtaggaaggaactacatagtgtaaatccaggcagtggggcttgctaggtggccgtcttggagacaggctgccatggacttcttttctcaattattttccgcagagaaagactcctctccatgtgccttacctgaagatttaagcctgggtgacagtgtttagggaacctagcttggaaataaagaaggggtctcaccattcagtatttgactcttccttagttttctgggttttttttttttacaaccatgcatcacactcagcctctgcagttatgcctggcatcatttagatcagaattggtcagcctacccagaaaatgcaactctgatttgtacaaggaggagagaagagaatgggcagtctctggagcacagactgaggaatggaaatgggccaaggcctcgttgggcattttacaggctttctacccatcctcttgccatcagccccaccctgaccttttaaagcagctgctttccccaattcctgagctttcctgggtccctgcaacttggttggcctccctacctctgtaggatgtcaggtctcagctgtctctcttctggagagagaattaccactgatcctggtccttatgttttcacttcccatcttccaacattttgttaacatcactcatctccactcattttctcctggttttcttcgtatttgtgagttttacctattttactatttcactgtctttgtggtagttttaggatggttgaatttctgtatttagcctgccattaagtatatatttccatttttctgcttgtataatttccaatacatatcctgatagatagtatttcctacaaaatttacttttagaggaaaaattcaaaatgttagcagactaatcagcttatcctgcccaaagcttttgagatgagaatagaatggattatgctttccatgactcttttgatttctggctgctttagaatgtagatttataagaaaagaagagtaggtgaaaatggtcagtagtatactgtctagggaatgagcttagaattctgaggattttagatttctcttggactgttgcttaaaagtaccactcacagcaaacacttgatagcttaacgcatacaaccgcattaaagagatagtgttttaactgcacatataacttaactatttctgtatttatcttcagttttcagtgtttaaacctgcctgtttcttacattgttggaatcatggaaagaaagctataaacaagttggaagtatttattacaatacctcaaggtgaaaccactaaagtccttctgtgggtaatttattatactgcgagatctcagacacatgagaaactgtcctgaactcccaaatgaaagcacttccaaaatacagcatttctaaaacgagtaacctttaacttatctagcataagcagaagaataagatatgtttaaagttttcatgtttttgctgatagacttaaaatctacgtagcgtttcctagattctgactttgacttgctcacacgctgtccctacccatgcaagctagaatctttcctctcccttcttgatttcaacatgagtttagaaccaaaggaacttttacttggtccggtgacagtttcccgtctgagacttccccacgcaggcacagagccatggcccctgggctgtttttatttgctctaattcaaatgccaattctaatttgctttctacggtgctcttttgttcgtctgtcttcttctagtatttataattgataactgtagtttaattattcaaaatcattatttttagatgtttaaaattgttttttttccccttcagacttgtatataaatgtcattatctcctgagaagtggtataattttcagaagcagagaatacattatcttctcttgtatccagtggtgtagtgtctgtcggggttcccaacctctacactattgatgctttaggctggctgcacctttgttgtggaggggctttcctgtacgttgggcgttgtagggtgctcagcagtgtccttggcctctgtcattggatactaataacatgcccacttcacaaatttaatctttctgtaagactcagaaatacataggaacagaaacaaaagcaaaaaatcagtatcgactgcttcttgagggctcactgcctgctgtgaagcagcatctgcaggtctgtggtcagcgctggaggttgaaaaccattttaaatgagcaactgtggcgggttcacagggtcaaagggcagagttcctgttgggatgtgggaaaagatgtgatctctactatctcagtggcaattccacagccaatggaagtaagcaatggaacaatttagaccatttgagaaccaaggtgtcaccctactgtgaaatctgcagacagagaaggcatttcatctgtatttttaccttcaatccttgtctgtgtctataagttcacattgccgacagcccacctgccagctctgctaccagaattgccttgctaaccagctttactcctggaatttaggaaagtctgagaaaagtcttcatctattcatattggcatgctggtacttaaattcaatgaaagtaagagtagaaccatgtattcaataaaaataagaatagctttatttgcatgctgtcactagtatcaacctaacttcttatgtccttttcaagtaagtcagtgaaaaccagaaatttcctgacagctggccttggaccgtggctgctttaacctctctgcaggggcaagtacatttctgtcattctgcatttgtgatcctgaggtctgactgtcacatgtacagttattggcatccacagggtagaacttctttcttatctatagttcccaggtacagagcaggaaaggagaactgcagccaaggggtgatatctaattcacaactgggatgccccagtgtgtgtgccgaggagaaggtacctgagtaatgttattcattaacatttatttctgggctttggccaattggtcttcctgtagggttatttggcatgttctaataaaatgtgcctatgattgagattatcttggattaagaaaataacttattcaacaagtatttattgagcatctcttctgtgttgagcactgtgctagagagtatagcacagaacaggccagatacagctctggtgcagcttgtagtctagtctaggagaggtagaattgaacacacatgtaactgcaaactttgagaagtgccacaaaggcaagagtattcaggaaacccagtttaattagagtcagagaaggtttctgtaaagaagtgaaatttaagctgaggacatttaaggcagaaggaatgtaactgtcataggcctgtactgtaggctgcaaagatcaacttctccatgtctcatgaatagttaattatgtatatttcttattttagcacctcacattatgcagttgactgtcgaacaatgtgagagttagggttacagggcccacatacagttgaaaatctgagtataacttgcaactccccaaaaaacttaactactaatacctattgttgaccagaagccttaccaataacataaacagttgattaacacctattttgtatgttatatgtattatgtatacaatatgtatttttatgtattcttacaataaagtaagctagaggaaagaaaaaattatcaaggaaatcataaggaagacaaaatatatttactattcattaaatggaagtagatcaatataaaggtcttcatcctcatcatctgcctgttgagtagatggaggaagagaaggggttggtcttgctctctcaggggtggcagaggtgaaagaaaatccatgtataagtgaacctgcgcagctcgaacctgtgttgttcaagggtcaaccatactgacatgtttacatgtatttctccttggcaagatgcagaccgagttcctagaagatagggatgatgtgttattcatataggtataacccagtcttgagcttcacaacaaacaggtattggatgatagttggggaattgagtgagtgaactaatgaaatgaatgaatcaatgaatgagtaaattggaggatgtaataaaggtggttgacatctgctttgtcctccgtatccatactttcttactctagatactgagaatctcttctgtcagtcatcttgtgcagtggggtttctttcttacttagttttgaacaattggccctatttgactttgcatgcccaggcctcagcaccttgcctggcacacagctgttcaatgagttatgagtgaatgaatgaaagaatgggtttattttcctgatcgtgagccttattatgtaagcttgcttgctgatgtctgaaacctgcagccttgcctgcctacctagaccgtttctgcactccacctgaggccaccactcccaacagttacactgaagttgatttgcctggaaatgcaaaatgggaaaaattggttttgtctctccaaaataaatctcaaaactgtctctttgtctgcctaggccaaaccactatcatctctgtctagcactatgacaataatctcttctttcgtctctctgcaatctgttttccacaaagcagcttaaatttatattttaaaatataaaaggcaaatataaaatataaatgtaggatttaaagtattctctaagtcagattgtgggacttacctgctgggaactgtaatggcctcctctagcacatagaatgaaatgtaaacccttctgcacctgcaaaacctatcttttttgaccccgcctacctctgttggctcattttgtgctctttttccctttgttcttcgtgctccagccaccctggccttcttcacgtaccttcacgtgtctttcacttacccaactctcattcccttcatgaggaacctgcccagaggagacactcaggaactctttggacacattcatggctttttagtccactgatttttagatatgactttacccataggatcatttctttccaaggaaacgttaagcagaacctcaacacataaagcaaatgaaagtaggggtactctgattcccatggaaacgaggatcccaggaacctccggtcctaaggcttcttctgaaaatataggtttccagagatgatggtttgcaaggcattgctcaggtccagtagtgcctgtctgacttctgtgtttactttgactggcctctttgaacttggaccactgttcttttaggcatttagaaattccttcctactcaactgaactcctgattctcaattcttagcctactgtcttgaatggccacacattctgctcttaaaatgttaaaacagtctagatgggaagatggatggataaaaaagttaaataaaacttgtatatggttaacttccagatagttcctctaagcaccaaaagagtccagagaagcaagagtttaagggtgggggctacagagatactggaataatccatggaagtgtctagatttgagaaaggtctttgaaaatagtaggaaatagtgagaaatgatgcagatagtctactatgcattatggtttgacgaaaaacataaagggaatgagacagtttgggtaatagaggggcagccatatcaacaaagcatgtgaaggagtgtctggcctgtagatatgtaatgtaaggtcacaaatgcttaggggagttggaccagtgccataacacagaacattataccctaactaacaaatgtgaacatagtagttactgttgccataaatatcatgtcctcagaaaaatatataattcagtgagcaaaaatttattttaattacattccagctcttgcttctgaagatccacctggttattttgctgagcctcagttgcccccccattccttttctggtcgaggacatgatggcagatggcaaaactcatctattatagttatttctttactgtttacagagtaaccattccctgacctcaaattctgaggtcatcgtatcaaagcctcctatgcactcattgttttctacttctgagaacatctgcccagcctggatggctctcttttgtataacatcccagcattgtctggctttgctcactggtcacagccagggttctcatgctcatctagtccttccctcaccttcacccatgtcaatgacttgcttaattacttaatttctgcttaattttttgatagcctgaatgaaatggtcctatcctcttcctgaatcatcctatgtaggtgctctccaaatcctggccttgtcactgggtgactggcagaaagataggaccattgacagaacagtgaggtcaagggggagctgacaagagggaaaagataagttaatttacaacacaattagtataagcagaggtgatgtttaggtggttacagataaggaactagaactctagtttgaaaatctgtgtttttaaataacactggaagataaagttcattcctcaggtattcattccttaaatgtaaacatatgctgttgccaggcactgtgctaaacactgtgagtataaaagtgagttctcactttaatgcctttaaggcattcactctctggtgtgagacacaggtgtgatatagctgtataatatgtctacatatttacctttagcgtaatctttccatgtaatactcagatcattaaatctggaaagaaggaaggaagtctaaaagtgagtactcactttaatgcctttaaggcattcacaccctggtgtaataaacagatatgatatatctgtataattttattgtatctacttatttacctttagcataattgttttcatgtaatatccagaacatgaaatgtgatcatgaaatctgggaagaaggaaagaagttaggagaccaacattctaccacttagtagccctatgactatagcaacccttctgaacctcagttttctgatctgcaaataagagcattggacttgatgaagtgttttcagttgatctcttgtgaaatcagatgcttttccaaggattccagaaacatttgatttcaaatgcttttttaaagtgtgatgaaaataactcatgcacttaaatgcattatgtaccaaaatttgcctcatcaggagagcctcgtttttcttgacccaaggttacaattacaccttataagtttggacaaaaggttacaaatttgatttagcagtataagcaaaaaaaaaaaaaaaaaaaaaaaaaaaagcacgctgattaataaaatatgctttttgtttctttcacctatagttgtttcatgaaatatttgcttggcccaatgagttttgctgttaaagacattgccatcaccagccctcatctgcaacatctacttctagctctaagcagctaagattttttaactcatgtaataaagttgatttatacttaaatttatcagattgggtggttctttttgacttaacagcttattgatgtataattcataacatattgttcacctacttaaggtatacaattaattggtttttagcatatgtacatagttttgcagccatcatcatcaattttagaacatttgaacgatgccagaaagaaaccctgtacttcttagcaatactccccaatttccctactgtccagcccaaccttaggccaccactaatctactttctgtcttgatagatttgcctaatatgaacatttcatgtaaatgaaatcatgtaatactgtatgtggtgtgttgtgactgccttttcccgcctagcatgttttcaaggttcatccatgctgtagcaagtatcagtactttattttctttttactgccaaataatatttcattttatggatatgccaaattttatttgttcatttataagttgatggacacttgttgtgagcactctttagctattatgaatagtgatgctgtgaacattttgtaccagtttttgcatgtacacatgttttgatttcttccaaatatatacctaggagtggaatggctggggccacatgatacctctgtggttaattatttgaggaaccaccaggctgttacccaaacctgtggcaccactttacattcccaccagcagtgtatggtcccagtttctccacatcctcaccaacacttgttatgatgtcttttttcttatagccatcctagtgggtgtaaagtggtattcactgtagttttgattttcatttctctgaaggtagaatggatggtttttgaaagaaaagtttcagcacaacaaaggcggaaactttgtttcaaagttacagaaaggagaaaaagatattagggatggaaacatataagtcaaagttggttagagaactgtctgagagaatagggcatggcagaggaaatctccagagagctcatttgtccagattatagccatgacacaagcttaatggcaataaagttatagtccccagaagaaaggcaggggtgtgtttgtgtgtagctacctctcacacacccagtttttccagcacaaagctgttgccgctttctaatctgagtggattggggatattcactcttactccccacctatatcccaaccctacagtccacggtcttttctgtcaccatgtcactgattttatagttcccttcacttaggatgacttctttattcatccaaatctcatccttaagacttggggacatcaggcctacctgcttggagcaacctctctgacctcttggacgatgttaacatcctttttatcccttgtgtggcatttaaagaggtttgcatcacacagcttggtacttagtgatacaattatcttgtatcattcacattattttatatgtggtttcaagtatcccagtgggttcattgaggggaaggaataggtttatacaatttgatattgcacataaaactagaagcatactaggtgcttagtgcatctttgttgagttaaataagagggttattcttctgttccatctaaactctgcttggaatttcataaacacaggcaggttctcactggctttgggaaaaaatacccctcttataaattcattaatacaaagcaaggggaagagttgatattttaagtttacattcaggtaagattacattgaaaattataacattttgttcaatctgtgcttgttacctacaggaccttgttatatgtaggaaaattatctttgaaacctctgtgtgttgtcgaagtcagatggctaatattgacccaagctggcatctccctcacttcacattggggatcctgttgagttgtcctcaaggctagccttttggaccactatactgcacttctgtccttaagctctcaatgtgaaatcagagacaggcaaagtcaagcaaacaaggcaaaggttaatacgagcaggctaatagtcaacagatgggagtcttcagcctgagtgagatcccgctagaggccttcccttcagagacccaagaacagttgaactggaaatttgaccaggaagggactccctaagagaccttgcctctgagcatgtcagctgaaaagatggcagagttcagagaaaggtgatgggagatggtgggcagagaaagcaccagttcctatgtactacctccaaaccagaaatttctaatacagcaaataaagcaaattggaatgatttcatgaacctgtgtagaggtctgcaactggaaaggatgtcctgaaaagcactattttatatagtttggtagaaatacatccacactgtatgagtctcaattttaaaactcccttgaggattaggaaacagattataagtagctagaatgtaaaataataataatttagacattgttttggaatgataaagtttattgtacatggtaaggaaattatgtattgtagattttcctgattctgggcatgcattgggaccacaggttatggtggctcacattttaggattgacttcccaacggctgctcacacagcctctggaagtggtaactttggaaggactggttgcaaagtggaaccagagtatattgcagtttcacaagcaggaggtaatagcatttattgagcaactatatgctctcttctctctctcttctcttctctctctctctctctctctctctccctctctctttctctctctctctctctctctatatatatatatatagttaatcttttcaatgaccctgtgtctttctttggatagaaatttaaaataaacttccattttaaatatgaggaaaccaagacttaaggaggttaaggaattgggtctagtaatatatcaagtcaatggcagaaacacagggaactcaggtcccttggattctgtagcactggttttattcctacactttaccccctccattgtaagggtactaaaatcttcatatgtggtcaaacaccttttacttttattaggagaaaatggaaaagaaaatccaaatactccaaaaaatccaatgcaaaaactccaaaatatcaaaagctacctttttcaaacaaattcagttttttattactcttactttcataatttgctctttttagtaattatttgcttacttcattgcttagatttaacaatacaaatagatgataaaaatctaatgattcagttagttatattttaaatgttatattattgtgtcacaaaaagtagacatgtaatgcatgtcttatctaacattacctaaaacatactggcttccctatgtaattctattatgaatactatgccagtatcttctctaatcattccaatttaaacatagtatctatgactggattgtaacagaaattggaatttgccggccaacactgaattggaaatgcttccattcaaattttcttacaaatgatctttagaaatgtattttaaatttcattctagcgaaaccaacttagagtgaatcttaatgggctagaacaaaatagattttggattgatttttctcataaaatatgcaaagccctgtttttaaatagagtttttccccttcaatattgttctttttctctgtttagcaaataatttgtctaaaacgtttctttttcagattttagttagattacaatagaattaacatcttagaattgccaaggtagatggaagatgaagagaaaatccggattccagaccatgctaacttcaagccagtgttttgcctgcagctgatctcaagaattaggtgaaagtttcactatgtaacctgttttggggctcaactcttcataatacgatcattcattaagtaatataaccatggataattgtaaaaaactgggacactgggttttccccccttactccacaggtcgactaggctgacagtatacaccagaaaacaggcatgcaaggcatccttctacatctttctcttttgcttgcctcttgttagttacaaagatacatactgtgccaggcactaagctggtttcaacagctatttatttagattgtgtgaactggagctgaacttgaacccaattaatagcaactgaacttgaacaaactgatatgaaatcattacaggctcagttccctggtccattatccctgaagagatcatccgacagcactccaggtgccttttctatgccaaatcttggtgcagtgcccaatcagagagtgtcggggggattagaagttcggttgcatcggagttagctcattaccacatttgtgatcgctttcacagagaggagaggtggtgatcccactgggcaggattgcagagaaggctttgttttcaacaccatctggcacatggttggcactcattaacacagcacaatgtcgattaaaataataattgtacgtggcagcaatgctgcttagacaggtccccacctttggccttccagcaaaggaaattgaagaaagagaaggctgaggagttgcctctggtaactctggtctctgggtttgcatctttcttcatgcccacacctttttttttttttttttttttggtaaagaagctacttttttaaatgtatgtatttatttttatttttagcagcagtacccccccaccccccgccaaatccccctgtttttttaaactgggaataccatgagtctgaccttgttcgcagttcccaaggaccctaattacagagctccggctgtagctggactcccaattcaatactgcagccaggaaatatttgctgaaaggggattctatgcagtcatatttcttctgcaacttgaattatatataattaagagttttaggcttttctcttttaaaggatgcatggatgaactcaatcattcaggtgctgagttaagactacactgcctttccttaaaaaaacagatgtgtatttacttcggcagctccagatcttgactctggtagcatctacttgatttgctgtttgggggataggagtgcagatttttgaaagaaattgtttgagtttgaatcctgtttctaccatatactaggtgtgtggtgaggagaaaatcccttaactcttggtctcccttttcttcactgctgctatggtggtaatagtcatccctaagctttaggatttctgtgaatataaacaaacatgtaatacactaagaataatgcccagtgcagggtgagctcttgatatgcattagctatgatcatgtatgcctcaccatcattttctttctttcttttttttttttttttttttttgagatggagcctcacttctgtcgcccaggctggagtgcagtggcgcgttcttggctctctgcaacctctgcctcctgggtacaagtgattctcctgcctcagcctcccaagtagttgggattacaggtgcacccccaccacacccggctaatttttgtatttttagtagagatggggttttgccatgttgggcaagctggtctcgaactccacacctcaggtgatccacatgccccagcctcccaaagtgctgggattacaggcctcactgttattttctgcaagagtttattcttcctccagattgtgcctcatacctatttaaattttttattcccaaatgataggatttactagttgtagtgatgtaggtagtggttatgtggacatttgtccagatatgttgatcaactttttttggtaggacactattatttaattccttgtcatgctagaccaaggttagaagaagccaattgatgtgggtaatttcctcatagatctataataccttcataccataataattaatgaagcacatcatttgtttccagagcagattatgcatatcttaaacaaaagaaataagttgtatatttcaagcctataggtaagcactataactaatgatcatgtggttttctctggttgtggaaccataaacagcatgccctctggcactgtaatgatttgtgttctataatactcagtgtaaccatggtttttattctgtttgccgtttggtatgtggaaaagccttcaagaaactggctttttgcaggagtgtttacatatcattcatgccaccaagagaagatgaccgacattttagatgcagaagaaagattaaatgcattcagtttaactagcggcactaaaaagggctgcatctttgtattgttgctgtttatcttctttccagcagtggaatattgagcttccccaggctgtgattcaggtattaatgccgattttaggtcgggcaagagtgtgttcagtctgcggcacttagatagcaaaggcaaactgctcacggctattagtcaggagtttctgtatgccagtgattgcatgcttgtgactcataatcagggtgattcacagcaaccgttagatgggcttgctgtggctgtgtttttcgtttggactgctgtcattgccaaaagtgtcagcctttctcctacagatctgaccgtgtgacacatgcacagtgccctttggttgtgctgaatggctcaccactaacatcatggctaagttttattatcttggaggaattgtctctcacagtgagtcccaattagacaaatgaattttgtgttgttttctttctgaagtgttactctgggattgttgacagaatttgtgccacagtgttctcttgggcagtctgaattccagattctctatcttggtttaactatgctctcacttgagaatcagcaaggagatgtcatgttatctgtttttctgtatacgtggagctgtatcggtggtctgggttcctgctgagcagatacataaataaccacacgtctctctgggtttaataccagcccggttctgacatccaaggctgactcctattccatgttttgccccaaccaccgaacacgatgctctgacccctcaacacacagatgccttgtacctgacctaataagttgagtcagcaacctgtatttctgatttgtccattaattctgtgtgtcctggttgagacccacttgcatttctgcatgcttgcttaacctacgcctgtcacaactacctctgttcctttttgaacttaacaaacatttatacagcccgcggtacgctagggtctgagcatacaactgggaaaagatagataggatctctgttctcatgaaacttcccttctggctcttagaagttatacatgtaaacaaatgcacaagagtctctctgatggtaacaatgcaatgaagaaaatgaaacaggataaaggaatagagagcaagtaactatgacagggctattctgagagtagagggaaaggtgggagaacattctacgcagagggaccagctagtacaaaggcactagggcagtctgggtgaatttggaaagatagagagccaaggaggccagggtggctgcagtgtagtgggtgggcagagaagagccagatgagacagagtcaagcctgatatagacagtcttttttctattttattttaaaatatttaatttacaaataaaaattgtataaattatacatgtacagggtgatgatttgatctgtgcatgcattgtgtacttattaccacaatcaaatcaacacattcatcatcatccttagttaccatttgtgcatgtgtctatatggtgagggcacttaaaaatcttctgtcatcaaatttcaggtaaacaacacagtattattaactatatttaatgctgtacatgagatccccagaatttatccatcttgtaactgaaggtttataccctttgaccaacttctcaacacttcctccaacccttcatccatggcacccatgattctactgtctgcttctatgatttaaactgttttagattctgcatatgattgagatgagatactctttgtcttttggtgtctggcttatttcgcttagcataatgtcctccaagtttatccatgatgttgcaaattgcaaaatgttcttcttcttatggctgaacgatattctcttgtttagacacaccacattttctttattaattcatcagtggacaccgaggttgttattgtaggtgttatttacacctatcttagttattgaagtaacgctgtaatgaacatgagggtgtagatacctctttgagatattgatttaaattcctttggatatatgaccaaaggtgcaattcctttggatatatggctggaccatagggtacttattaatttacacatttttaattttttaaggaacctccatactgttctctataatgactgcaccaatttccattcccatcgtgcacaaggcttcccttttctccacagcctttccaatagccagctgctatctcatctttctgataatagccatcctaacaggtatgaggtgatatctcattgtggttttgatttgcatttctctgatgattagtgatgttgtgcacctttttatatatctgttggccatttgtatgtattctttgaaaaaaatgtctattcatgtcctttgcccattattaaatctggttatttgttttttgatattgagctgcttgaatttataatatttttggagactaatccctcatcaaatatacagtttgcaaataatttttcccaattcataggttgccttttcattttgtggatttttttttcctttgctgtgcagaagctttttagtttggtgtagtcctgcttgtttgcctttgcttttgttgcctgtgcttttagtgtcatatccaaatatcattgccaagatcaatgtaaaggagctttttcactgtgctttttcctaggaattttacattttcagatgttacatttaagtcgttagtcttttttgagttaatttttgtatatgaggtaagataagggcctaatttcattatattgcatgtgtatatttggttcacacagcatcatttattgaagagactatcctttccccattttgcattcttggcactcttgtcaaagattagttgaccatatatgcacaggtttatttttgtgctctctgttctgttccattggtcaatgtgtcttgtttttatgccaataccatactgttttattactgtggctatgtacttttgtaatacagtttaaaatcagggtatgatgcctccagctttgttctttttgctcaagattacttttggtatttgggggctttttgtggttccatatgaattttagggtttttttctgtttctgtgaaaaatagaattggaatttatataggaattaaactgaatctgtggatcactttgggtagtatggacattttaacaatattaattttttaatccatgaacgtgagatctctctccattaatttgagtcttcaatttctttcaacaacatcttatagtttttgatgtacagatcttttacctcctcacattaacagaatgaaagataaaaatcatatggttctctcaacatgtgcagaaaaattcaatattctttcataattaaaaactcttaatagattatttgaccaaattcaacattctttcatgataacaactcataacaaattaggtatagaatgaatttatcgcaacataacaaaggttctgacaagcccacacctaatataatactcaacatgaaaagctgaaagtttttaaggttaacaggagcagactcatagtcgacagatgggagtcttcagcctgagtgaggtcccactagcggccttcccttcagagacctctaagatcaggaaccagacaatgatgtccatctctcaccacttctattcaacatagtcccataagtcctagccagagcaattaggcaagaaaaacaaaagacatccgaattaggaagaaattaaattgtctctgtttgcagatgtcatgatcttttacatagaaaaccctaaggaaaacccaaagaaactgttaaaactaataaattcagtaatcaattcagtaaagttcgggatataaaaatcaacgtacaaaagtcagttgtgtttttatacactaacatttaactatctgaaaaggaagtttagaaaacaattccatttacaatagcatcaaaaagagttaaacatttgggaatagattgtaatctggtagatcttggttagagtttattggattttaatagaaatggcaagaaacaagaatatgaagcaggaaagtgctaaaatctgatttattttgtgtctctgtttcagcctactttatttaagtatgatctctagtgccaggttgctagccctatctcagtttctgactcatatttttgacatcagctttaaaaatgttcacaaatatatatgcacttggttttcattattttgctgtgtcaaatacagaacagatttgttttgggtattagagcctttctccactattcaccaccatcaccctctactcacatcattgtctttctacagaaggccgcctttgactccgagagacataacctcttctgcctctgtggtgtctttgtgcctagtacttaccacttcctttgctctacctcatcctataagtgtctttcccctatgggcttggagttctttggagggagtccattttctcattcatctaagttttccctagcttccagcttagtgctttgaacatagtaggggaaagatggatatatagatgaatggattacgaatacccactaaaatgttcagtctgctatgaagccctcttcaacagttagaattataattctccctcttgctcctacagcgctttccagtgactgcttggaatctttagtggcattgtgttatgcattagtatgtatctttagagccctttgggggtcaaggactatgtcatagtcatctttgtttccccaggatttaacacagtttctagcatttagcaatcttcagtaagtgcctggacaaaagatgttaaacaggacataaaactccaaaaacagaagggctgtggaagtgtattaccagacagaaccctgggctagatgtgttttcttaaggcacttgtaattcctcagaaacttcccaaaccaatagggagttgcaaacctgctatggagcatcctccaggaaagcagctttggagctatttttcccgccaaactcttttgaccataacacaaagccagaaattgattttgcattgcaagccagtatataactgttctgcaaaacaaaaatgcatctttactctgtaatacagtccaatatcttctatgccctctgtggtatagaatgctgatcatgaccctttaaactgattttaagactcgtgaataggttgcagcccacagattgagaaaaccctgtttttgaggacagagatagtcccctgaggtgagcttcagaggaagaagcatgagctttacctggaacccataatatctcactgtactctgactgtttgttgaatatttgtataaatttagcaatgaccaagcgacaaccaattaaaacaaggcatcctggccaaaaagaatcaagttgtgtagtggagacatctttgtcatttagaattgagttgtttgaatgctgaaaagttgttagagataggtccaccagtcacttagttcaccatatccaaatacagcattgtgaatatttgaggtaaatgtgttgcttctaaaatgaaactgtgggcccactgagatatagggaacttaacgtttcttctgccaatatgttgacataaatattgatgttgttaagcatgtatgaataggagaactatttcagtctttttatctctttaaaactaatttaaatctgagcattaaaagactgtttgataccatatgtttgttttagataggaaacaaaatctattctaaacataagggcttatgaaatctgtattctgaacataagagcttataaaattagtatataggactggaagctatggtaaattgtttcatggccacagattcctcccgtgttagtatgcatggccctttgtaatgtgaccttgctgttcctcctgtccagaggggggtctgtttacccaacccttgctaagatatgttgcttttatgctgtgctaagaatccaacatttgctcagtaatgtctttttattgtggaatgtaagtccagcatgaaattgttgatttttctctttgaagaccatttaaaagctacttttgaaagtgaccaaggtctgtggacatgagcatcacaagccttttgtgaaaatattagatagacttcaagaacacaaccaaagactgccacagactagaaagatacacatcacaaatccatttagctgtgtacgtgaaaggaacaaattaaaaggttcagcaatgtcactggcatatctgagaattcaacctatttcattttgagacccacataccttatctgtgaaggcaactctgtgtgtgcgttttccaatctagatggatagcatagaatgagatgacctagacaagcacagcacaaagacagttgtgatagcatccgaactttcatgtgtagcttataagggcaattcctccttttctatgtaggccttttttgaaaatagcactgtgcattggtttgcttaccctgagaagacctgaaagatgagattatgatctttcatctcaaattaaagaaggcttgtctcaggaaccatttgacaagttcaaacgctgctgacttagatactggcctcttatcagcaccttcaatttaatgtttggagtgagtggtaggcctatgttgttgaatttttatcatatttcccctcatcttggtagattatgctttaattcactattctgtgacttatcaatattgtctgttttatgctattgagctataataaataaatagcgtaatgcagtacttacaggtagtgaaattgaggcaaaatgggcttgtgacataggctagatcaaaaaggtattacctgcaagttaataagtagctcagattctgctataatttgctttattcataggtcttgtgggggaaaaaataaaataagctttctcgttctgataatcccttaaaagagtcatgaagttttgatctttggcttatttgatttatttttaattgatagaaaccaagccattcctgtgcctctcaaaaatctatctgtggaaaatattttaacttttaaccaaattatgtcttcccagtattagtgaccctctatgttaaaatgtttttcccttgaaagttagaactccaatgttgttagaagagtttgattctctttttgaagaatcatagaaacacagtacagttttgtacctgtggcctttggattttgattcacattgaatttgatgccaggagttacatggaaaagtcaataataatccgtggatcattgccttactctgacactgggtgaattagcctgctggggtaatgttctccagcttgtgtaatgggcctatctagtagcaagacagcagccatatgaaacacctgggtggtcttccagagtactttcacatggattagatttcagttatccaacgtgaggtcacaaaggcttagacagctgggctggtgccacatcatgaacagagtgcgacttcttcctaccggatgcataatgtaaaaggtgcctgaggttaaagctgatccttgggctccaggagcagatatgggtcaaatgaggtctcaaaccacagttggaaatgttgggaaagtctctatacaggaaagaatcagattttcctctggcactttcattaggcatgttctctgccagaaaagcctagtttctgagttttctggattgagctttatttgattaacactggtttaaagttttaggtgttattaagcagaaacagaagaaagggcctgagtggccctttcctgttacacagaaaacagcatttgaggcacataggctttggaataaaatcacctttttagtgttcttagagataacagtggctccaaagcccaccatttttttccagtcttgccaggaactttgaatgatccaataaaaggtaatgatcaaaggtttcaaatgcaactgataaatcatatagatttgtattcaggatgcctgaaattgacttgtggatgtttctcatctatcaagaaggacttggtgatttgaatttagtactttgatgttgcagtaattgtttgcaactgcagctcaatggcctgaaggcattgctcatttctccctttctcttcttgcaaagagctcttgaagtattcttttacaggctgttctcaactcactgggggctgtgacctaaaatttaggataagagaatagttccataaacacttggtacagaccaacaacaatgccctaatgagccatcccaaatgtgcaccattctgaatcaatcatcccaagtccacaccctcttcactggatatatattaagattcacttcatggtatttataagggaattactaaagaaatcatggggaaaagattcctctacttattattttagtcaaggtatttcatatatttataagttacaaatatctttcaaagtatattttaaccagttcctcaatacttgaaaaaaatgctatagattatctccttttggaagataatctatttcttcctgctatttcaattagattaaattaaaacactcccaaattaaggctttctggtaatgttttctaaccgtattctgtagtttcctcaatcagttgttccactagtcatttagtgcatgcctatattctggctgagcaaatgtatcaatattcatgcaagggtgtccatctctagcatcaaaagccacgtgcccatctgtctactatgaatatcttagtcatcattttacaccaatatattatcttatatatcttctgcatctcaaaattctttttaaaattcagctcatccacagaatcttttcaggtgaactcaactattatccctttagctattccatgggttgccataaatcttatgaatatagattaacctcataaatatctaggatctaagactgtaaagtatcacaaactgaaagatcaactgtcagggcagtagattcctctataagccacagtaattgacgagattgagtcagtatctctgtgcatctactgggattgtttagcatcgttgttggtgtcacttttatgctcatttaccattaagttgcaaggctgataacatgtgctgcattagtgtgaatcgtgtttattttaaaataaatgttgatgctgaagaaaaaagtgttagttgaggggaaacaaaccagacagtagcaacttatttacatactagacgagatacccttttcatgacctccaaagttctcaggtctgggacatttcatactctaaagattacttagcttaaacatctgtctttgcgcctgtagctttgtttggttcaatttggcatgcctctgttgagtgcctattctgctagggatcctaagtgattgactaaaggaagtggcttgccatcaaacagcttacaatgtggttccaccctgttctcccagatatcactttctctctcacattcttgtttgacaacttgttttatcccgattttaaatgtccgtatttatttatttacttgttgatgattggtcttccaacaatccacagctcttcacaagcaaggcctttgtgttgtgtgctgatgtatccaaaatgcctggaagaccagctggcacattttaggcattcggtaaatatttaatgactcaaggggagacaaaatacaactacatacacaagacaaatagggatataacacaccctaaaaagatacaaaaacagatccacattttgcaatgctctaactacaaaacttggggggattgctatttaagaaaagcagcaataattttttaaaaattatatagaaatgaattatttagcatgaaaaataatcgcaatttataaataaagttaacatactagagatgacaaaatgtgagaaataatattaatgatatattaacacatgaaaatatctcgatattatacttttttctctataatttttggccatgtgttctttttttgttgttgtttgtttattgagatgaaatcttgctctgtcacccagactggagtgcagtcgtgctatctcagcttactgcaacctccgccacctgagttcaagtgatcctcctgcctcatcctccagagtagctgggattacaggcatgcgtgcgccaccacgcccggctgatttttttgtacttttagtagagacagggtttcaccatgttgtccaggctggtctcgaactcctaacctcaggtgatccccccccctcagcctcccaaagtgctgggattacaggcatgagccatcacacctggccagccatgtgttctttaatcacctctccatatgtaatatcaatttctgagagattgaataaatggataatttgttatttgctctagcatgggtaatccaaattgtttttgtttaaataacatttgggacatataaagggcttcacacatacatacttgtaactatgaaactgctacaggtttgtgtcttactagcgtgggaattttaattctgtgctgcattttcaagtatattctatataagagagaagttcccatttgtcaaggtatcgatgagaactgaattatttgcttataattgtatagatctggtgagtgaacaaatcttccatagagtagctctggctttgtgcatttcaaattttgtttatcttccagtgcccacatacttacagtactggtgcaaaaacagcacagccacatcattacttcacctggccctgtaccttagtatcatgaaactggttgaacttgcacagtgggtgttgggaatattcttatattacttaccaagatgactggcaatagattatatgcagaattgtttgtgagccacataaaaatagtccattatatatattctactatgtatataaataatccactatatctatctatcggagtcagagatatatctcatatatatatatatatatatatctatatatctatatatatatatatagtgggctatatatatatgagatatataaaatatataatatatataatgggctatatatatgagatatatctctgactccactatatatatatatatatatatgactatttttacatataggggactatttatatatatagtagaatatatataatggcctatttttatgtggctcagaaacaattctgcatatagttaatttattgccattcatcttggtgagtaatagaaacatttttccaacacccactgtgcatgttcaaccagtttcattatacagaggtacatatatattatatatatataaaaaatatgtagtatatagtggactatatatacaaaataagtatatagtggactatatatataaaatatgtatatagtgggctatatatataaatatatgtatatagtgggctatatatataaatatatgtatatagtgggctatatatataaaaatatatgtatatagtgggctatatatataaaaatatatgtatatagtgggctatatatataaaatatatatagcagactatataaaaaatatacgtatatagcagactatatataaaaatatatgtatatagtggactatatatataaaaatatatgtatatagcggactatatatataaaaacatatagcagactatatataaaaaatatatatatagcagactatatatacaaaaaatatatatacacagcggactatatgtacaaaaaatatatatacacagcggactgtatgtacaaaaaatatatatacacagcggactgtatgtacaaaaagtatatatacacagcggactgtatgtacaaaaaatatatatacacagcggactgtatgtacaaaaaatatatatacacagcggactgtatgtacaaaaaatatatatacacagcggactgtatgtacaaaaaatatatatacacagcggactgtatgtacaaaaaatatatatacacaacggactgtatgtacaaaaaacatatatagtggactgtatatgtaaagaacatatgtagcggactgtatatataaagaacatatatagcggactgtatatataaaaaacatatagtggactgtatatataaagaacatatatagcggactgtatatataaaaaacatatatagcggactgtatatataaaaaatatatacatatatagcggactgtatacataaaacaaatatacatatgtagcggactgtatatataaaacaaatatacatatatagcggactgtatatataaaacaaatatacatatatagcggactgtatatataaaacaaatatacatatatagcggactgtatatataaaacaaatatatatatagcggactatatataaaaatatgtatatagtggactgtgtatataaaaatatatatatagtggactatttgtataaaatatatatatatagtggactatttgtataaaatatatatagtggactatttgtataaaatatatatagtggactatttgtataaaatatatatagtggactatttgtataaaatatatatatagtggactatatgtataaaatatatatagtggactatatgcataaaatatatatggtggactatatgcataaaatatagtggactatatatataaaatatatagtggactatatatataaaatatgtatatagtgtactatacatatgtaaaatatatacagtggactatatataagatatatgtacagtcgactatatatattttatatatattttatatatagtcgactgtataaaatatgtatatagtggactatatataatgtatatagtggactatatatatatatgatatatctctgactcagtttccccttaactggaattccaaaaatactctgggccacttcattgccacccaatgggaggaagagtagtatggatggaaccttagtgatggaagagattacagggttaacctatagcaattaaaatattttacttatgtaaattttacaaaattatataatcatgtgatcttgttactaaggctcctcttggcatcatgtaaggggctcatgcaaatgaggacccctgaaattacatttatttccccacgcaaatctgcatctgggcattccaaagaaatagagattgtttataattattgggagtagaccttcaaagtgggacaggattacaactgattgcagtattagagaataatcatttagaggtcacatgatctaggacatttttaggtgatggcaggtggtctgtttggcatatacacctgaaaaagaatgtagtataagatataattagtggttgaggcaaacccttgaggtccttgaatgccagaacaagaaattgggaggttgacgcacacataatcaaaatccttcctttcatctctgtgattcaggagcttttatttggatttattaattcagatatatttgtttatttcagttagtactttacttgtttttttagagtgtatgcctttcaaagacctggacctttgcttgcaccaaacctcctctgtcgctttatccttaacccttgagacctagtgcatatctgagacctggcattaactaaccttaagtagcatgagcaaatttatattgtaaagtagcttaaaaattttgaaaaattgcagatttgtgaatacaactggataaaatgtgaaaactttaatagttcaacccacttcaagtggaagtcattcgtcttcagagacaagtataagtcccaataaaagtgagttaaaaaccccttcacatatttttgtagcactggctttccaatttcagctgttttccaaatactaaaagatgctttatcatgcgtgtgcttattcatatccattgtgtagtcagttgactattttgtgaattacttgcatttgtccatcatgtgttgaacaaacatggtttttgcaatctgaaatgagagaaaaatgatatgaaatgtcagttgacttgaacttccttcctcgttttatggcaatagtgggagtctcttttctaatggactcatatttaagatgaaagtttttgacttagtttccttagtgtggttttcgcatcacagtatctgaaagcatgtcctagctgctgcattcatcacaggccaggcaccaaaccgggtcaggcactcctgcggcgaaagtgatctcttctcagtactttgctataaattgtgctgctattgatatcattaccagtttttttttttatgggtctccagatttcagtgttgtgcagtttttttggcatcagctgaaaagccctatctgatgcccataaaatctatacaaaaagagaaaatgtagttgcctccaaaaacaaatgatgtaccactttcactagtcttattttattgagtattgatgggagtaatagcaatactggtaaggcatgtaaatcatctgcaagaaagactgtgtactctgggagaggagtttggatgccttgactagtgagacaagcatcttaccagatatgtccttgtgaccatgggttgatgttttcctctcaggtactcagcttccaccataccttccttttacctgtatctttctatcaaagtatttctttctgatggacagtttattttattttatttatttatttatttttgagacggaatctcgctttgtcacccaggttggagtgcagtggcgtgatctcagctcactgcaacctctgcctcccggattcaggtaattttccctgcctcagcttctcgggtagctgcaattacaggtgtgcaccaccacaccccactaatctttgtattttagtagagatggggttttgtcatgttggccaggctggtctcgaactcctgacctcaggtgatccgcctgccttggtttcccaaagtgttgggattactggcgtgagccaccacactcagcctgctgaccagtttagatgaaaagaattgctgctgcattgaagaggtgttattccccttacttctatgcacttacccagatagagaatgtggccctgccataggaaagtgtcaggtgagtaaaactagagtagaaataaagttcaaaagatttggaaacttcatttttctgggcttcagttcttttttttgtttgttgtgtttgtttgtttttgagacagagtctcgctctgttaccgaggctggagtgcagtggcacaatctcggctccctgcaacctctgcctcctgggatcaagtgatccttctgcctcagcctcctgagtagctgggactacgagtgcatgccaccatgcccagctaatttttatgtttttagtagagatggggtttcaccatattggccaggctggtctcgaactcctgacctcgtgatccacccaccttggcctcccaaagttctgggattataggcataagccaccacgcccggctacttcagtacttttattggctatctaaattagaaaactatctttttacaggtctacactggcactttgttgcagcccctcctccgtgctcatttagccagcaagaaaagggggagcagcttctttgaggtgacagtgctagaataatggttagaaggaaagtttctgacctatagtctttttgtaccatatctctgaaggatacacccatattttttcaaactcattcaacagttgttaaagttcaagataattgagaggtattgttccaggtgctgactagttgcaaagtctgttaaggaaatgtactacatgaaaccaagatgcagcctatactgtctttctatgctattaatatggattacctggaagaatgtgtttttttctacttctttctctcttctctaatttgcaagaactttagccacttgcagtttactttcatcatcaatgtaaaaaatttaccaacttacatgtattttaattcagagcattttcttctgttcatatttatcttgttatcctaagtgtcaacagtcgtggaaggagagtgtgttttttttttcttcaaactgtccaactgttttggtagcaccaaaggaatcccttagggcaaaggaaaatcgagactctgaaaagaccagccccctaaagaggagtctctttgcacataaacaggttatcgtgttaatcccagttcccttctccatgctttcaccccacccatttctctgagcactcctctgtgactttattaaacaataagcattctatatttctttctttctgaaaattctgagagagtatgaaatcctggcttttgcgttattttgcatgcgatgccattaatagttctttactgattcctcctttttattttcctctgttcacttcatgtttgtatctacctgctcattctagaaaccaatatgattttcattatcagcttcatattcatctttgtgaatgcccaccctattgaaaatctagtctttggtttctcacgcatatcaagacattttagattaaaagcaaataattctaacagtcagtgggctgaagccaagatttgtattttctctgagacaaatcatagcagttgccaaaacctccctattgctcttcttcaagccagaaatgagaatgattttaggtgtctgttttatgctccttctcatttgctttttatgtgtagtcagtttctgaattctcctgtgtcctcctccaggttctctctccatttctgcctgtgactgctgacaccctgttcaccttctccacgttgcccttctagcctctctgtgcgtgaggtcctctagttcttacagaatgtcttgtcagtgctttcaccgtgacctgccccccaccccgagagctgtccaggtgtcagtcaccctaggatgaaatgacaccaatattggtgacaagctggccttctggttatgctcaggagaatcattaaccatctttaaataaataaatccctgctgctactccccatacaatttagaacatgtgccttgtaacttttgatgtggggctcttgtttgaagccattgttgttttccctgctgcctgcatcatcatatgttatgtgattcttcaggaccttggtttcaatctctataactgcctatccttcaaaacccccaaacatattattaaatgacgtcacctgtcatttaagccatctccatcccaaacatatcctccaaatgaaaatccactgagagggagagggagagtgtgattataacaaagagacagaaacttatagaggtagcaccttacatttttgttggtctttatatcttgcatgattcattggtataccaatttcaccctttaactaatggctgccactttcaaaattgttttcctcaaactgaattagacgaccctcctcttggcttccttagtgacatttaaaggggacatggatcagtacctggaccccatttaataccagctgccccaccattaaaatagtgattactggagaattagaagatgcaccatcattcatagacacttgggaactgacttcactttctcctatgaggacgtggcttgactggtgttaattggcctaaattctgttaaaacctgacaaatcttgccatcttcctaaaggtctgtacagtaagtgagtgtgtaagtttttcctgaatgtggtataagtcctgaatgtcagtggagaatattctagtgagaattatgcttatcctgatatggcaagatcctatctggtgaggacatagtcaccagcagctacatacccaatcagggactcttctattcctgcatctagtagctttctctttggcttccattcagtttcaagtatcaactaaataaaatggggacttgatctagcctctggtgtatgttttcattggtgtgtgttctccaataagccacgtataacctacttgaacactttagtggtacctgcctttttgtgtgctggggtgtactgaaatgttcctcatttccacatttccttttctgaaagataacttgagagtggatgaacaccatgactgctgatcttaatatcctcatcccttctccctgtcctgatgcataagggcaacctcaaatatttaactgtgtgaaaaaaaaaaaaacccagcaagcagttctataagaatttatgctttaaaatactgaacaattcctattttatttgtgctttgcttccagtggcttttaaactatgattctaaggaacattgttgttccttgagctgaatctggggtttttgcctctaaattccaataataagtcttttcttaattagctgaaaaaaaactaatgaatagcaaaattttcccatttttgaactcccttctcacctcatctttatttgtgtaaaagttttgattcgtattgtaaggttatatttgttttagtgcaaggttagattttattattttaatttacaaattattccatgaaaattaacttgactttcaagagcctggctttttaagcagacgagataacacagctcacaataaataacaagtgctattacctacttttttgggggagggagtcctgtatgaaaattacataccagacagttccatgtcctatgcatgccttaatttatttcagcctcccatcagttctgttatgtgctatgttcaccaagttttaagtgatgagactgagtcacagagcagtgcaagttcaatgccacagagcaaacaaaggctcaatctgtttgactccaaaacccagggtcctctccactgtcctgacacatgacagttagcagtgttagtgtctaattgttactgttagatttataagcttcttcactgtagaggttatgtttcctttactccctaacactggaagcctctatgaaactggatagagttgtcccctctcatttcagttagctttccttgtacaatatgacttctactctaccatatattcaaggttttgcccaaattatcttcagtactcctaattacctgccctctgttgtgcattaggacttacctttctttgtcttttttttaaattttttatttattattattatactttaagttttagggtacatgtgcacaatgtgcaggttagttatgtatgtatacatgtgccatgctggagtgctgcacccaccaactcgtcatctagcattaggtatatctcccaatgctatccctcccccctccccccaacccaccacagtccccagagtgtgatgttccccttcctgtgtccatgtgttctcattgttcaattcccacctatgagtgagaatatgcagtgtttggttttttgttcttgagatagtttactgagaatgatgatttccaatttgatccatgtccctacaaaggacatgaactcatcatttttatggctgcatagtattccatggtgtatacgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtcaaagtgttcctatttctccacatcctctccagcacctgttgtttcctgactttttaatgattgccattctaactggtgtgagatggtatctcattgtggttttgatttgcatttctctgatggccagtgatggtgagcatttcttcatgtgttttttggctgcataaatgtcttcttttgagaagtgtctgttcatgtccttcgcccactttttgatggggttgtttttttcttgtaaatttgtttgagttcatcatagagtctggatattagccctttgtcagatgagtaggttgcgaaaattttctcccattttgtaggttgcctgttcactctgatggtagtttcttttgctgtgcagaagctctttagtttaattagatcccatttctcagtttaaggtggaactcagtctcttcctgacagccaccttcaaatagggtttagtagtttagaaaaacattctaggaagggttgtttaaaagtctgagataacagttcatatttaaagatgctcattattaatttcaatgtggaatgatttgcacttgttattaacacatttagagagaaagaaaaattagaagatactcaacaggagacattcaggtgtggagtacagaaaagccgagaagaagaaagttattcctgatatgtttaagaaagatctagccatcttaaagttttttttttttttttatgtttcaaatagctgatacactggtacaaaactgaattgtcatcttctaggatacactataatactatggcatattgattgaatacacaaacctgaatacttatcattattattactattattattactattattttgagacagagtctcactctgtctcttaggctggagtgcagtggcgctatctgggctcactgcaacctccgcctcccgggttcaagtgattctcctgcttcagcctccgagtagctgggattacagttgcgtaccaccatgcctggctaatttttgtattttcagtagagacagggtttcaccatgttggccagactggtctcgaactcctgacctccagtgatccacttgcctcggcctcccaaagtgctgggattataggcgtgagccactgcgtctggcatgaatgcatattattataaaattatatcttaaatattttagtgtgttattatttaaaaagcagatactgatagtgaatgaggactcataggcatgtgtctttaaatttgaagaaaaattacctactgtggcttttttaaagaaaatgtatttattacctaagaaaaaccatgtctctctctctctctcacacacgcacacatacactctctctctccatatatacacacacacacacacatacatatatatacatatacatatataaacatatatatatgactcagctgcataaaacaatgtaactaaattgttgatcgctaaaatgttcacttctgtgcctctaaatcaagttgattttgacaatgaggaaatgccttggtgaaccatgttggttttactttttgtttattttctcccattcaagattatcaacttgtaatttactggcctgattaaatgcttggaaataaaccagagttcttgaattttgccccattttcttaattttaaagataatgagttcctttgaggatattgcatttagactgacttgttcatttcatgttgctggtaattgaggggcttaatctgaaaggaacttagtcttcagattacctaagggacagaaaaagatactggtatgggactgggatcctactttcttaaaattttatggtactttttcttgcttctactcttcttgttttttttttttaaaaatgttttatttcaaagaacaattgccaaccgtacaattattggtatgtcagttggttaagaaatgtttgggatggaggtggagggatggtgaaaaatgtagtgatgtctcttaataaaaaggaaataaaggaatgtgaagttggactttataattccttttggcataggtttgtgtcctaagtagcatgttaatttcttatcatgaaagaagtttttttttttttttttaagaaaaggaagttctatctggacaaagataaaaaaatatttgcaattctatgttttgtacaaactaagaatgttaaagcacacataaaaaccaggtttgtaaataacctacaaagtggatgaaaaatgttcctttaagctggaatcgcttcagaggtttggggaatcattttcagaatattgagaaatgagaaaatgcatttcaactgttttctactcttttcccaaaagtacaaaaataaaacgctaatttttatatgagagtgattttaaaaccacaagcagattttttttgagatgtttctctgtagtggccaactttgtatgaagcaaattattttaggcctaattgcagtcagagcggttaggccgctggctctgctaaggttgaatttcatttgaactttctaatagtatgatcttttttcagaatttaataactgactcaaatatttaatagtggaagctttcattaaattaaaaagaaatcaggatatatttttagaagaactaacttattttctttatcagttctatctactttaggagaagaggaagagaatggaagcaatctctttgtgtacttaaataggcattaatgttgtaaccccagcaaataatttattttggtctatatcatcattcaaaagatttggaaagcaccaaatggcagtaataactatacttccagctctgttgaatggcaaattacactgactgtgtgaatcccttcattcgtctcctggataatcattctttttaatactcacatatattttctagatcagtttttagattgtacacagtcaacttgtgcattgcctaacagtttctgttaaacacaatggcttgttttgaaatgcaactggggaaagatgagagttgaaagattttgtttccatgtgtcaacctataaatagatgacaaaagatcattaaatggattaatttacaagcatccttagaaatagaatgtttttacataaaagcctgttgtaaaccttttaaattaaagtgcattgtgtcatgcactctcttcaccccagggttcttttgacctctcacctctcactttgtcttccaggcactccactgctggtgaggagaagcagtgacccagtgccaggcccacctgctgatacccagccaagcgcttcacaccctggtggccagagtctgaaactggttgttccagtaggtatcctgctgcttgtagttctaatgaaagatcaaagtgctgtacccataggttaagtgggactttgcagttttaaacacattgataactagatagagatcttttgatagtatatatagtattagttatactaatagctagtatgggctattacttgtatatagttatagcgatagctattacgtatatggcactgattatgtgccaagtactattttacctgttttatattaagtcatctaaacttccacatcaaggtaagcacatgtttttatctccatttaactgataatgaaattgaggcagaggaaggtttagtaatttgtttaaggtcacatagctaataagtggcaaagcaaggaatttcacccaggtgttctggctccaaaatccttgcttctggccagtacactatactgttacatttccttcatcttccagtttcgtaatgtccaaggatatcattatatttttgttgtgttaacccaatgctttgcaaaaccataccatgtgagtggtgtacattttcaagctcccaatatcacgaaaatgtggtgccaggattggatgtgtagaactcagcattcagattgaagaaaaacaaaatcattgaccaaaagtgcttataaccagatatacttataactaataggttaagtggagaataatttcctgaagagatgatattctccttccatataggactgtgggatcttcctgctaaatcctcagttgctttgaagagctgtaattgtgaataatcctctcagatagcctgagaattcaattttggctaatgactatataccattgcaataggtaatcttcgataacatagccatattaaaaattccctaaaagcaagactctttctcactttaagtctcactgtctataacgccttaagaaaaaataaacacatcatttataggtatatacggatgctgaaatgagttaaacaggtttttctgatttggtataaaatattcttatcaagaaccaatgtcaatgtgtatgagataggagtcactatttgaaatcattagctctttgctaatagatttgtggcaatattttggcatatttcttttattattaaaagaaagcaggtgtcttgaaagtattttagatgtaatgtttttccactaacctatttaaaactctatccttctaaggaaatatatttgatggaacattaataaaaatcaggtgtatgtgttctattttaatgtacgtacaaacaaaactggtatgtggtatgacttttcttaaaacacacactggttgagaccatgttgagtctaattatgttggattgggggaagacagctattcagtgagagaagaattacataaaagagcagaactacaatttagttttcattttcatgatgtctgtgtgtctgtgtaccctaaaacgagagtgtgtctgattaatgtgttagcattgtttgcatggagaaagtccctgtatttgcccattttcacactgctctaaagaaatacctgagactgggtaatttataaaggaaagaggtttaactgactcacagttctgcatggctggtgaggcttctggaaacttaaaatcatggtggaaggggaagcaaacatgtccttcttcacaaggaggcaggagagagaagtgcagagtgaagggggaagaaactcttataaaaccatcaaatctcataagaactcactcactattacaagaacagcatgggggaactgtgcccatgatccagtcacttcccacagggtacctcccccaacatgtggggattacaatttggtttacaattcaagatgtgatttgtgtccggacagaaaccttaaccatatcggtcctccaatgtttatttccatgtttctatcacttaggctctgggcttaaaccaattaagatgacatcaatgttactttccctagaggaaatgatggctactgtccatctggtaaatgctgtagccccaccaaaatatgacatcagtgagttccaagttggggtatggggcagaaagacatattattactagcaaagatgcatctcataattcaagaataaatgctggcgcccaaaatccttgtgccttacttatgcaagtgatcaaatatgggctgagtccctgtgtatcaacagtgaaaaggaaacacatgtttcttcctttcctcatagtgtcctctgtggatgatggagtgcagaccacagacccaaaaaggagagtctggtccttgcccttgcatggaatagtggcacatcttaggtgtctcttgcttcagttgtaaaataatctccatgaatactttaagctttaacatcccaaggtacagacattgtgccttatgtatctttatctagggccaagtacatggaagatgctcagtgtatatgttttggacttaggaatgcaagacacgtgtaagtctaggaagagtcctaaaagttcttagaaattaaccagctaattaattattattaattaatatatattaatatataaatatataataatactaattaataataattaatctgactcagccattctctccgtttcccaaagagcatctaccagggaaatgtttatctgctccaaggtctagttcaccacaggcaagtgacagatagtttaacttccctattatgcaaacattaataaagacacttaggtgtgtttatttttactagaaggaaggtgtgtgtgtgtatatatgtgtgttataactgttaatatatccttgcatagccaaacttatggaatgtttagatctacagtgtctagtttagtagccactagccacatgtggctattgagctcttgaaatgtgtctgatccaaatgtaaatgtacttaaaatttaatatacacactggatttcaaagactgaagcataaacaaaataacataaaagatctcattaataattgttatactgactatatgtggaaatgataatatattaggtatattggcttgaataaaatatattattaaaattattttcacctgtttttacttttttttttttacatggctattagaaagctgaaaattctatttgtggttcttattctgttttattggacagcgcagctctagacagaagcaaaattgggtatagcatgcatgagatagtttgagtcctggggaagatctttgagcctcacatcatctcttgggcaacagtgcaattcggtttgcctggggcagtcctggttagtgcccgttgttctggcataattattaataatgtcttcacaaactgtcagaggtgtccatgtatggatgataaattacgtggcaccctgcatatagccctacgctcacttttattgttcgctcactgataagagaagcagcctttcaaggaaaccttgggaacataacaaccacaactctaacactggtaccctgcagaggaggttctgtgtggcaaggacctgggactggagctacggacactgagacttcacattcttttccatctcttggattttgtacttggcgcttccttcacaactccagctacaccattcttgattcctatgatttgataagtgatggtgaattcggggagtgtgtgataatgtagccatgtgtcaactaatatgaaaaataattgcttaaaaagccatgttcaattgcatttcagtccaatatccacaggaagaaaaaacaatcaaaatttccatctcttcaagagtgttcacgtataagtaattcacagatggcagagccccaggtgggttatgttcagtcattcccaagaaatgaaacttacttataacccacagcataagaagctgtaaggatgaatatttgacacatttgattatgttgaaatactgcctttaaaacacagttgatgactgttatttttagttgcacttcattaggcttactgtagagggaagagttttcattgatgcccagagatgtgtgtttttcaaaagttgcaaaagttacacttgttttctagctgattaaatttattacaaattggttatttaagatgtacactctcagacatgctggagttttaaaaagggcttaaattagaaaaatcagattctctgaaagcttcaaattctatgtatattgagaagccactaaatctggtatttgttatttaacaccagacacacagcaaagaaatttgtttcctttgttcctcttttggtcaacatacctaattatcagaatagtacaatcattaatgtgcaaatagtaataactgtttatctttcaagacagtatagcaaatccaactctattgactgcttttgaattcagaaagagaatcctagaaacaggatattttggtgagagtctgcttgtgggacttcttaccttccttttcttgattgtaacctggtgttcttggcttaagggcatgccataaaacaaggttcttgaaactgatgttctcaaacttgcaatggaacagaactctaaaacagatgtgatttttttcttaatatccggttaactagcaaggttgttttgtgttttaatgactgtttatggtttttaatttaacccttaaggcaaattgatcctgcagggcgagaaaattaaaaactggattcctgaaaattataatactgtggttgttctcagagagtgaatggcattatttgttctaaaaccattacttgtcttacatcaccaaaatacttgacctatcttttcaaagtccatgtgtattttatatatatatgtatatatatatatatatatatatatatatataaaattaaaaaaataagctggcagatttgggggttgttaaattagaagttcatggatagatttcaggggggtctgttaactctctgaagttttatgccttagccaggggatgggggtgtgtttcatgaaagagattctattacttcagattttaaaagaataacaaaaaatcaaccactgtttgggggttagattaaataatgtagggaagccactaattctcacagtgagcagaatgagagaagttaagaagtagagaattatcacttcctccctgcaaatatgtattaaataatgaaggttagttcatcatattatcacctgtttacatgacacataatatgtaagttcaagattttaagaggaatagaagtttttgcattttttcattgagaggctaaaaataactctttagtcagtatcaacacaattattagcaactctaagattgggggtaaaggacacagaccggtggagggaaaacaccctgaggggaagtgtttccagttgtcctgtgtgttctactgagacaagaagggaaaatacagtgttctttggggcttttggtatgttatcagtgaggatagtggcaggtggctgctagtgagagtgcatttttacagtgagtggctgcattctctttaagtcttgctaagataatatgatgacgtgttgatttgaggaatttcccctcatatgtcacacattttcccatgtttgtcacatatattgaaattattgtcagtattgcccctgtattaaacttcctcagacccatgaaagaaatcaccgagatattacagagaaattcaaatagcttgatttcagggttaaaataattgatcgccactgtgatgttagaggacttttggttgcaggttgctgactatcaaaatccaacataaggcagggtacagtggctcatgcctgtaatcccagcactttgggagactgaggcaggtggatcacctgaggttaggagttcgagaccagctggccaacatggtgagaccccgtctctactaaaaatacaaaaaaaattatccaggcttggtggtgtgtgcctgtaatcccaagcacttgagaggctgaggcaggacaatcgcttgaacctgggaggcagaggttccagtgagccaagatcgtgtcactgccctccagcctgggcagcaacagtgaaaactccatctcaaaaaaaaaaaaaaaattccaacatataacttaccaaacattctgagtgaccaaatcatatttttctgtagaatcaaatatctgtagaaacactggaacaaaataaatgttgtgggtactgatgtgtattagaaggatggctctatccattgttttccaaagaggagagatggatgctgaagagcaaaacagggggagaaatagcatgtaatatactactgcattatttagagatactgaaactataaaaggtttttattttttttccccaccctgacacagtgatttaataatagttctggtgtttgtaactccagctgttcacgctgtgtgctgataagaccagagcttgaagacacattgcaacgatggctttcatatggctttgtttttaagagataaagctgccatccgatatttcatggggccaaatgtttacttcatttggcaagtttaggcagcttaatttttaaatcagttatgcttgcaagactcaagtttcaggtaggaaaaaacctgaagcccagtttactctgcagcagagtttttcaccatatctcagcagaagatgttaaaacaaatctggattgcctgaatgtctgtaccatgactaatcaaggaaactaagaagtgagatccctatttaggtgtgtgctccccgatttttcttcttgggtcttagtctaacactgaaaaactctaaaagaaggatcactatttaggtcaatttcagaaattaacaaggtaaccatgacatgtcttttatatatatatatatatatatatatatatatatttttttttttttttttttttaattatactctaagttttagggtatatgtgcacaacgtgcaggtttgttacatatgtatacatgtgccatgttggtttgctgcacccattcactcgtcatttacattaggtatatctcctaatgctatccctttcccttccccgcaccccacaacaggccccggtgtgtggtgttcccctttgctgtttagccttgatctgcacacaatgaaaactgaatgggttttgttttcatgtcaaaataaattgactaatcccttagatgcccaagatttctgctgtgtgctttctagaaagcctaagacatggttcctgtcctcaagaaacttacaacctcgttacagagaacacatctaaagcagttaaacagccctagcagtctgcaagcatgtatcagattatcaaataatacggttttaaccatcaaaatgagtggttttttttccctttagcctgcactttggtactctacttagccttcctaacccctgaagggaattgccatgtgcagtatctctattagctgttatctctctgaaatataatgtttacatgactgcattttttcaagactgtgaactcttcagaggcacaggccagtgtattcgtttttgtattcaagcccccaggcacagtgcctggcacttaagacgttatcacaaatatatgactagatgataaaaatcataaaatctagaatcataaagttagtaatctttgagttataactttgtaattttctaataactgttcaaaacatttagaaaggtcttgattagaagtttctggataatttcttatatccattacatctaaagatttctccttctaaattttcctcctagtccatctcccttaagaaatttttctaatttcagttgatttggaagaaaataaaaatacttctggtatgtgaattaattaaaaagaaagaacatttacgacgtgtttcttggcaaagcactgataaacatctcaatctcactttcacaatatgggcagatgtaatttgacagtgttgtttgaaattttgtaaagatgatgtttaaagtagttttattttaaagaccaagatcctgtgtgtgattgcatcaataactctgtgaccctaagaaaattagttaaatagtgggtgatttcctcagaaattctatgtaatggaagggaaataataaatagagaaactgtatgaactctagttgttcttagggacttatccatccaaactagtgacttcaagattccagatgtgaattattaagttggttggtatgagttcaactttagatttcattttaatgtctcagtgttcataaccagtcatgcagtgaggttatctttccatccaaaacaccaataatcattttttattggtcaaatgaataatatcaagaaatattttttaaatgccacacacacaaaggcagcagcgtaaatgcctacatatgcgtatgtgtgtacccttaccctctttggagggaaagctactacctaaatttgaaggctaaagtacatatagtcatgttatcgtaaagtgaaagttaagggtatgggttgtgtcttccataggttctgaacttctgtatgtaccttccaaattgtggacatttagtaaagactgatgacataggaggaaagggttaatgagagttcaccttgagaagaagcaagacaattggccttgggaggagaaggaaaattatttctttgagcatggtgtgattcatagaactctcttacgataggggacgtttttttttttatcacagcataaacgcttctaaagtacaagtttcaatttggtttctgctttcaaaatcttgtcatacaatgacattgtacagacgtttaaaagagttttatttcttaggagagtggcccctttcctaatagctctgtactttaaaatagaattcccatttagatgaatcacattttaaaaagtagctactgtgagtgttttacgcttgtggaaacatatagcatcctcataagcagcatgagagcctgtcaccatacagcttttgatgtctgattaaatgatcgtagggacatctggagggagttagttttgaagtaactggtgtgaagcactggagaatccgaagccttctgacagactaaaaccattaaaaaaaaaaaaattgctacttttagcaaatcttttttaacttgaaactggctggaaattttcagactcacatagccctgatatttctcaacagatttttcagacagaactctctacgttttaagcaaagaatggttaagtagcatttgttgcaaaaatcataaaggaatatcctttgaaaggaaaaagtagatactgaaagcaacagaagtcaaaattgatttacttaaagaaattgtctcctttttatctgcctttaattttaatcagtgtattttaatttttaaaggacacaaacacacacacacacacatacacacacacacatatatatatatatatatatttgacattcagctatattcttatgaagacccaaaggcatcaaagcgattgatattgatataaggttatggcatgttttgagcacctgtcaaaagtttctaaatgtcttgagtcaaaattttatttgcatagtctcataaaatacaggcattgtttatttaaaggttgtataatttgtaatttgtccaccgaggttctcctagtatgaggtgatttcttattgtttcatgaataaaattatgatatacctacatatatgaatatatttacaaatcctgaccttatgtatgtatatgtgttatatacatatacatgtgttatacgtatatgttatatgtatgttatatacatatacatatatacatgtatgtattcgtatatgtatgttatatatgtatatgtgttatatacatatacatatatacatgtatatgtgttatatacatatacatatatacatgtatatgtgttatatacatatacatatatacatgtatatgtgttatatacatatacatatatacatgtatatgtgttatatacatgtgtatgtgtatatgtatatatacatatatgtgtatgtgcatgtgtatatatacatatatgtatatgtgtatatgtatatatacatatatgtatatgtgtatgtgtatacgtatatatacatatatgtgtatgtgtatgtgtatacgtatatatatacatatatgtgtatgtgtatacgtacatatacatatatgtgtatgtgtatacgtacatatacatatatgtgtatgtgtatacgtatatatacatatatgtgtatgtgtatatatgtatgtgtgtatatatacacacacgtgtgtgtgtgtttgtgtgtatgtttatatacatctcctgccttgaaacccttgatcattctccactgcattcaggatgttttaaaatttcttggtatggctttttaaaaaaaagacttttttctcttttttaaattgtggtaaaatatatatatttactgtcttaacaattttaagtgtatagttccatggtataagtacattcacattgttctgcatccatcactaccacctctctccagaactcttcaccttccaacactgaaactctatactcttaaacagtaactccttattccctccttttccttggcaaccaccattctgttatactttttctccctatgattttgactactctaggtgccttatacaagtagaatcatgcagtatttgtccttttttaattgtatttgtccttttttgactggcttattttactgagcataatattcttaagcatcatccatgttgtagcatatgtcagaatttccttccttgttaaggttgaaaatactctgttgtatttgtatacaaatataccacattttgcttatctactcatctcttgatggacacttgagttgcttccacattttacctaatatgaaaaatgctactgtggatacgggtgtaaaatatctcttccagactctgctttcatttctttccgggagatgtccagaagtagaattattggatcatagggtttattctaattttcattttttgaggaaccaccaaattcttttccacagaggtgtgtcattttacattcccaccaacattgcacaagagttccagtttctccacatccttgccaacacttgttggtttctgttttgtttttagtaatcatcctaatgactgtgaggtgatatttcattgtagtttcgatttgcatttccctaatgcttagtgatactgggcatctttttaagtacttattggccattcatgtatcttctttgggaaactgtcttttcaagtcctttactgatttttgaattgtgttcttcatttatttgttgctgagttctaggagttttctatatatgctggatattaactccttatcagatatatgatttgaaaatatttttctctttctttacattgccccttcactctattgtgtcctttgtgcagacatttttaattttcatgaagttcaatttttcttttttttttttaactgtgctttttgtatcacatccaagaaatcattaccaaattccacattatgaagattttgccttatgttttcttctaagagttttatagttttggctcttaggtttaggtcttcgatttattttgagttaatttttgtacacggtattagataagggtccaacttcagtcatttgcctgtgaatatccagtttccccagcatcatttgttaaaaaggttattctttcccccattgaatggtcttggcaccactgttgaaactcatctgaacataccttagagggtttatttctcagtccttgatgtggcttttaaaaacttaatcacaacctatatgcttagctttatctctagtcacactgcatgaaggaccctatgtatgagagttataatttttcacatgtgcaaagaaagcttctgtctgtgggtctttgcccagatgtttcttctgctggaagaatgacaaatatcatttgtctccctttctgctaatgaatgtacaggtacccttcaaaacttagtgtaatggcctctttctttactgatccttatccacaccctttctgctctggacagaatttaccacttcccactgatggcatgctggaatacctctagcataatttgttccaccccatgttatagttttctgcatatgtctcctttatgaatctagaaacttgtaggtggcttgaatttccttccacattagaacacggcatcatgcccaacagcagcatttatatattgtttaaggaatgggggaattttctaatcacgattgctcatttcaaccatgaagcaatttaatttcagctttaatagcgttaatttacattctacttctgctagcgagtagccacgtaatactacccagcacaccttggaggagggctacttttctctttcaattccaagttcatgtcagtcgtggacacttaattattaatatatgtgttcaaatatattatttcatcccatgaacatctgcaagttcagctttattgcctccattttacagacgacgaagttcaggctcaaacgagttaacttatttgccttagatcacagaactaacaagtagcagtgctaggattcagatttatcttaacctgcagtatagactcttcattctacccctcaaatcaaatgttagccttgagagtagcatttgtccacattatgctgccattgctttgggcaatcttcctttgaaactgcctcaaagccagtttatcagcccctcctcctaaaaaaagtcatttcatcattttatagtcactatttttccttcaaaaatggtggcgttctatttgatgccaaaatctatattgtacagttagtctcagactgtttacacaatttagatacctctgtgaaggagaaaatttttccaccacaaaggaatttaatgcaggcatttaagacattcatattcatagaagaatgcattcagatgggctgaaagcagcagagttttagaacaattttttgtttattcagttgcctagtgattaagacatgtaggttttgtccctgactcatccattgactctttgtcaggttaagcaagtgtaatttagttctgtgtctggaaaaggaagattgtcttctatattggccacggtggaattgcaaggttaatgccttctatcttgagtacagcatttagcagactgtgggtgcttaatatatgttaataatagtgataataatgaatgttgataattaaaggtcttttataattactaaattttctatgtgtgttaaatataattaaagggaaatgatttaaattaatatgcatacatataaaaactagagctagccacagcttttatttttagcttctcaactaacgtcatgaatgtgaatcttatattaagaaattcaattatgatggcagtttcactagggtcatgtatagagaacccatgcatggttctactctggaaactagaaaggcaatttgagttgaaaaacatgggcatgaatgggaagcttcaagggactttagtggttggagcttgaccaaatgaagttgtgcatcggatatcgttattatgaagtatctccataatactccctttgagttctactgggagtcagaggtaccttactggaagctgggcaccatcccagaaatacagataataaacaagactgcctggagggtctatagaagatataggtagaataaaggaaacagtaatcataaataataacccaggaaattcagcttggagattcattctttgaactcaaatgctcagggttactaaaggttattatttcttaaggttctggcatggcagtggaagtgtgaaccatgagatgtggaaggctagagtggttaagaacatggactgtaaacatgactgcttggttcaaagctagcttgaccactgactgatttgctggtcaatttctgtcaagtgtttgttttccttcttttggtctcacttttctcacctataaagtaatgataataaaagtacttacctcacaggattgtcttgagaaattgatgagtgattatttgtaaaaattcttagaacacatggtaagcactatgtgtgtgtgttaaatacatacgtatgttggatttgtgccatgcatggttggatagaaggtgtaggataagatagactatagaagtaagttggagagtaatctgcattaaaagctgaatttgatcatctttagctttaatttacagaaggcacttagcacacagctagcaaaaaatattgattccaaagtcgagcattaaatgcatactgagtgtcttttgcttatagagacccttgcaagttcttttaatttcaaaaaaaaaaaaaaaattcctccaaaggcaagttcttaaggcaatattggaactacatcaatgaacccagccctggctttcttctcttgatatgaaatgttgtcttccttataattattttgtttaagttgaaaacctagaaggaaacaggaaaggacggattattaagcaacaagccagtttcaaatggttcaaacctgtcatccatctcctgaggttttctggaagcccccttcccttgtacgcttctctaatttgctagtcctgctgcctttatcttgactcaccttcctcacttgtttacagggtggatatcttctcattcattaagacaaggttaaaataccacctcctttttctatcccttttctgaaactctacttccaagcagaagtgtagtatttttttatgtaaatattttatgtaatatttttaaagcaatgtatgataatacgttcgttgaggtcgtaatgaaagtatgttattggagaaattagtgtttaatataggaccaaaataacagaggtcagacatgagtcacagagagcacagtgtggatgccctcagatcacacacttgttcctggactgaggcatgccctgctgtgcccacagagctacctgttccctcctcagttcctgctccccgctcccacccaaacccagaaagagtgatttataattctgtcacaaacagtaggaccactcttatttgcatttgtgtgtctctttccttcccttccttcccttggagtggaagtgcactgaggatggagaatgtattgttttttatctttgcaggccagcagtagcatgtggtaggtatttaataactgatgattgaataaatgaaagaatgcataaaagaagtaatggataagcaaatgaaaagaaaaaaagaataaattagcagagagaaattaagaaaagaataaaatgtttttaaaggtaatgtacagtatatttttgtatcttttgcagtgctcagtttttaaaaataaacaaatgtattttaatttattcagcatgaaatttatttatatcttatatctatgtctgtataagaaaataaaacagagcagatacaggtctctgagagtattatgacatttctgcatttttaatgtacttcaaactccatccttccaagtcagcttctttcattttaaatatagttgcagtgggggtgagggagggggtttgcttggaaattattgtattattaattaatctattatatatattcaactttagtctctggtcagtgttttcttagcaatttgcaaatatgcaattatctctgtatatttgggatagtagttacagaaactaccaaagtaaccgtttaaagctaaaatttggaattttatcactgcaaacatttatctttgtgttggggacatcataatccttgtagctattttgaagtatataatgtattaaccctaatttgatcattatacgttgtatgaatgtatcaaagtatcacatgcaccctcaaaacatgtacaactatgatgtactaataaaaaatataaaaaaataaaattttatattttaaaaaataaagtcaaaatttgagttttcctggatttctaaatttgtttgataaattaatgaactagaaattagtctttgcaaggaccaaaggatgcaggtagaaaaatgcttaggagtttgttatgattcaggtcacaggaggcaaccacccaaattaccagcatgattcctttatccgtgtaactcagcagttgattcagtaataattataaaacacccacaactacacttattttgtgctagttatttttctaagtgctttaaatatattatttcatcgaatcctcttaacacccccatgaggtggtcccattgatatttctgttgataaggaaatgaggtacatagaggttaagtaaatgtcaaattgtttagttgtaaagcaaataaatggcagaaatatttaggaaataaaatgtacatatcttggataagggaatagaacatataagagatgtcaagaataattcccacttttcatgtttgggtagtaaagcatgtaggtattctaccaactgacatacagaacataggatctgtttgtaggcaaagatacaagtagagatgcttggaaataaaaaaaaacgcatatccaaactttgaagtcattggtgatttcagaataagaccagtttctataaagggaagtgaggtaaaaactgttctgctattagttggaaaagatactggaggcaacgcattgggaacagccctgtggaacttataatcgcattgaggagaacatgcacaggttaaattttataagctaataacaatttaagaactaattccaagtggcaaaatacaatttaaaatggttcagtggaaaaacaagggacttttttatttttttatttttttgaagaatggcacatgtaattcatgagagtgttgaacatctacatcttgggaagtgagagatgcagctgtgcttcaggaaaaagtggaatctgagatccaagcaattgcttctgcttcactctttcatagatttcatcatgtttacctgtttacctgcccactgtcttcctccacattggggagacatgcgtggctgctaagaactctgcttttcccatctgcagagaggaactaattccttcctaagctttagggaaaaaaagtctgattggcccagaatggccactttacccaagctatggcactttaaatcaaccatggcaatgggggtgtggggaatgttctgcagacatttgatgtatgatgccagtgggagaagagcagttttcaccatgtggaagactgcgcagacattcccataagtgtatacccagagtcaaggccaggtatgaataatcagtattggcagtgagtgccgtaagttcagggaagaactcagtgtcatgtggtcaagggagcttcaaggaaaaagatggcttgatgtggactttaaagaaagggtagacatttgataagcataaaaaagtcagtgtgcaaattcacagcaacaaagatgtgtaagtcatgttgggtagaggaagacctttctgggcagagttaaatttgaaagcactgtttctcaaagagttatcaaaagaccccttccctcagaaacaccaaatggggttgcagaaatgctaatttgagggctccaactcagtctgttgaataaaaatctttgggaacaaggtctgggaatctgcatcttagacaaatatcctttagctattgcagtctccagtgtaataacagcatggagtgaatagaggttataaagaaaggctggacctggcctcaatagggcaagctgcttaggcacaggaagatgaggtcagctatttccacattggtgcttagagggaagaaacccttagaagcaccatctttatgaatttattcaaagatgccacagatagagtgagaagattacaatatatctgacaaattaataaacactggagttgtgaaaaacaactgtagaattttgcatgaaattgtgaagttgtaaaaacagaaacaaagtgagacattctgttgacgacaacagtagtgataaaacacacacaaaaaaagctttttgtttccatagaataatttcacatggccataaagatatcctgacccaatatataatttaaaccctaaatacgtattttttatttcattctgtgctatggtttggttctagtttgtttgttaccatcaaaagtcatgttgaaatttggtccccagtgtagccgtgttgggaagtggggcctagtgggaggtgtttgaatcatgggggtggattcctcaagagtggcttggtgctgttctggtggtagtaactgagttctctctctggtgagaatagattagttcctgcaagaatggattagttcccaagagagtgggtagttataaagccaggatgcccaatggattttctctctctttgcattttttgcttctgctttaaccttccctgccatgttgtgatgcagcacagaagcccttgccagaagccaggccatgcccatgaactttgcagcctgcagaaccacatgctaaataaatattttaataaattacccaatctcagatactccattataggaacacaaaatggactaagacggcccccatttattcatacttattattatcagcctcattgaacaggtagacaaaacaaccacaaaaacaacaaaaccttaccatctccataggtaagggaattttgtctcatataggacacagaaggaataatttaggacacagactctctcgggtctgggaaagttaatgtatctcatgtaactaactgacattcaccaaacgtaagaacagataaagtttcccccgacagaccctgtgcatattttctgctctcaatttggctgaggtactaatcttaatctgattgtgttgaacagaacaacccacccttttagcatttctttgtctggcaggagtcctgacatttggtcgcatggttaacatcaaacacgaagagaaattccttctggtaatacagttaagataggtgcctttttcctgaaagttagcaatattctcactctcatggaaggctgtactgatggaggaaccaatgaagcagaaaactctaaaccacagataattcttgttatttctacctgagttgaaaatacaatgtgttcattagcagcaagtgtatactgtagtctgacaactgggagacctgccttctggtgtaagcttagagactgaattgtgtggtcttggagaagttacttaacttaccagggacagtttcttcatctgtaaaatgagaaaggtggtatagttaaaatgggagctcttgtgtagaaactgataggaatataaactggtgtaacacatttggaaatcagtgatcttaattctcaatctgtgaatttgtaatgaggaaacatgttttttctgctttttttcattttgacggtttttcttctaattctaaatcatctaaataactgatgacttaaatcatcatttaaatcatcaagttatttaaatcatcatctaagtaacttttattttcagtttttcctcatgtctttcaagtgtccaaaaataccctggatgagttgaaactgacttggagtcagcttcccctgaatcccatgcagtgcgtgaggggaagggaggttgtgcacctgaacaaaactgggggatctaatggaaagggaagtaagatgaaattatctcagtagaaactaacactctattttttggtcaccaaatatttctttgcatcttgcatccacttttactaggctttttttttttttttttttttttttttttggtttataggcattggaaatattttccccagtccataattggtttttgtttttcagagaaagggtctcactctgtcactcagactggagtgcaatgctgcaatcctagctcactgtaagaaactcaaattcctgggtccaagcagtcctgcctcagctcctcagtagctaagactacatgagcatgtcaccatacctggctaattaaaaaaatttttttgtagagatagaggtttcactaggttgcataggctggcctcaaactcctggcctcaaaccatcctcctgtcttggccttccaaagctctgggatttcaggtgtgagccacgatacccagcctataattgtttctttaattttaatttgtgttacagataaattttaaatttcagtgtttatgcttatcaattttcttttattattatagtgtatatgtttaaagaaaatttctaaaatgaattacaatattttccaatgttttaagttggaatttaagcctttaatttacctataaattttttaagtggtatgtgtgtgggtctatttttattttaatatttggcatgagaaatcagttatttcagtgccatttaaaataataaattttgtttatgaaatgctatttctgtgtttatttagatgatgctattttttcttttatcactgaaagcagcgtaattccatgaatacattttctaatactcagccttcctttcatttctatggccatttatcaaacacctttggccatgatgcattctgttttatatattgctgaattcagtttgtaaatatttcacttgtgacattatcatccacataactgagatagttctgtacttttatttcttgcattgtccctgtttagttaaagaattaaggttcatgctttacatgccctacataagcctcacaaaatgtgtagggaaacttgattgggttttctcccattatctgaagcaatttgtgtttagcattggaattatattttctatgaacacctgttcagtctgggactgtgcgtatgtgttgtttctctgtttggggatggggcagggtataggagaagatgacttactcagattttctgttttgtctagatgaatttttgtgtgttgccaatttttaaaatgtccagaaatttatttgtagtattttcaaatgtattgtcatagtcttaagatttcaaagtaatctacactttatgtgtagttatgttctccacctaaccccaatattgctaatttgtacatattctgtttttaatttttttctctttggttaatcttagtagacatttgtctatactattagtttaaaaaattgtttttaaggaaacagcttttgatttagttaataccctctattctttcattcttttccagtttattaacttttgcttttatttcctttattttagttttaagtagcctaagaatagacaaggaatgaagttatttttttttttaccttttcctagcttcttgtatgcttaactcatttatttgtattttcttgttttacatgaatgcactgaaacatgtttgtttctaatcaaagtacagctactactatagctgcatccgctaatttttgatgcacaatattttcatttgcctttcatttctaaatgctttgatttctgttgacttcccctttaccgtatgaattatttagtagtatattttaaattttttgaacatatgactctgtacccattgctaatttaattgcattgtatacagatcaagagattcatataatgctgatttcttgaaatttgtggtgatattttgtgatctagtgtatgattaacttttgtaaacattcaacatgtagttaacatgaaaacatgtctcctactttttgctatatttacctgaagcttgttcattttgttcttcaaatattcgatatacctaccttttttttttcttttactctatctgccagtttctaatagaaatgtactaaaatttcctagtgtggctatatatttgtcaaattctgcttttcattttctgaggttttatcttaagtgtgctgaggctgtttttagttgtctacagttctctatccatattagtaatttttcattaaatcctattttgcctgatacatttgcaaccacttgtttgttttggttagatttttttctggtgcatttttctatccttttattttaaacttctcagtgtggttttaccataggcatgtctgttataaggggcatatagatagattgtatttaaaaatccagtctgataatctatgtatttaaatagattagtctaatctatttaaatgtattgtaattactgatctgtttggttttatttctgaccaccattgaagtgacaggttttccccaccttttttctctttgtttcaaatctacaaatgttacttgtattctttgctcattattcataaattttagcatatatatattttatttcataacacagaaatttgaagtagattatacttactgtgatacaacaagcagaattgactgatacaactctgtggtcttaccctgggttgtctgaaaaataagctagctaggaccagagccctcacccttcaccctaagtagaagaagccgcacttgaactcagcttcaagggaccagtggctccctggcaccagcagcaggcatagtaaatttccaccgtcccaaagatttccaggtgtgaggcagctggcctttgtagagcacctcagtaaagagctagtatctacactctacactgcctcatgtcaagattcttgtttaatcccccactatcaaggctactcttatgctcatcctatgaaaagtaagagtaacagtttgtgtggcctatgtcctgtgataccccacccttggcatgtttagcagaacaccctggtctctgctcagccttccttggggtcactaggaacctataccttctcttcttcctgtctcctggcttaaatttctccaagcctgttccttaacccatttgctatgtgattgtgaaatcattctcagccctgttgcttagtgagtggtctgcaaaaggaccctacttgcaagacagaagctatgacatacaacccctaaaacttaaatatgtatctaaaacaataagtatttttaatattgtaaatataacactatcgtgccccatgaaattagcagtttttaatatcaatacttaatccacattagaatttccccagttctccagctgtttttttaaatcaggatttaatctaagactaaacactgcatctagttgctatgtcttttacatctctataatctttgttcatgacattgacttgcagaaaaccaaccagttgtctctgagcaggtcattttgcatgaatttaattgcttccctgtaaagttgtttgaattgttcctcttgtccctgtaggttctgttagctgaaagtcgtactaaagccttgcttaaatgtaagttaaacattttagcaatactatatcataggtgatatatagcaatacttcttatgtataagatcaaaagatacataataagttttgttttgtttttcgccattagtaacctaaatttgattattgggttaaggtggtgacaaactcatccatccattgcaagcatcaatatgttctacttgaaacaataggtaatcatttgtgaactaactttgtcactacgtccagttactgtcaatatttttataactaacaattttatgctgaaatactaatttcattaagttttgcagtgtaacagtttttaactatttcatttcttctacatttgctcgcactcttttataatgtagagctttccacagctttctataactggggctatttgattacctggaaataaagtgcatactgttaatgtaaaaaaaaaaaccacttaatttggggttttaaatggccagttttcaaagtaaatttgtttcttggaagtgtcaaatgatgacagaagatttttctttggcttctttcttatcactgtggactcagcctttcataaatacagtgtgtgcaaatcacccatgatctttctttctgatgtctcagctttgctgagtagaagctccttcagactagcttctgggttcttgacatgattgtattaattcttacaagtttccttcctttatggaacagcaagatttcccaagatcactatataccttcattgccccacacttgccgccattcttctcgccaaagatctgtagagaatggtcctagaaaccaaactccggtcctaggtgtgcatcttgttcctgagaacaaattacttctgtatcatgttctggccagacttagggaaaatatgtgaatatatacacttaaaatccagagttgaaatcaatgtctataattgttttatcactgagtttaatttctttgattttctaattgcttctctttcaccttgagagtcttgagtgctattaactttaatgtaagtatggatttgatttattctacaatgtaaatgtttttaaataacagcactgctgttagtacagacaacaaaagatgtaccatcaaagcattaacatgtaaagtcatttgaaataagaatcttttcactttgtagtgtatcacgtatgtgtgtgtgtatacagagatacacacatagtaatttttaaaataaattattgttatccagaatttctgtcttcctaaacataactgccacttttacacactctctctaattgttggtactctcacattgctgtctatagatccaaattttatcttaaaaaaaacaaaaaatgcaaaacactggtcattacattttaagcagatttagccacttgtttgagcaatttttgtgcttgtgtgactcatgttttctgtgaattagcttttttttaaaagctataaattatgagttcttatttgtatttcttcttaaaaatatatgtagtctcacataatagtaaacatcacacttttaattcatcttgttgtaaagaaataagatatagtttgacgatggtattcctgtcattaataaatcataggcattaaataatatgatcaaaaattccacattaaaagactgcttacattcttataaacttgtatttggacttcataattaaaataattcaggtcctttttttttttttttcttctttgagacagagtttcattcttgtcccccaggctggagtgagtgcaatggcgcactcttggctcactgcaacttctgcccccctgggttcaagcgattctcctgcctcagcctcccaagtagctgggattacaggcgtgcgccaccacgcctggctaatttttacatttttggtagagacggggtttcaccacgttggccaggctagtctcaaactcctgaccttgggtgatctacccaccgtggcctccccaaagcgcagggattacaggcatgacctacggcacccagctgaggattaaagtataggtggagacaattaaattttatttcatatcagtggttcacaactatggtacagtataatctggatattttaaggtctaaataacattttcttggtaaaacttattttaaatagaaaaattgaaaataatgaggaagaaaataatatccttctctgtaactgcattcatttactgtttaaaaaataatttgcactacttgctatggccatacttcttagtttagttatactaattctatttagtaaaagcgacgataccaacttttaaaaaccaacatgcaatgagatagattagaattaaaattttatgtatgagagtcaaaccattagctccttaaggatagaaatgtcctgtttttcttcaatttgctcagtatatgatatacagtaactgcagaaattaaatttcagagggattaagtgattttcctaagtcctatcttcataaattttaatatatatcttttaaacatttaaacggtatccatgaaatttaatacaaacattattagcaaaaagccagttagttgaaaataaagaactaagattttgttttttggttactattccaattacctttctattaccctagagctgaataaatggttatttgtgtgaattaaagtgggccacttaaaaaatgtaaatgtaaaataaagctattttattcccctcttgtgtaaacagcagttttcctgtaaatcagggtgtgttttaaaaatcaccatccctttgcttaaagttgtgttattctatataaagaagattggttctggtggtgtcctgctgtggtaaattttgaaaagatgtcgaaaaacttgtcttatttgctttgaagtaagaaaccaagataaaactgaaataaaattaaatggaactagacaacatttcatctcatgctattttttcgggaaaaaaagtccaaatgtatatagtaaccttgaaagtaagtctgtagacattatcaaatcaatctaaattgagttagtgtatatgtggtaggcagaaactggtagaaattagtttatcttccccagactctttctgttttctttgtacaaagtaggataaacttgtttttagacctgattatgtttctttgttgcttttttccccctttccctaaaagggcaaggattgtccatattttgttcaattcacaccaggcgttagaacaggaaaccattaaaaagccctaggcacatgtatgacatctgtagctattattggaaagatgtgttgaatataaaacctgaaacatttccaaataaggaatataaacaatgatccccagtgttttgtagtttcactgcttataaacaacaaattgaagctgtagggctgattcttgtgatatacatacatgtgaacaacctagcccacacatattcctctttatcttattaacaggatctctacaaaatgcacttcagtcccattagacaaatggtaaggctgttgtatgactaatcttagtggacattttaaaagcttattttaaatatccattgcttcttttatttaaatgtatctttttctagttggatccattcattcctagagcttctcatttataagttcagattgtattgagaatatttgtgtcaaaatgcttgattcatatagcactttctgaaataattttgctaatcttcaaattgtctatttgaataaaaacaaagacattaattacaaaaaacttttgaaaagactattgtctcattaacttttatgctaagaattatatatcttatgtaatatatttgcatatatcaatgattttccactcatttgaacttttaaaagttgctaattggtaaaggaatcatctaattctaccttgatgggtttgaaaggagaacttaatagtagtttatggaacgacttcagaaaaactatcgtatgtcatctattgcctgttgcattcagaatgaacaacaacttatcttcatagaaaatggtactactgacttagttgctctgccctctatgtcattcttagtgaaaatgctgtgatcaggtgagctcttagtaatcatggctgtctgatgtatcaaagaggtttattaaaacttggaagcagctgtggcatagtacaatgttctcgatcattgtgcatcgcaaaatttacaaatgttgagagtgtggcttttctttagtctgtaaatggcagcacccaatgacccagattccccttctatttcacaggcgctcaaaagaaaacaaaaaacaagctgccagctttccaatttaatccttaataataacaatcttccaagactccatattttcctaggtcatttagacaaatgttattctacatcaaaatataattaaatgatccaatatcagtttaaattgcattgttggtgtattgtttccaaattataattgttaagtgttctgtagctcactgaatatttttaagtttgttgtagtgcccagaggcaaaaattgcaatgggtacaattttataaatcaaactcattaataaataatgttttcattattactggaataaagagaaccatataggatgaccttttaaaaacattactacttacaatttgaaatggctttaaatggaggattgtacataatgtattgtaatgagaccatcccttccagacctataggtatttcacatcagatttcacagtgaaggaatgtttgagagcttcccgaaagttagacaatgcatttttatcttataatgttttcttccttaaatttagaagttttgtactagtaaactttggttacttatttgtagatttcttttcattgctcatggtgaagataggaattattgcatacaatgattaaattctcccgtatgaaaattatgtttacaattaatatatagaaagtacaacttagctcaataacattttaatccaccctcaaaaaagaaaaggaaaatccaagatcatatattaagaaatatatatatgcctatgggagtttaaaattcaacttgtcttcaagaagacaagaaattttacctcttttttaggttgcaaaattatttctatacttcttatttcttcataagaaatagtttaaaagatgttgaccatagctgccttacctttataagaatttttgccattctaacaaaaaaaaaaaaaaaagaatttttgatagacattttttctgatacaatcatgaaaatatacaagacactccaaaaataacattttccttgatctctatggttaaacttttttcataaacacatacttttgctttgtattgtaccattcaaagtaggaatcaaattttaaacatgatggtaatgttcaaactgataaaactaatattcatcaaaaataaatattagtacaatatcccacaacaaaaatgaaccactgcttgtaattatttaaagctatgaaattatatattttatatgataaattacaactattttataattaacagtgaacatcatagtaattaaattcgtgcagtatcctgtgtcttatgagaactttcttttctttaaactttcagttttacctaacttcatgatgcagagtggttctgtttgtaattgctttgtaaagttctgaagtgcaggtttagattcacagtgcaggtttaaagctgtctggttaactatagtctcaactgggtaattcttatataactagattgatgcagctaagaaaataactaaagtcagtcaaaagtattggtcaccaatgcttcaaacaatcccattaatctggctggtgacttcaaggatgtctaaaacttctggataataacttgtctcttgttatgctaattaccctttccacatttagcatcacatctgaggagactgcagattgagttccatatcatttcaataaatgttatcttaaatgttaacatacttcaggttcaatgtatatagtttagggcttctcaaagtttgttccacagatttctagctctctagattggggatcatcagcccccagccatggactagtactggtccatggcctgttaggagccaggctgcacagcaggaggtaagcagtaggcaagaaagcactgcctgcgctcaggctcctgtcacatcagtggcagcattaggttctcatggaagtgtggatcctattgtgaactgtggatctaggttgtacgctccttacgagaatctaactaatgcctgatgatcagaggtggaaccatttcatcccaaaaccattaccccatttcccccacccccttccatgaaactggtccctggtgccaaaaagattggggaccactgctctagataatctgtgtttcattaagatctggaaatgctacatactatattccctccatgagttcacaatatagcaaattaaatattctgagtaaactactatttcctaaatttatttgactgcaggatcattttggaagcaccatccactaacatcccatagaagacattgtgagaaatactcactgcgtcacaactcattaatagcaacaaagttgcccctgaatccggtccaccaatcacacatcgtttgcttcattatctttgtctatatatagatataaacaaatatatatatctctctcaagatttagattgtcaggtgagtagagagggagggagggaggagtattgtcatttctaagaaatgtcaaaagccacaggtacttgaaaaggcctgaaagatcagggacttggcttcctttagagccttgaacaaattacagaactttgcttggttttgttttgcttttatcagttttattcatcagttgagagtgtcagaaaacttccctttgagttctcaagtttcatggctcaaggcgaattttctgtttcttttctgtttttaagaacttgggtctagaataaaagataagtaacaattcagtcatacccttttgcagaacactctcagtatttgcctggcagtttctcttgatgcatgcgtgcttgattttagagaaagccgtgaagttcatgcattctgtagttctgagagtgatctctgttacttgaagaagccaaaaatgcagagccttctgtacccctccaaatcttatttttaatgaaatattatatgattccaaggaaatttaaacctatgcaatgatttcttagagaataggtgagagagatgcctgagagataacagaatagggacgtctgggatatatatatatatccttggggatttttttgattatagaacacatgagcattaagaaatagcacttatttaaaagagactgttcagttgaatacctgtgttgctactaatcacttcatagctccttactttcctatttaaacaacaaaagagagttggccataggaatttttgtgttgaggtggggaagtttataaaggaatagaacacataatcatttcaatgtctcttttaatggaaagtagttatttgcatttgtcacaaattaaacttacctaattattaaaatgctgccctttggtttttgacttaataattaagaatgacttcattgtgattttaatcccagagagtcagtttatgtctgtataacatgcatggctttccaaaaaggtgatttatgtaattaagagtgagatatagtttatttatgaaaaggtgcttttgtgtggttaaatgtttaacctgagctaattaggagccttgagaattttagttagcaagttaaggcattcaaaactctgaatgggtatttataatttagctttgttccttttattagatgtgacagagcaatttagtattgtaggttcactcaatggctatcgcagcatcattcttcataatttttattaattgtatggttttccttttatgttttcaggtgagagtatttcttttctaaagatagaccaaagacccactttttttcctgagtaattctgtctcttaatgaatgctacttaatccattagggttcacataagtattctatcaagatagaaatttaaagtaaatgtgacttcattaatttaaacttgtagtattttgcttaaattcatgtaatttttttaatccatagggtaagtgtggagattgtcaaacatgttaataaaatatttgacactgtttcagtgaagagctgaggtctaatgtcctctcttcttgaatctggactggcccagtgacttaattgaaaatcatagcgtgcagcagacattgtgtgacttctgagactagttcagaaaaggctatacctgtggcttccatctgattcccttgggcatttgctctgggacaagccagatgccatgtaagaaagtccatttctctgagtccactttgctagaaaggccatgtgtaggcaatctagttggcagccatggcagatctcccagcttccagctcgcatcaatggccagccacgtaagtgagccgtcatggatgcccagacctgtggagccttggcagcagccgactctacatctgactgcagccttgtgagagaccccaagcgagggctgcccagcttagcctttcctgaatccctgacccacaaactctatgagatgtgaatatgtaaaccagaatacatattgctttataccactgagttgcctgatgatttgctatgcagcaataacgaccagaacaagtaggttcaatacattgcatagatctgttcttacatgatgtgttttaaaagataaccatgatttaaataaattactttatctcaaaaagctaatccaatgttattattaccttgtgtcttagtctgtttgtgctgctatacatagcaaaatacccgagactaggtaatttataaagaacagaaattcgtttctcacattgctagaggcaggaagtctaagataaggcaccagcagatttggtgtctggtaagggattctctctgttttcagtatggcaccctgttgctgtatccttacatgacagaaggcagaagggcaaaaagagcaaaagggacaaaaaaggcttcgccaattccctccagcccttttataaggcattaagccattcatgagggcagatcactcaagacctgatcacctcccaaaggccacacttcttaatactgttgcattggggattcagtttcaacatgaattttggagggcacacaaatcttgagggagattatagcacctcctgagaataagttttagaaattagtaatatattattctaagtatacataaataatgtgtgctgataatataaaccataaatttatatcttaaccaaaaaacatttaataagattatgctaacgtaaaaattaatgtgcttaagagtttaattctccatgaattataaaatcacaggcagataccatatagtttatatttatttaaagattctaagagattttctgtactcatactttactacccagaaatcaaccattttccagtaagttcaagttggtgagctatggtatagaattagaacttttcaggttcttgctgagagccttttatctgtgtacatttaaactagtatttttattatagaattaatatatccacatgctcaaaactcaaatcataaaaaagtaaaatgaaaactcagcctccctggctcctattttgtttcagtcccacaggcaacccctgatcacagttgctgtttttacatttttaaggtggctatgataaaacttaaaattaaattttacacgtattcccctttttcttgatttgtcaactttacagaatatctactcttgtttacctgctattgtaaatgagtaatttcttacatttaggttacctcctatctccctttctcctgctctgcttccggttatgtataattttcactttaatggttatcttcagattaattgttgcctttatagctttaaataatatacttaaacatctatttcttgatttacccaccctggccaatatttcttactccttgatatgaaaagggaaaaaataagaatactcttccttatattaacttttccttgattcatcgctatgtttttataaatccattgttacttttatctaaaaatctgttttattctactcttgatgaatatttgaattatccactttgggattattaataatgcttctatgagcatcttgcactgtctttggtgcacaaatgtacatgtgttgctaagtctgtacactgtgagttaaaggctgtgtgtataataccagttttcaaatagctatactaaattatactcacaccagcagtatgagacagtaggaattccatatcctcatcaataattggtactgtttgcctttttcattttagctattctgatgggtattttatggtataaaattaggtttaattttcgtttccttgaggattaaggaggttgagcacctcttcatatgtttgttggccatgtttattttatgaagacttatatagataggtctcttgcccataattgtattggatttcatccatctccctcctctctctcatcactgtgtagattttctttatatattctctgttacaacccttttatcaaaaacatgggttgtgggtatctgcttgtgtcttgctcttttcactctctatttggtaacctgggtgaatagttattttaagctagttcaatctatcaatcttttcctttatggatggtgcttttatattctgttaatatatctttccctattcccaaatcataagcatattctttcctatttttatgaagttgtattattatttttgtcatttattttaaaatctgtaatctacctgaaatttatttttttctgtggcataatctagagttacatttgtgttttaaaaatatatttatacatagttcactcagcaccatttattttttatggagaaaatatagatttacttattactttctagtctatgccattgtccttttttgctatgatgctaagacctatattgtactgctaaatagaaatggtgacgatcttctcaatatttgtagaacatgtttagatttttgccattaaatatgatattagttctaagttttttaatagattccctatgttaggttgaagaaggttccttctgttcctaataggctgagagtttttaatcatgaagagtgttaaattttgtcaaatattttttctacatctgtttcttttgtctgataatgtggtaaactacattagtgaatttttgaatgttaaatcaagtttgcattcctggtgaaaatcgatttaattaagataatattatcttttgtatatattgctatgtttaatttactaacagttgattaaatatttttgcctctctatttatgagtgttactggtccctgactttctttattgagtaatgtatttatatggcctaggtttcatggtaatgctagtttatataatgtgtgggaaagtgttctcttctttattatttctgaaagagtctttgtaggactagttatgtccttctcaactgtttgagatgtagtaatctcggcctggagttatctttgtttcaaggtttataaatatatattcgatttcttcatttgctatagagccctttaagttccatctttcttattggatcattactggtaattgggtcattcaagaaatatgtcaatttcatataaattgtcatatattggcataaataatagaattcctttgtttttctattattgtctgtggaatctgcagtggtgttccctttttcattcttgacattgatacagtagtccccctttatccacaggaaatacattccaagatccccagtagatgcctggaaacacggatagggctgaactctatagtatactcacacacctatgataaagcataatttataaattatgcacagtaagattaacagcactaataatagaacaattatagcaatgtgctgtgataaaagtcatggaaatgtgtgtttgctttcatgcttgtgtgcactttctctctctgtctctctctaaatatcttcttgtgctgtactcacctgttttcaaacctggaaaactgataacgcagaaagcaaaactgcagataagaggacactactgtaatttatgtcttctctctcattctgcctaggtgtttgttaatttttttcatcttttcaaaaaaaaatcagtttgatttcattgattttgtttcctgttacatgtccatgttccattttattggtttccattcttatttatactgttttattctgcttaattgttctttagttttttcaagtggaagcttagataatttattttagaggagattaaatatcttcaggccaataaatttgaagcctttgctttaatgggcaacatattactaactaagcctcttccaagaaaaatcgaaggcctaaattagaagcataatcttaagggaaattacaccaaaagttaaaatatatcttttttttttttttttttgagacacagtctcgctctatcgcccaggctggagtgcagtgacgtgatctcggctcactgcaacctctgcctactgggttcaagtgattctcctgcctcagcctcccaagttgctgggcttacaggtgcacactaccatgcctggctaattttttgtatttttagtagagacaaggtttcaccatgctgaccaggttggtctcgaactcctgacctcatgatctgcccatcttggcctcgcaaagtgctgggattacaagcgtgagctactgtgcccagccaaaatacatcaatttttttaaaataggaaaaggtactagactgttatatagtaatattcttccagatcttcaaaagatacataacctcagtagcataaaagtggttttaagaatagaaaaaaaaaaaagaggaaataactttccaagttacttggaaattcatctagtcttaaactaagtaagaatggtatgaaaggatgaacaataggctgatttcacttataaaaatcaacatcatggtagaaaaagggccaattatggttttaaaaacctaaacatcttcctgaccataccctctctttgattttaatattatttgtgcctcttctctttcatttctttatgtttatcagtcttaccattgacttttctgtttgattcttctttttttttttagttttattttttgaggaaacaatttttgccctcaaaattaatgatttcaaatgtggctgtattttctattttatttctttgttttttatattcatgtcttcttttcatttctttaggcttattttttagtgttttcaacactttatatggtttagaaacttttttaacatctttatgattgaatattttaaacatacacaaaaatagattagtataatgaacctccatgtacccatcagctagtttccataatgagcaacacattgccatcttgtttattttcccatttcataattttactttaatactgcaaagcagcttcccaacatcacgacatttatatataaatacttcagtgtacatccctaacagaaactcttaaacaaaatcactgtgtcatcattccatctgacaaaagtagtgaataattctttaaatatcacctaatacttcgtccatattaaaacttattcaaatatctcaaaaaaaatctaaggatcagtttgtgtgcaatagaatctaaaatgcacctacacgttgcttctgtctattatgactctttgcattcttattgtataattgtttttctgttttttatcttaatttcttagaagttagtgaaaaaacagatttttatatatagaaaacaatcctggaattagcagattgctgccttatggtatcatctaaattgtttcttcattccctgaattttctgtagttagatctagaggcttgattggattcaggataattctttcagcaagaatatttcataggtggtgctttcagcttactacttatttgaatccctttgtaaggaacatgtcttattgctgcacagggttcagatgatagccacccaatccttcctttatataattcaccatcactctttcatttgatgtttttatcacctattgcaatcgttctcttttaaaataaacatttaatttttaaaatgttgttatgtaatttcttatacatttctacatatttctaaatttttattgtgactttctctgttatgtatgttgtttaggtaacatacttcctataaagtttcctaatgtgcagtggtgaggtttttgctcgtttttaggtttctttttgttattgatcttaattgcactgtggtcagagaacaagatgtaagatgtgtatttatgggctctttagtgtctattcaggttgttttatgtcatagtatatggtcatattttttctctatatgttcctttccttataagaataaataataaactttttctctatatattcctttcctaatatgtttcatgtatgcctttgctttaaaacattattagatgccactttctatgttcatttgaagattataccgaagtttctagctgttctgcttaaatacctgatatcctttagtctgtagtagctggcagttattgagagtacatcaaagtctccattatgatgctggatttgtcaatctccttataattgtatccctcttttatattaggaggctacgttgttaggtgcgtaggttggaatttattatatctttctctggattgttcttttttctttatgtaattaatgaccttttaattccctagtaatattttattgacagccttttgtctgatattaacatagtagtacaagtttttttaagttagtacctactaatgtatcttgctgcctttcaatgttgtcatatttagatatgactcttagctaaaggtaagagacattcagtgatcactggttttattttttttagtttgagaatctccgtgtttcattatttcattttaaaacatggaaaatctttagaacttttttcttaaaaagaatagacccttgttcaaacaaaatacttttaattaaaaattgagtttatttttatgtaaaaattgttgccattataaagcattctttcatattaaattataaattatccatgatatgattttttcctttaaacaagaaatgtatacattatcattcattgcttttccttgacatttatgtattttaaacaataaccattggggttttcaccttctttgtactttttatcttaaagttagcattatttaaattaatttaggtattttccatcaaattattggccctaaaacctttagtgctatttttatattcagtatatatttacattttaattatatttgaaggtatttaatttttgtattcatttgaggaatgaaatataacaatatatttttcattattttatcatatttatgaatgactgggttgcactggtgcaaattattatcattctgatacattatataaggctgtatcttccaaagtaagctttaaaatgtgctcagaattgttcattgcagaaaggaaccttgggagagtgctgggaaacaataaaaggtcaagtttaatgccttcaagaacttgtggtgatgctgttgctagcaagaacatactgctttattagttgcatagctttattagtaggtgcagtttactaccactcagtatagtttccagcctttcaagtgaaggagagctggcttaattaattatggcatttctaatctcacttaatttgttattttagtgaagccttcaacaagccctactggtttttcccccaggtgacagtaaatattacagaaataatacactttacaaaatgggtattgaagtgcacctctttggaaagccatatagtgcagacatatttatatgacaggagcattctaaatgggatctcatgtggcctctttattttccatgaagatgcacatagaatatgaaagggagtaaacatgtggcttatgtgggagcaattacaaaggtctctttgtatttcctaagtccaaaggcatccattcacacctagttctgcatggtttcagttgcttctctgtcaatttttttcccagtgcatatgatttgaaaactgtagttactgtgacagtattttggttattagatatttttgttatggttttaaagtaattaatcccttgctactttatacgtttcatgacagtggtggaggaaatggggggaaacctttggaggcactcctgaaagaatggagagagaaattaatctccagtcaacatagggtctaatgcagttataagagaagcaaagatttagggccagccccctgctccaccacctctgtcaattcaccactggatgatgaagcccacaggggtgggtgtgactcatctgcatatccagcccctaataaatcaaattgtgcaattcagggaatatggcaattgaaaaccagatgcttagaccactaagccatcccttctggcacatcgtaaagcatggtgttgtaaatacagcagataattgaaatttagatttcagatataggcactgttagcagccctcctctagctttcattgctgagagtcttccaagtgtgtttaacagttcatattaaggcaattgctgtcaaaattaattaagcatttttattttttcatattttttaatctcttctttgatgaggagagtattcataatacaaacaaaagacaggcgtctgaacttaaaagtacatccaaactgaatatggaaaatattctatagtttgggaaataaagttgtgaactccccatttggtttctttcaagtttttgctttaaacaaaacacaggttttttaagaaaaaaccttgctactccattgattaaaactgtcatccttctttgtccatcatataatgtactttccataaattagctgcttcacttctttttataccaatcaaattacagtggtccttaggcttaagtgggtcacaggacttggcttcttataaccctcaaagccccttagctttttataaaagccatcaagcatgccatttgatctgtacattttctctttttttttcttgctgtcttcaatattatggacaaaatttggaatattttagtaggttgtctacattttataaaacctgtttttgtaatgagactgttacaaatgagagtaatgaatgcaataaagttaagaatttgttgaaatgatattaccttattcaaaagtagatagagtaaaagtaaaaagtctatgaagagtggtggtttgaattgggcaatcaacctgggatgaatgtcaccatttcatccgtgttagtattaggcatttcaaatggcaaaattatatcaccaataatattctttcaaaaaggaaaaacagctctaccaggcttgaagtgaccctgaccatcatagctattcagacagaatgggtgttttatcattccatgtgaatatcgtgtgttgatcggaagtcataccaaaaaaaatacttaaagtgcatcttctaatgtgacagtgtaatcataaggacatcagagttaagccaattattctagttcacagcagttttaaattgaaagctatttttgtgcaatggcatctagatgaatgtgattctcagagacaggtaaatagtgtcaggctctaaagattttgcaactgtgatccaaatgatgactgagttcccgcagtgaggccataactcatgggcactcaccagtctttccagtactgagaagtcatcattagcaccctaatggaaactgaggatcatgatagaaacgtactcagtgatgcatttgacagctgtacagagtaacttcctttagagggaaggattaaaatttgacagagtttgagcataaataaggaaataaattaagataagactagatctagatgcatgagcacattgaggattgaattattcaatccaagtggacagaaagaaaataaatagattgttatatttcttttttaaaataatagggtaaaatgtgataagctgggcttggggggatgactgagttgctttgaaaaataatgggaaagaaaacccaagcagttttgctctgttttaaaccatttggaccatagccacagaattcagaggaagagaaaactatgttaagtaaaaatcaaccctcaactttcactatgttcgggcaaaactctgggaacagtgagacaaattcatgtcacattaatgaagagagttactgacttacactgtcccctttctattcctttgtatgtctttctgcctcctggtctcaacctctttgtgtcaataatagagatttatgggaatgactgccaatcataatgcaaagtatatagaatggtgcaacacttatgactgtcttttttttttttgaggtggaatcttgctttgtcgtcaggctggagtgtagtggcctgatctcagctcactgcaacctctgcctcctgggttcaagtgattctcctgcctcagcctcccgagtagctgggatgggactacaggtgcccgccaccacacccagctaatttgtttttgtatttttagtagagacggggtttcaccctgttggccaggatggtgtcagtctcttggcctcgtgatccacctgccttggcctcccaacgtgctgggattacaagcatgaaccaccatgcccggcctgcagtgaggccataactcatgggcactctcttttttttttctttcttttttttttttctttttttctttttttgtttgtttgtttggagatgaagtctcgctcttgtcccctaggctggagtgcgatggcatgatcttggctcactgcgacctccgcctccagagttcaagcgattctcctgcctcagcctcctgagtagctgggattacaggcacctgccatcatgccaggctaatttttgtatttttagtacagacagggtttcaccatgttggccaggctggtcttgaactcctgacctcaggtgatccacccaccttggcctccccgactctctttttctgcaagcgcttaatccttgggcttactcataaaatatgtgccaccttgatagggacatacctgaccatctgactgaggagggcaaagtaggaggtcagcaaacaaatttcatgccctggctcctttcactgtccatggcacttcagcctagtgctgtacaccaactaccaaacaaccagtcatttctctgtttttcctttctggtgagatggcaaatctgagtccaaaatctcattgattctccatttcctgaagtcaagggtaggactgagtcaattattttgttcaacttttttgtatccagtggatgtcctaaccattactgtttctgtatgcatgtacttcagtctttaagaaagaatgaaaaccaggtttttttctttattgtcatatctgtaatttgctcctttctcagaggaaggtcatccacagaaaattaaccaatatgtttgattctatagaactatcatttttgcgtccagttgccattccttctgaagagctgttaaatgcagtgattttaatctgctttgattgcctcacaagtgaagaggtgatttgctgtattttgtagaggtgcatcaacggagtaccctcagctacagaattatttcccttgtaacaagaagagaagagcaaggtttacatcaccactgtgcttaaaaactcttatctgtcaggaagcatgtgcttttctgtgcaaccctgggagttcattaaaagtgtgaggttgcctcactaattagatatggcggagtgattgggcatagtgctgtgggagaaaccttaatgtaactggagtgaaatgaaaatctctgttttgttcataccaagggaaggtttgattaaaaagatttcctctttttcatttgggacactgttttgttgtgtcatgtggcattgagtaagtgatctgttacaggtttgaaacataactgcttcatgtatgtttttaaccattccttgttattattctcataacatattaaaagtacagttcaggaaagatccaaatatttacaacagtttctctggggtttgttatttctgcatgcacttgtgaaaaggagtgctggcccacattcctctgctagggagtatggtgctgcagtcagcttcacaatcagatggcaggttgggtaagttggtttactcactcagtcagttaatatgagtatccactataaactaagccaataaaactcaggcagacaaccggaggtgtttttacatggctttctttcttccaactttgtaagctagaagccaggtcagtcttcatgaggatttactgagtgtagacactgtgctcttggagcctcttgggagtggaagtggagagagacgggcagtgatgcacatgctatgggaaaagattggcccattagtgtggggaagttctttatgaagctggtttgtagctcttaggcaaaagcaatcagaatgtgtaaacagtcggccaatttcatcctctaccagttttcattgcataggattttggccccaaacaattgctcaactaactacccatttggtgagtctgaatgggattcaaggattaatccagagatgatatttggattaaatcatcactgtctaatagaagcagttataaatatgtaaattaagcaatctgattatagtacaccttggctgcttctagttattctagtaattgtctatgcagggttagcggaagagatttaagcattagaggctgaagtttttcaaccccaaagtagccaacaaatggaatagaagttaagaacataagacctttagtacttatggattcaacatttgaaatcatatacacatactacatgtaagccaaaggcccagagcttgtaataattcataattttgccgtggcacaaactgcatcatttacactgggaggtttgtatgtggagtgatgtattttcaaagaggctccagaaaagatcgcagcattggcgacctctcacttttctgcaccttctcggggaaatagatgaggagggtggccattagaatatcctccccacattcactcaggcttgttgttgttgtttctagcaaccaccacctctcctatttagatatggtcccacagagctatcactatttaaggatgtgtctgcgaaaacatttatcatcatctcagtgctacaagtctcttacaattctgtcaaagatatgggcttggattagcagctacatatcagttcttatcttacacttggaatgggggtgaggttagagaaagaatagcagtgtgtttgggatcttgctggtgctcagttgagttgaattatagaacatgcaaaggggaacagtagacgggccattcattagtatcttctctccagcttctgtgctccttactccccagaatggactcttcagagcaaaaagtgtatacattttttcatctctgtatctccagtgcttagcactggagcaaaggggaccctcaataaggacttgtgaactgaatgattcctgttttgctatgggtttgctagccctgttatttctcatttgatgatatagttttgttgaataatgagcgttacccaaaaacctttcccttgaattcccgtgttcaattttgcttttgattacagagttcctaaagcagaaggctactagagggagaaggtactgagtgaggtcaaggtgtaagatgcctgtggacatggatgtcacccagggtgatactaaaagataaggcatgagagagggagaaaatattaattaaaatgatggagcaagaggaagtgctgaaggaccaacttggagactctcaggtgtggacaatgaaaagggaatagtaaagcagcatggggcagcttccagaggaggaaacaggaaattcttatctagaaacagctccaggatgagagtgggcagcatgaagaaaatgatcatgtctcacttcatagggttgccgaggaagtggtttctttggggaaagtttattgtcatttacatcaaggtagcagagacaatacttaaggaagttcttgagcttatgaaagagtttcagggcatcctaggaacagaggaggagaagggtttggaggtacttgggaggtgatgcaccaatgaaggctaaggaaatgccgaaagaagaaagagcaatggaagaggacagttgccccaagagttgtttctaccttgacccacgattaagtctaaagaaaagagatagctggaagaggagaggaatatcgagcaagaggttcaaaacagattttctgagatggtgggccttgcttgcagtcttgcctcaagtgtaaggtccccatactgatcaacaatctctagtctgtaggttcaggatctggaggtttcagcatggaagtttcctttctcagctggtgagaatgtgattaactcaagcttccagcgattgtggaacttagttgattttaaatattggtttaaatgtattttataaataatgaaagtcattttaaattacattataataaataaaatataggtgcatatgtaaagaaacataaccagccaggtacaaatcagtgcattctcttttacttcaattatttcaatccataaataaagattagctttcaattgcactttaaattctcttgccagagatgcctctggcaatggttccagctggctggcaacttcgaatgcagagacagtatcatattgtcatattcatctttgaatccccccagagtccagcacaatactctgcacatggagtctagcataatactccagacgtcataaatatatattctattgaaagttaactaagaccctttaaggaaaaggaacagatttgtttacccagtaaaccccttgcaagtagagtatctgttgtatttcagtcctgtgctaagtgacagggataccaagatggatgagactcattccccacctcaaagctctcagaaccaagcaaggcagacagacctgtaaagaaatcttcacctaccccgagatcaatgaatgccatgacagagcttgcacatggcatgaaagtggcactgaagagggagattgagtccatgcagagtgttcagggaaaaagtggctcatactgagttgggtgtgaaggtatagatggctggatatttgccaggcaagcaatggtattctagaaaactggtgtatctaggtatgtgttgagcatctcccctttgccaggcactgttctaagctttgggaatatatttgtgaacacaacagataaaaaccactgcctgcctacttggagcttacattttagctattgataaccaatagattattttaatgggacagtgcatccctctacctctcaagcactgtaaagttttaagtttaaaacatttgtatttaaatagaaatgcatggtggtttccttgtgtgatcagaatatattctggtctggctatagctacttttgcagagtctctcctaactctttgttgtgtttctacccttgctcaaaaaacaaacaaaccttttgctgactgctgcccatgactacagctgctctcagcagttcagacctctgcacctcatttcaagctgtgtttccacatgctataagaacccacgatggtgtagccggctctggatcaccctacttctctccatacagttgtctttgactcttccgctgttcctccttcttcacataagtcatggtaaggattgcttcaagtgcctcttaggttgtctgaagaaaacccttccccaaattgtttattttcagtaggtcttataagctgtgaaattgttttttgaaactagaggcttccaataaagatgtcacaaagtgaaatgcaagaatgacaaagtgaatggcgaaatgattgtgtaggaagatatatgaaggtcataggagagcaacagatgcacatggcaaagtcaggaaggtttgagtctgggtgagaagagggtgaaatgcttatagacgataggcaataaaaaagaccttttcaagaagtccttgaacttgccttattcatgaactaagatggcttgtcaatgcggttctctatctaatagttataaaaaaattctttaacacagttttggcttcctaaattttgagattttttttttctaaatgtactaccaaactaagcacacatacgaataagtgtgcttttcttttctttcttaccctgttcatgacacagctatggaattggtctgtggattaaaaattttctgcagcacattttcatcctgaagattttcgtcatgaagaccagcagggaagtatgcttgtgttggcatgcgtgaaatgcctgtgcaaaaataaacaattgctttaatagtgtgaccttttatctctactctctctgatccaaacctggcttttgtatagctttgcatcagtgtatatgggatatttactagagccaaatttgattgagatgtatttcagccagcaaaatgaaagtggttaaggtagaaatgcttggtaattgctgaattatcccaacttccttaagttttttctatttaccagctttaggtgatgatttggagttacaaatgaagccctagtaccatataaatgtccattttgacagacctggattctaaatatttgagaagatggtatagtttaaatagattaaatgaaagaaggatgtttataatacctttgatcatacattttatgatttagcatgatctgaagcagaccttgtggaaattgctgtttttcaatatcttcaccctttcaataataaacaacattatctttgtgtatcgaagcactgggcttaagcagttttaatatatttaatgatataggaaaactaggggaaaattagctataactgaatgtgggaaagaatccaattataaatagaaattatgattataaacatgtttatatcagtcttgtatttgaaaaaattgttttccactcttttcagcacttttgaaatgtgttatttgaatatgagaaagaaacagtgaacaataaaggaggggttgcagaattactttgttgaacttctaaacttctatggctctgaagattttaaagcagcctttacttgaacatatttgtgtagggagaagtgcacccactggtgttagccttatgttgaaagattagcagagcagatgaaatgttgatcttgccatcagtagttattttcatttctgatacctcgatgagatggatgaatgtgtttggtccactcaaatctcacaaatgaaacagaattccctctctacccaccatcacctctgccttttttaaaagctcacagctgtcttttgacacctggtatcagcttaagtcaacttttacacatttctaccaaaaataagcgataaaaccaaacacaaacaaaaaaactccagcaggtaaagggtataattttaaagaactttattataaaaatttcactggtcttttaaaatctcaatcagaatactgagaaatcttaacaatgaactctaactgtgctgattattagcaatgagaagaaaagaaaatatccaagaaaagatcataggaaaataaaaaagaaataggggtatagagagaaggttttggttttatttcaggtatgcttcatgccatagatttattcctcaaaagttgtatagaaattagtatgttaagaaagtataaaagtgttatctattctgagagtgcttctcaagggaagctctccaagaaaacatttggtcaaatgaatacctcttaattgatctgttggggaatttttatatgtatgtttattcagttggagtttgcctgccttagtatttggtgcattatgacattttatgcttggaatggaccttaaaaatcttcttatccccaatataaagaaaatagaagtgagggccaggaggtgatgtgtctggtcaccagacaaagcaatgatgaacttatattagaatctgtgtctcttttgtgttagaccagaattcagttactgtatcttgatcttcactcattttaaatttatttttattaaacctatgaaaatcattcagcatctcttgcagacacaccagatgaagagaaggtgtggccaaccctgattatattgattatcaatgggatttagcctctgtagcacataatccacaactgcataatctctgtgaaaacagtccattgaaagttgtagacttttagtgcattttacaaagttcagaactgtttacactgagtgcagttttatcccatatgcattcaggtaatttatccacatggcttagtgtgtgtttgtgaatgtgcatgagcaccctgtgtgcatgctctccataagccaaggatttgagccagtcatttaatgttaatgattttacctgctcccaggattagcaagggactagttagtagaatatttatgatctaatcgtattccaaaaaaggttttttttattttaaagatgcaattattagagcataatctctagaataatgaaaaacttgatagtctttcgtataaataatttctctgtttgtttcataatatggtatcttttccttaccctgtttgcctgaaatcaacaaccaagagacattacaaggtaaatacagttaatgtgcttgctttcaaaactaagtcttaggaaacgggggtcccaagaaattttggttctttctttgaccttcagtttcttcttcgacaagatagtcatctttttgtcttgcatatgttcaggtatgaaattggaataggagtgccaagaaatccactagattgttgtggatatacatctagttatatgtgaaatagtttgagatctttgaaagaaaggtaaagtataatgaagacattattataggtttttgttgctgtcattaaaaaagaatccataacataagtaataaggtcaacattccttaagtcagcaagtatttattgtggtgcacagaaagaacactgaactgagtatcaagaatcctagattctggctttgtcactaacacaacatgtaaaaggagaccagtcatttcagctttctgcgtctgagtttccttagctataaaatgggtgaactggcttcactcatcaacaccatccttcccggcttagttaataatttttaggatttttcctgagtctcagatctgtactagctactttaaggcagtggtttttgaagtgtggctcctggacaagcagcatcagaaacttgtagaagctcgggactcaccctagacctactgcagtagaacttcaagcattgagtgcggggcccagcaatctaggttgtcacaacactccaggtaattcttctgatccacgttaaagtttgagaaccactgttaggcatagaaatgaataaaacacagttcttcttaagcagcttttaatttagcacttttatatctctaattgtcatgccaatttctggctatgtaggtgtaaaatctagtggcgtgtgtgtgtgtgtgtgtgtgtgtgtgtagtaaattataggcatattaattgctaagactgaaacatttagggatggtatctttgaagtcaactgagagatttccaatggcaaggcatttccaaaggcataaaaaatatatatgaagtttgaaaataacagtgtttaacaatcaaattgcatgttaatttcatgtgtgcttatcaaatacagtttgttttactttagcacagatatttttgttctgaaaagtaaaaacaaatattctggaattatgcccagaattttaattttaaaatttacattatgattatgtatgagcaccaggcacataacctgatgttcagatcctctctgtataatgtttctattactctcattctaacattcatgtgtattttcaaaagaaacttgcagttgacttttcagaatgcaaatcttgtttttaaatgcacctgagtttttaaaacataattcagctgcagttaaattttatgggcaagtggtttccaatgtagctaaaattcattgagggggaaaaatcatggccatatatgatcacctgtaaatcagagggagatacttattgatagacaggaccgctatttcagttctcatctgagagatgaaaaaccgagcaataaaactacttttaatttcattttgtagcgacactagaccagggaaattccatgagaacttgggaatgcgatgagcattctcttccaaaaaaaagtatcaatagtgttaagtttctttggacatgtataacctagtgatgcttcataatgaatacacgttcttgtatgaaatcagtgactggtactaactgtgaaatatgaaatgatagcctggtactgataccttaatcacccctggagagaccgttgcccctcttggtgcctggcccctttcatccagcctgtgagcacttgcagttgttagcgctagtgctaaccaaatgtaaacacctttactttccagctgttgctaattggtttgggactaattatagaagtgttgattttaaagctaaaaatagtgcggtgatgtttaaatccaactcattttggctgtcagaaatgctcccttgatcctgaaagtgttgctaaaaacgttcgctttaaaaaaaattgtagtaattaaacttgtctgttgtgagagctacatatgatctgtctgttccctgctctgatgaaagtggtaaagggcaaacatcttaaaggtgtctgaccagttggcaggacacaatctcctgctgaactttattttagacagcaaagccttgtcatttgaccaaaagaggagataaaattttgaaatagctctataccttgtatttcatacagctcattatatccttctatgttaacattaaaaatagaagctgtaagaattatattaataaaattaattatagagcgtccaaaaccattatgttttctagaggcaagtttgaggatttgaaatcacataattaatattgttcaaacataaagctgaagaaatatggtagctgtttggcatcagttgtttatacctctgattcttcataatcagggttatttttctacctttccttccaaatttaaaagtcatcttacagatttttctcaaagtcatttaaataagcaatgaggaaaactatattttcatttttagacatgtgcaatttcatgactcttcattttaccatgtaatttagtgaaggaaaagcttaagtattcttaacttatcatttgtcagttattttgtaatttttggaaaaaatgattttatgtaccctgttaagaggtaaactgccttgtcgataagtatcaaagcactgcacagctacagtgttgctgaagtcaatttgaaattggctttatgtccttataggatgccctaagcatctgtctgcctgccccatcttcagagaatatcaaagaattttgttagtgcaatatatggaaatgatcttggcaagtgataaacactgctcattagttgagatgataaactatagttactacccttttttgatagcttcggcaagggaaagtgtttttgatattatcttaataataataggagatataagtctgtgaatgtgtattctttttaaagtctgtagtcattgacatgatttctccaaatgtgtagtcagttcagaattacccttgagcagattatgacattgtatttggcccaatattactttcaaattgtaattgatatttccatatactcagagaattaagtaacttgttgatatgaatagaatctttacttgctatctaactggaactagatgaaaaattcattttttaatcttgcgtaatgttgatttgagccagaaagtatgttatttttctaccttgttagggatcaacaacaaagttccatttagagtatggtgcagaggcaacaataatgatataaaactttatagcaaatatcagtttttttctttgacactctgaggatacatcccatacagaattataaaactaaaaagaatatttattttaattaactgtcactgttaactgttcatggattgagagactttatgatggttagattgtgatactctccaaattgatctatgtattcaatgcaatccctagcaaaaacccaactgttttttttttgcagatattaacaaactgattccaaaattaatatggaaatgcaagagacccagcatagccaaagcaatcttgaaaaataagaacgaatttggaagaatcacacatcctgatttcaaaatttagtacaaagctacaataattgactgtgtcgtactgacataagaatagacaggtatagatcaatgaataaaatacaattgaggatccggaaatatacccttacatttttggaaaattcattttctttaagggtgtcgagacaattcaatgaataaaaaaacaatcttttcaatgaatgatactagcacaactagatatccacatgcaaagaatgaatttgaactccttcctcacacagtgtgcaggaatgaactcaaaatgataataggcctaaatgtaagagctaacaccgtataagattcttataataaaacaaaggtgtacatctttgtgaccttatattaggcaatgtttcttagatacaaaaccaaaaacacaagctacaaaagaaaaaataaatacattggacttcgttaacataaaaaacttttgtgctttaaaggacacatgaagaaagtgaagacaacccaaagaacaggaaaacatatttgtaaatcatatattggataagaaatttgtatatggaatatttaaagaactctctacaggtcaataataaaaagacaaatagacatttctccaaagaagatacacaaagggccaataatcacagggaaagaagctcaacatcattggtcattacagaaatgtaaatcaaaactacaatgacatatcactttatacccattaggatgaatacaataaattaaaattaaaaatgaaaataagctgtggcaagtctatggagattttatacccattaggatgaataaaataaattaaaattaaaaatgaaaataagttgtggcaagtctatggagatattaaaaccctcatgtattgctggtaagaatggcaaattattcagacatgtgggaaatagtgcagcagttcctcaaaatgttaaacatatagttaccatatgagcaacaattccactccacagcgtacgccagagaacagaaagcatatgttcacacaagaacttgtacccaaatgttcatggcaacattattcataataggcaagagtggaaacaacccaaatgctcaccagctgatgaatggataaacttagtgtggtatatccataaagtggaatattgttgggccataaaatggagtaaaatactgatatatgctacaacatggatgagcttttgaaaacattattctaagtgaaagaagccacaagtcttatgattctgtttatatgaaatgtctacaataggcaactcctttgagacagaaattagattaatgattgacagggcctgttggggaaggggaggatgaggaatgactgctaatggagtttgaggtttctttttggggtgataaaaatgttctgacattagttgatgatggttacaaaactctgaatatactgaaaaccacttaattgtactctttaaaatggtgactcttatgtaaattacatatcgataaagctgttgtaagaaataaaaatgatcttaaggcaatcctttagatgactgtagctgcagccccgcagacatggggctgcaaacttacaagcgatccaaccctagaaccgcctagctaagctacttctaaatctctggctcagagaaactgtgagagagaataaatgtttatttttttaatttattaagttgtgggataatttattatacaacattagaaaattaatacaatgagctcttggtgttatgtgcttgatatatagagaagcagacacaaattcattcctgtgtaagagaaacagataagaaagttaatgattttggcaaaaatgaggccatcaaatatcctgacatacatgataatcacaggttccaatattatgttaaattatccacctaagtatttttgtaacccgcccaaccctgtctccacttatctgtaagcatatatcaagcccttcataataatatgaatgtttgagagctttcaaaaacaatcgtcttttaaaatttggtaccttaaaccatgaagtgttctttagccttatggaaattctttcttatctacatgaaaaggagaaaattaattttttaaaagtctagagtagaccaagtgtttcacaaaactaccaacccctgcatgaaatgttgctactcaatctaaaagtgagagacattttttttaactcatttcactacaacaaagtgcttctgttgcagttatgtcttactttctttaaaataataacttggctgggcgcggtggctcaagcctgtaatcccagcacttgggaggccaagacgaccagatcatgaggtcaggagattgagaccatcctggctaacacggtgaagccccatctctactaaaaatacaaaagcaaaattagccgggtgtggtggtgggcacctgtaatcccagccactcgggaggctgagccaggagaatggcatgaatcagggaggcggaggttgcagtgagccgagatcatgccactgcactccagcctgggcgacagagctcaaaaaaaataaaaataaaaatatatatttttttatttttttatttttatatttatattttatatttatgtaaaataaacatattttatatttatgtaaaataaacatattttatatttatgtaaagtaaacattttatatttatgtaaacattttatatttatgtaaaataaacatattttatatttatgtaaaaaacattttatatttatgtaaaataaacatattttatatttatgtaaaataaacatattttatatttatgtaaaataaacatatttttatttatgtaaaataaatatattttttatttatgtaaaataaatatttatataaattatataaataaaatatttatagatatatttatctgtctcaaaaataaaaattaaaaaaagataacctaatttacttatgtccagcctcttaagctcgtatgttgtctttcttactctgttggaataatgcattcagatgcataaatgctgtttataagtgtgggtttttgataatgggtctttctatatctggtttgttgctttgatgaaaccggagtccacgtgtaacaatagtttattgtgactccacttatgaagagacaggtatccacaggattccctgttagggaacagctctgagccctaatgtcttctgtaaggaagcagcagcatcaggcgtgctttctagaatccatcctctcctctgcttctctgggtaacatccaatacaacttttccactgtcctggagtacagggcctctctgaccctctaacctttctgtagtgggagcctgtttacaattttagaaattaaataggcaatttgaatctctctctgaagattatcctcagagtcaaatttcatgacaaagtaagagttctggatttcttcttcctgcagtgtttctgcctgactttgacagaggtgactttgccaggcaatgttttttcatggattttgcttttctttatattttaatgttgtgaggggcaagcaagtacgtaccttaaggctaatatatcaccatctgtcaccagagtcccccctttggtattcttttcctttctggtttaaaacactcaatcccaaaagcctatggctgagtagcaagaagctaaatgtattccaaagctcttaacatattgcattgtgtagatgacccatttgagcatttcagaaaccaaacaggagagaaaagaacattgaaagcacagaaaagattaacacctgcttccagttttcaaagaaattagagcatactgtatatatccagcgtaaagcggtttactctcccatattgggatattttattcagattttcaattcaatatgcacagcatcacatgcttatgactttgtttcactataggattccacgcagaacttggaagacagagaagttttgaatggtgtacagacagaactactaacttcgccaagaactaaggacacattgaggtattctctttatacagataagaatatctgatttatttcaatttgatgtgttttttaatagtttataattgttcttactttacaagaaagatcaggataagtagaatcatggagtgcaacatgtcccaagtctaacagttacttaattcttcttttctagtgttttcttcatatgagaacttactgacaaacatatatacaaatgatccttaatccatccaatactcttctgtacccaggatttctgaaatacttttttctctcctcaaacagcaatttcaaatgaacatttcagaggtcattgtggtggttttactttgactttagctctttgaaagcaccaaatcctagccactagaccaccggggaaccctaaatttagctctttgagtgctactttgtattgtgctttaacacccttgtaatagtttacttgatgaaataaaatgaaccctgtctatcaaccagggtttttcatgttcttaatgaaggcaactcatttgctgtcagtggctgccatgtttcccagtactttctttgctttgcattgattcccagttcagctctaggtagtgcctgggttcatatcgcagctatgcctctttactagtcctgtgagcttagacaagttactcatttctctttctcttagtttctagtctgtagaatggaaatagtattaaaatcttattcagagggttagtatgggtattaaatgagttaatacatgtagaccattttgcacagtgttgtggttaggataaatcctgtgagtgtttgctgctgtttctactactatcattaatatcacatcatctctattattgttctaatcatcattttgtttaacgcacttcaaatttggcataaggaaaataatttcatatttaatagatggttacttcagcattaggtaaagctactgaagtttataattattcatgcagttgacgtattcctttcatttagtccaaacaattaacatgaaattagctttttaaaaacataggtcatcatcctttgtcatgtgctttactgtatggattctcctcaaacttatttatagccacgtgagcatagttactctttatttagatcgtttctttgactgatgagctatacagtattaaaaatttgatggaaactaggctaggtggtgcctgcctatcatcccagctacttgagaggctgatacagaggatcacttgagtgcaggagttcgagtccatcttgcaacatagggagaccctctctctctctgaagaaaaaaaaaaggcggggggatatggggtagggagtaatagaaaatcttcaagcaccatcttttcagaaacttaataagattatctaattatgtctacctccagaaactaataagattgtttctggaggtagacataatgattgtaatgctcttattctatttggctttaatttcacttatttcagtgttagctttttgaaaagtttgttaatatcttgtccaaatgctatgtgaatagcatcatagagtcaacattagtttggtttatggctgtatgaacaaattagccaagctttcttcagctacagggaattgagagaaatggagtataggaacttaaaaatatatatattcttttatttatttatttattttatttttattttgagatggagttttgctcttgttacccaggctggagtgcaatggcgtgatctcggctcaccgcaacctccgccccccaggttcaagtgattctcctgcctcagcctcccaagtagctgggattacaggcatgtgccaccccaaacccagctaattttgtatttatagcagagacagggtttctccatgttggtcaggctggtctcgaactcctaacctcaggtgatccatctgcctcagcctcccaaagtgctgggattacaggcatgagctaccacgcccggccaaaaacatatatattctttagttaagaaatgtatgtgtgtgtgtgtgtgtgtgtgtgtgtgtgtgtgtgtgtgtgtgtgtgtatatttgattatcaaaacgggcttttcacatgagttttcttatcacctttaataggttaaggaactacaattcatagcaattaagtgacagctagagacttaattgacacccaccactcttgtctacaaagccactatttcaaacattcctgttgcgtgtacattccctgatgccttggtgttttatttcatgctacctgaccaaggctaggaaacttctcatataaaagtgcagctaaaatcagttttatatcaaattcaaaaagtagagtgagtgcaattcccagcactttaagaccctggagtgggaaaaggatgataacaatcttaatgccattgaatgcatgggggaaagcttggaggttacagttctaagacagggcattgattctagccagtatgagatgaaaaacagttgaagtgaaattaggaagccaattctgtctgaattacatggtccatatgctcctggggcagggagaatctcatatgccacagggcttggcccatgcataggactttgggcacgcatccacgtagaagctaagtaaattatttgtagtctatctcaaaatgtcttgtaactgtttaatttctataatcattgctcaagcctttgttatccctcagctacaccattataataacctactaacttctctgtcaaatgtcagtttccccttattctaattgatcccacatattactgttggataaaatgttttaaaccacagaatttatcaagccattccttagttccagaccttttggatttagataagtcttgggtttgagtactaactctgctacttactacctgtgcaatcttggactaattacattacttctttaatatgtatcttcataggaaaattggtatcatggtcacatagattattgtgaagattaaatgagatatagtacagacaaccgacttagcacaatgctaaatgaaaggctgaagaaacattaattgctattgccattatcattgtcatttttacacagattgtagtttattgtaactatttctcattcacccaagcaagactgtgaatcctccaaagggtttctgacacctaatacaggtcttggaatataatagggacatatttgctaagtgaatgactgaatggataaaacacattgctccataaatcataagcaaaactgttaactgctcacccattattaacgcaaacatctttatttaaaataacatttaaaagacattctccaaatagttttacaatatgcatctcttatgaagcaccactcaacttattttgatcttaaaaagacaatgaagcaagaggtttggtggttttttaagaaaattacactttgaatgtctctttaaatagcaagcaatatgtacaaaagaccttcacctcatccctaattcctatctcatttctgactctgccttatctctccactcctgcttccacagataagccttcttccagacttgccttttgtttcattcttaaaacgccagcgcattttagcctatcctctcctgtgtcaaggatatctattcattgatcaaactgtttgcagaggccatctcaaaatatgtgggacatttccccatgttttgatgctttattcctgtaatcattgctcaagcctctgttactctattagtttcagctagattattgcaataatttagtaattcctgcctcaagtaccagtctctcccttgtggttcccttttccaattggtgtcacatatcactgcataaatatttctaaaccatagcgtttatcacacttctccctaattctagaacctgtagtgacttcattttctgcaaattaagtataaatttgctagccagaaatttaacacaccactctgagctttgatctcaagctaatggtttaatctgtctcctgtacacagcacctttctttgtttcccttttctcccttcttctttctcctcgttattctctctcccaccttcctccctccctccctctctctaatattacaaccaattgttatgctcacagactatcctcgttcaatatctccatacagttgactttctctcctgtgcatgcccactccatcccctcacctatcttttctgatggaagacccgtttgtccttcttcaggaatagattcctaatcccagcttcccttcctaatcctgtaccctcctctgaaacacatcacaaggtgcctccactttgaaactgcaccttggttaggcagttaagaactctgctctggggtgcaataaatcactatttgagtcttgactctatagaaatggtatgatgtcggacaagttattaaactctctaagcataagtttacttctaaaatggatgtgatataaatgtttactttatagatttagtatcagtacatgatataatgtccagaagaaggttagtacactgcctcccaagtaataccttgcattcaccgagaatctactactgtaacccatcgctttctgttcttttttattacctgtcacaaccttccccttagattataaactcctcaagcattggtctttgttttttccttgtggaacttccccaatgaaacaactcaattaatatttgttgaattcaagtgaagtaagtggatctcatcaccaacaacaaagtctttgatagatttttactcagtacatttgcatcctcaagatatttcaccatcaagtagagttcaaggttatccacagattcttcctggaggtttcgctctgtagtccgcctctcatactattgcatgccacagatctatgaatccacccttccagaaaatcagctaacactcagccatgtgctgcagtcctttgtcttctctctgcatgtcagcagtctgattgcaaataaaacgtgttcctcaatcctgcagtatttaaggcttttttaagaaagtcttactgaggaaatcaatagaaaaaaatggattattctcttttagcctataagcttgtttccttagacagttctaacaatcatactaatagcaggtagttattgaatgctttgtaaataccagatgtggtatgtgtaacatatatgtgttatgatctttatttttcttattaaagccaacaactctaatagggaaatacctaatctttttttttttttttttttttgagatgaagttttgctctttcacccaggctggagtgaagtggtgtgatctccgctcactgcaacctctgcctcctgggttcaagtgattcttatgcctcagcctcccgagtagctgggactacaagtgtgtgccaccacaccctgctaatttttgtatttttagtagagatggtgtttctccatggtggccaggctggtctcgaacttctgacctcaagtgatctgcccgccttggcctcccaaagtacagggattacagacgtgagccaacgcgcctggccaggaattacctaatcttaatgttctccgtgtgcaaatgaggaaactgaggcaccaggtcttaattaaaataatttactcagactcctgactcaaaagttaccactgggatacactttctctgtaattacacatgtgaatcatgattttcttctgaaataaattacccccggctccccatcctcaatttcatctcttccatacctcaacaagtgacctgccactgagttcagtaatcttagtgttaaaaatgctgtccatttgccttgtgtaaagaaatgagacttacaaacatctgcagcttctattgtatatttttccctcaagcttgaagtctttcttctggatggaaaccaaatgaagcctttcacttctagctctagcagagttgccattcatgacagtctcatttttagaccactgattctgcagcttcgcctatagttttgtctaaatctcagattggtagcagctggtttcagttttatcaattagatcttagagcattttgctattttaatactagttgaactaatgctttgtaactatctgcttgttttagtatgtcttagaaagttgtataaagatagctattttgatcttagtaaaattttcccacttttcttctatgtataaccaaaatatttttcttttatctcacacagtttattttctgttttttgttttttgttttttttgtaagtggctgtcaaccgctttttctttccattgccagaatatcctgtctacctcattttctgtattttccattttaaaccaaccttctagcttattttctggctactatactgtcctctaaaacataaacataaatgtgcacatgtcctgttcactagtccctgaattctactctagagtttatctaaacaaatagcaataatagcctattttcatgtctttgtaaaatctcactttatgagatatgtcgtcaaataattgtgtccagtcctacttgctgtgtttctcttccatgaagagtgcatatatagagatctctacagagcacaactccatcacgtatttctagtactgagggttgttttctctttttaaataaataaaaatatgtgaactggtccatggggcattatttttcaaatgttctcctttctaacttgaaacaaataatagataacattttataaagaacatgatgagacatggtctatgtaaaattttattacttatctttattaaatagatctaactttctataagtgcttatatattacagtaaacaaaattgaaagtctgctaggctttttttctgggctagtactatttttgtgataataatttaaaagttatcaaaaatgcttctagctacaaaattgcaactattgtgtgtaatggtagaataaaaatttattctgagatactgaaaggagaatctcataaaatagaactcaacttttaaaattccattctcacaaattttttaagtattcttttttaaaagattggctacttaaaaatgtttggctttcttaagtgaatgtaaaaacacattattaatgattactaaagagtaggtatcagtatgatacatataatttattatgtcttatagaagggattttgagtgggagtaaagaaatatttgtgaaatagaaaagaacatgagaattcataaaaggtattctaaaaattcttaagctgaaaagttaaagtctgtaacagactaaacacattccaaatgcctctagatattacatatggatgctatctctcagcatgtggatacttgatacatttaataggaaagatttgtgttgtgctttcagtgcaaaactataaaaatatgttacaaaggtaagggtaataattttcagtgactaagcaaagcttgaatctctgtttataaaagtctttaaaagcagtattttaaagctagaatgcaaatgctttgggtttagtcttccacaaatgcctaaaaatgcactataaattctgttagtatataaaacgtattgcttttttgtctcttgaaagccatacaactttctctgtcaaccaagcattttatattcagaccttataatgcatatctatatataacagtccatatacatatgagtgttcatatcctcaaatatatagaatcatttaatactatattatcactctaagatttgttttgtttttagcttttattccaagcctctgacataagctgcttgactgaacaagttttatatatatcagcaatatctgggcaaaactcacttgaaatttattaccagatttgaaatttcatcatattccacaaatgctgaaaactgatgtgctcctttttgcatttcttaatgataataggcttgcaaagaaaacacattaaaaatcaacctaatccactgatgagaatatatttaatgtatttattttagattgctgataatttagagaatacttcgtgcagagtgaattcatcatgcattttgcttaatgctgttctcaactttccagcaagaagtcaaaatttcaccattttcaatttggagcagaaagcatttgtagcagctgtagctcttaatttgacatctagtttcaggtcattttcatgtaaatagggaacaatggagaccggcttacaatttccataacgtggatgtttccttcaactttattattttcttatgacaattatattttctctgtgggattaacggagccagtaattgttcacagttattatttataatctttatgaaaacttggtagttctactctttagtactcaaaagctcccagtgccttctatatttcagtcatacacacaatccattaatgtttctagctgatcctttccttaatcaggggtaggttaggcaggtcaggctttctatttctttctataatacattttcttcaggctttgcaacctctttttctacctttacaaaagtataggaggtgaaaatttggaattgttctgttgaatagaactgatgccctattgaaaagcaagtttgagttttgatttatattgctttgaacatgcccatatgtattaccaactgtggcttcacagccattataacacgtaattctgtgctttttctaataaatattttatttcatttttcctctgttccagagaagaagcctactttatgctgaagcatcgatgtgctttcttctgtgttttttatgatctgtacagcaattttcaagtgtgttttaatggggaaaattttaatttttgtgtacctcttttaaaatatgttgatttatgcagattaagttaagtaggaagttatttttgtaggtagtcatttccatttgttcctcttctaggagtaaaagtaagaaatcagatagacttttaaacattttgttttctggatcatctgaacataccaataaattatgtactcttttgactttgaagttgtattagttgatataatcctgagcaggggtgtgtgtgtgtgtgtgtgtgtgtgtgtgtattttagatgtgctccctctgttttttagcagacactcatttgtgctcttgtttttttctgccccagtgatatgacaagaacagtggagatttctggggaaggaggcccattgggaatacatgtagtgcccttcttttcatctctgagtggaaggtaagatgtttttctcattccagaagctcatgctaatgaaaaccctgatttgagctccttttcccaaatatttttcacaaggagattaaatgtgaattctattattcaaatggatacctcaagacatacttctgttggccacttaagtgttggaaacaaaataaaataattgactttaggatgtaatggggaaagaaatcaatcactgtttctccatttacaattaattatgaaatactttcttaaagtatccttatcagtgacacatagtaaacagaatccttggcaaagatgttaacatattgttagacaaatgttgcaactgaattttttaatattccagaatatacttcaacaagtgagtataataattccaaattgatatatcctgttattcttcaagtatgtagcatttagaataataaatattctaacattttaagtagctatatctgatgctgtgtatgtatgatggctttataaaagcaatgtgtcatcatgctgtattttcctaaaatataatttagtcaattaaaaataatttaccacatccttttggaatttttaatacattatgttgctaaatccacactggtaaaaatggcattgtagatcgtatcaacacttcttgaaatttacatctatctaactggatttaaaacttgttctcttgatggaaattaaagtgtgtgccacagagttcatattacccctgttaaaacaattgtactgaacttgttttagatattatgtcactttgtaataagacgaccacatttagcactagattgatattgacaagggttgtcagaaacttaaaagaaaatcagtttttcactaacatgacatgattttagttaacttactgaatttattttcttaaacacatcattgaaaaggggggattccttagtttagtttaggatatcaaagacgagacaagtcaattgattttcccaaggtcatacaaaatccagctctcctaacttctcacttcattgttctttcaagaactaaaattttctcaaaggttatatagtattaatttagtggttctgaatatttattcaattcagtctgccctatagcgaaaagaacagatttagtcatggtattttggttggcatcatattcagcaggtagccatctgctacctgtaattgcgaagtcatcaccttttttttttttttgcaaataacatctgatgccaagctctcactggaatgaatgttccccaaaagaaatgaaccaaaaagctagcaactcttattgtctcatttcctgtgtgtgttaataagtgtgtttataaatgttatgggttatggcataggacaaactgaggttgtttttgatagatagggtgaatatttactcagttgtcatgagaaattctaatgacttttggcagaagtatactgacagaattttgtgaactaccagagctattaaatgaccaggctctttagtttaatgaaggtgggatagagcacaagatcttcccaatttccaaaaatgagaaaatatacagtgtgacagtcactagacttcattttcagtagttcagaaaacaagctgatcctatagatcagaaatcacattctctcacttcaaacgagggaaatacactaagctttattgatttcctcccttccttttcctggttctgattcctagcacaagccttgtagaatagaaggaagagtattggacgtggtttcagaacaactggatttgaatcccagtgttcttttttataaccttgagcaagtcccctaaacttgccccttttgagtacctactttacatcaaggttatggggattaaataacattaaaaatgtgaaagttccttgtaaaacacctaatgtatgaacgtgtaaatcatcagtctgatgattattttggctaaaaccaaaaagcctgattcagaaatgtagttttattataagttcatggttaactgttcagtaacttggtgaaatagttctattatttattttttgctatccaccagtattataggaaggaaatttaattaaaaaacattaaaaatgctatggaagtggagacatgagccaataaaagttaaggagtaatgagtacaggctgaaacagcacgcttaactcaacccatgtgtctagatgcaactgtgtatagagcatgtcagacaagtgtctgacttcataatgccatatggtttcactgtgtgagcacaggggcttcgttaaggtcatagtggtatactttgctcttaatttccttccatttattggtttgtgccattattttaaattagaatttacatttaatttttttactaagattactgtaattggctttgcctccaatgtatttttttatttttttttcttttagaaaaatgttgccacacctgttgttgaataagaaacctaatctaagttagatcatcctaataagtaaattatagtggctgctctgctagataaagcctcaatgaattcattagataccatcgcagaggggtgctgaatgctgcttgtattgagggccattggctttcccagtaaaaacaaagcaaacataaaaaaaacaccaaagttcttgcaactaaaatgcaacttaattttattcagatttttaaaatcaatgtggtttttgtgaattaaaaacatgaaatctaattcgtttcagtacagatgcataatatgcctcagtttcatagggaagacagctaaacaggagagagaaggagaaggactggatgaaggctgataaagactgtgagaagagatgttcaaaccaaaattctaagctggtagagtcactgaggctgtgtgacattgggaaaagaacaggaagggggcaaggagaagatgttggtgcctaaatgataattagaagagcaagaagaattgttacccctctaattctgtgaggctgtggatttcagcatcctttatcactgttcattaatgcaaattaactggttagtctcggcctataactcctcgacagcattaatctttaaattctgcgagtcttggtcccaaatgagacagctaccacagcccaccagttcagggcaaagaggataatgaggtattgttttctgagccttcttgtattggtctggatgaaatcaaactggagggaatctatcccttccacggagcagagagggcagaagtggtttgttgccagggaccaaactaataaaatcagtcagttttacattttaccaaaattacctctgacacatgggttttacagttgggcttattctgtcaataaatttttcatggaaagttagattatttagatcagtgaggttcacatagcatactccagctgtaatatgccagctaaattgcaacccagtggcccgaaagaattaattcatctcccaaaatgtgaaattaaatcctagggagtaacattacatgactgatgatgtactgaattaaattaaaggaagacttgaatgcttgttaaaaaaatatcacttacataaacacgtttataaccacatgtgagcctcctaatgaatcaagttattgtgaatccaccctaacaaaaatccaaaatgtgaactcttaggatgctgtttaatttagggaaaaaacccataagttttatctattattttaatgtgtcaaatagtttcatttttaatactgtgtttcaagattaaagtaacacagaatatgactaatttgctaacctactggaactaggaaatgaaccacaagaccccactgcacacttgtgcctatgaccctgagccttccctgcagtagatggcatggctgtttgctgttctttctcctgcagcagcgtgctgtattcatttaacattttgaagtgagacccaaatatcactgccatgcctgttgaggtcttgagatgatgggagctcattaaggggacagaggttcaactccgtggccactccaaacaggaggactactttctctaatacttgcattgtagattccccttttctatggctgaccctgttatttacacataaaatgtactcatgttttatttaggtttgaaatttaatgtgaaggtattttgtaatagcacacatggattttatacaaaagagagtgacaaagtcgaaaagcaagagtattgataaagtgcagatcacagtttctccaaatgtagcagactcctcttgcaggacatatctatctttcttactctggacacagctaagccttgtcacatcacgaggagaagggaaatcccacaaataagaaataatgaaaatatgtataagttccatttcttacggtttttggtttagttttggtttatatatgtaacagaattgtgtatgtatgtgtgtacacacacacacacacacacatacacacacacatattttaattctagtggctatagttttctttcttctttccttctcttccaaccctcctgattctaagctacagccacaaaaatccagaggcctctttgtatcctctctaatttagcctcttcttggttgaaattttggacaactcttcccaaagcctgccttcatcatgtcgctgccctactcggaagcggggtctgctagatgcccccctccaggtccatcagattaagttcattggctgtttgttcaaagcctttgtgtgtggcactggtctcccatctagttagctctcaaatctttgaaggctctaggcttgttaatgtctttagtttttggacttcagctgtcccccaaatgtatagtgaaattacctggtcctggtcctatgactttgtctcatactcctccatcctgatcacacaggaaacacccaacacatacttgatttggtagcaccaacaaatgggatccagcttccttctaaactgagtaatatgatctgagcttaaatgtttctttacttcttaaaatgcaaatttttagaataggtagtaagactgcaaaaatgttactgtgaatatcctaatgctctcccactgctaaacatcacgttgccacgttggcactaactcagacttactatagtcaggtgtgatgcccttctccaaaccacaagtctttggtgtcaactccagtaaactagcctttcaataagtttactgcaagcatgagaaatgaagtcgcagattgatgttggtacttatgcatatttatctagaagggctttttctcttgtagtcagttttggctttttttggattagggattaaaataacaaacagttgcctgaatataaagtaaaatttcttttgtaaatagaaatcaatatgtatttctgaatagttgcaagtggagaaataattagcatttattattcagtaattatatttcaatctaaattttgcatttaggattctaggactcttcatccgaggcattgaagacaacagcaggtccaagcgggagggactatttcacgaaaatgaatgtattgtaaaaatcaacaatgtggatctcgtagacaaaacctttgctcagtaagcattttttcattgttttatttactttcttgatccctagcatggttataagcattactgaactcattatgatcaaaatagtaggtagaatttctagtcagttccctttgaacgatccaggatatccattttcgaatgcttctaatgttttagcctactcaaaggtggcccacacatgtctctggcaggtctgagaatgctaaactacagaatatcacaagccttcctgcctggctgtctttactggggcgtcgttgaacgggtttgtttttcttgggctatgggtcacttaaactggtatttaacggctcttttcacagactgttggttcagcttattaattaactttcttggtgtcagcagtcttccttaaactaaaaaatctgtgagagatgtctgaggactcaccgaatcatagaaacaaacagaaaaaataaaataccgtctcctggccaggcggagtggttcatgcctgtaatcccagcattttggggggccgaggagggcagatcatgaggtcaggagttcaagaccaactggccaatatggtgaaaccccatctctactaaaggtacgagaaaaattagccaggcgtggtggtacgcgcctgtaatcccagctacttgggaggctgaggcaggagaatcgcttgaacctgggggacagaggttgcggtgagccgagatcgcgcctttgcactccaccctgggtgacagggagaaactccgtcttcaaaataaataaataaataatactgtctccctcaagaaatcatctttctgcatgtgaaaatgttaagggaatagcttcctgtacccaggaattagagtgtatagtaatctgatgcatatttttttaatgtgtgttggcattgcagtgggattctggaccaaaggactaagtactaataatccttgggagtcatcaccaccctcttgtttctgaccaaaacagctcctaatacatcttctcgctgggcattagttgtcaatattgtatgcgtgtttgtggacaaagatgagtggttgtgggtcgaggaaaagtgggtactggctgctaagtatgaaaagaaatgaaaccttagaagaatctattgtgttaaaataatgaatgatagacaaaactatagttagtaataatttttaatatactactgtgctttttcacaaggacttgataattatgcaaagcaatcattattacttctgttttatagaggtggaaactgaggctcataaaaatttagtatagagttagtatggagtagaaactgattcctatgcaagcaaaaataacataggggaactgaccacaggagttaggtggagttaggcctatgtgaaatcttccttctcccctaacaatttgcagaattaagcacttcagaaaggggggtgcggggtagggtttaaggaatcagattgcagttgggattatgattagttattatgtgctgtggctgctaggaacagagacctgaaataagaatagctgaaacaagattaacattaatttttcctagcaacaagcaaacgtggaagagggcactccacagttagtgcggcagctgcacagccgccagtgggtcaggcagcttccgttttctgctttgccatctcgccatgtggctactatccttcagtggaaaaatgggcacaagatggctgctgagtttcctcagtcacttctgagtttcaagaaatagggaagagaaacaggagaacaataaaagtttttgtctctctactgaaccagccgcttctaaagagctttcctttaacgccttcatttatatcttctgggcaagaaagagtgggaaaggtagttgtttgacctgggcacagggcatctagaggcatgaggaagaagaaaatgttataagaagtttgaggaagaacacaaagtgttaggtcataaaagtgaaaaacacagttgctctgtgtgagagtaacaggaagggtgcatgttggattgaaattccactgagacattttggcacagccaaagcacctgccaaaatgtctccatgagcaaacatggatgtcaaacttgaacttgtgtaacacaacccatgttagagaagatctgtactttagaaggatgtcctaaaagaaacctaactaatgatctgatccaaaatatctattttgctttttatattcactttggtaatcacttctggttagattttcatctttagaaacatgtaaaagctgtgggtcattggataaattatttcatctctctgagcctcaacttccatgtccgtgaaatgaaagctatttatacttaccgaatgtgctttctaaattagagaaggatgcatgctaataatgcatgtataagctagtgcaggggcacctagtgcaaatagtaagtggtaactagtatgtagttggcaaagtcattctgataggaatattgatcgtgtctcctatgattagccactgtgctgctcttggttgccatcctcctggggtactttagaagatgctgcacctcaaagcagggtcatcatacatttatcaactttctttccagggctcaagatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggtaattattaaattatgcctaatagcattctattattgtaacatgtaaaattggttaagagaaatgcattaaggctaatttagttaattctcccttcatttaattgtatcaaagaatagatttaagtgtatacttaggtaacttaaatttcttgaaattgtacttttttattcttttcttcggagtgtatagattattttaaacaagaaaataataaagacatgttgggaagtggaaagaatcattgcaaacctgatatcaacagagcaatattgtattacaacttaataccaaataggcatgaaaattcagttgtccctgttctgagcacgattagtgattcttgaagcatcctttaggccatgtccaaaaagcatattgtttttctaagacagtcttctaacaacaaaaatttactcctcagaaagcaaatatgtaatgtttactaatttctctgattcaacgtcacaaacatttaaaacatacctaatttcaaaagcatgtataatattttctttcttcatctttttcaacttttctatccatttcaagcacagatcagtgagaagagatcatgtgtgtacatgcatatttatgcagtattctacacacatacataagcattcatgtgcttctgtgcttttgttcattttgtaacctctgctttatattaccttcccccattgcaaccttctgaaattctgtgtttttcaagacaactcaaaagaaaccaagatcttatagattcttgtctgaattaatagagaatttatggtcaaaaggtagttttagaaaaactattaaggtctttcaaaaacaaataatgtatcatcatttaggatatgaaaattattctggaaagattctctgatcaaaatttcattcacctataagaattctattctgggaataaaatacattgactagtaggtacaaaaatacttcagtgtgcttatcaatcaggttttttatttaaatgcctcagttgtattttttgtacaaatgatccagctgtgtgtaagacacagatttgggtgttttgaatatagaaaaatgaatcagacacagaatcaccttaaaaatttattacaaagccttgaatgcaaaaatgaaagatacgacatcacatctgtactttggcaagattaatctgacagcaaaaagatacactgaagacaaggccaaacaacaaaggataagtaaagggtgcactgcatctgtctaaaggtggaaacataataggcatgcattaataaatgactggttgtaggaaggaaaaaagagaagaattacagtgattcctgaggtttttcagccagagcaagttgcataatggagatgtcattgctagaaattagaattttaagtagatgaggatatttgaaaaggtcaggatctggactggagagggaggtacatagtgaagtttgaaatgtgcatgatgacatctaggaagctgatatcaaaaagagacattggagccatagagatttaggtctctttcattggaagatatacttggatccaggagctggccaaggcagggagtctaggggacaaactggtctaagacagatccttgaggaacatctgtggctacatgggaggacaatgagtaagatttagagagagtgatggatgtgatgtgatcaaagataggaaaataatcagaaaataaagacatgaaaaccaaagagagtcaatttcaaaaaaaaaaaaaaaaataagtggtgggaatcatcaaagctagaccaacagagatggtcgcgggtaggtcactggtgatggaagcttgaagaagcagtaagatggaagtaaggatccttcagggtagagaaatctgagcatacctttagactgagtgaaaaatacatgagaagggagaaattggagatgcaggagaacaggacaggaacaacaagatgcttgctgaccagacaatgggatgcagcagtacaaggaattgagacacaagtagagggctcagccataggttgtccagctcatgtaagaggctgacagaacttaagtcaaatggccttttgcttctcaggaagtatgaagtcaggttatggtttattgagaagtcaatctcctgggcatctggataacatgtgcatttcttctagaacctgaataagccaaagtgttacacatctggattgggccctaaattcactttgatactgtcatggcctgtcaggaactataatctgcatttgaaacacaaataactgaagcatatttaaaatgtcccagaatgtaaatattttactgattctatattagtctaaattaggtagatcttactgtaagactgaatataatattactcatgcttaagatgactatacattttcctgttcttatacactaggccctgaaggacttggtttcactgtggttaccagagactcttccatacatggtcccggtcccatttttgtaaaaaacattttaccaaagggagcagcaataaaagatggccgcctacaatcaggggacagaattttggaggtaagaattggaattaatagttgtatgaaaatatttcttggcatttaaataatgccatttaattgcattgaaatatatgtaaatatattaatatttttattttgaacctaatatatattaaaaattattacttatagacaagataagaactttaactatagaactggttaatgaggagtctaactttgtaaatccccaataaggtcagtgatatggggccaaatgatagtgaaaaccatttctgatcttccctctcttatttctacctcttagagtccctgtgaaatttggattgaatctaagaattcaacatatattcagttagggctaaaaagttaaaaagtctttgtaatagtcttttcaaacttggccaggacaagccagagtatctcaggtcattctatgctttgtccatatccctatcatctgtgctaggatagcaatgaaaacagctggaagggattttgcagagagatatatttgggataccaaaagcaagagggtggctgtttgttttcatttatttttgtctgaggacattatcgtcttgataattatatattgtccatttacctttgaagcaaacatcttcattaaaagcaacactttagcttttcatgttgttctagatcatgaaagaagatgcaccaaatgactactgtagctccaaattagaatttcccttaatctatgataatctggtgactataattttctaaatatgtttaaaacctgcaggattctattgctaggttcgtatttgcagagaaatttgccttgtgatcatggttcactctgcttgttgaattaggcagaaaatggcgctaagtaagcctttgcaatctgctttctaccttaagcggaatcattttctggtatctgtcagtccagtttcccccacataagaatgtgatgtcttaggaaaaactgctgatattaattaccgactctgagttcatccagcatcatgatgatgcattatgggaaatattgttgggttttgcccatgtatttagttatcatcttttcagagcttcctcaagtatgggagcccatttgcttcttgttttcaaaaactatctagtgtagaaggagataacaagtattgtgattgtggctgttcatatgcttttattcattaggtaaatgggagagatgtcaccggacgaacccaggaagagcttgtggccatgctcaggagcaccaagcagggggagacagcatcgctggtcattgcccgccaagaaggacattttctgccccgagagttggtaatgttcagatctcagtctcactgaatttttaatgccgagcttaatacactcaatgaactcattatagctgagaaacgagttctaaatcacaggcttcattcataaccaaaattgaatcacactcagggtattttaccccatttggggtatcgcatttttaaaacattgatacagccagtgggtatatgtaaacagtgattccggggcacagattcaaacacctttagcaataagcaactattcaacagtatgcaactaattcaataaaatatatattgaatatgtgctacgtgcgaagccctaggcaaaacacagtcagcaaaataatttgtggacctactttaatgaagtttacagtctaacaggaaataaaaagatagccaagtattcaaaatggcgatgaagattatgaagggaaaatgcagagtgccatgataacatagaacaagggtatttaacctattcttgagggctgggatagacatcttgagaaagatgagttcaaaagccttattaaaaatgtatacccttagacctagtaactagacttcaagtaatctgtcctaaactgatgatcaaagatgtggaaaaaattcatgtacattgattttttcccctcaagttctatctattgcagtgatatattgggtcctgtataactgtaaggcattggttagataaataactagatagcttgccagtgaaatatagaagtacttaaaatggtttctgtaaaaaattgataatacccagcactttgggaggccgaggcgggtggatcatgaggtcaggagatcgagaccatcctggctaacaaggtgaaaccccgtctctactaaaaatacaaaaaaaaaaattagccgggcgcggtggcgggcacctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaaaaaaaaaaaaattgataatagcatgagaaaatgttcataatctaatactatatttaaaagtaggatgtaaaattatttgtgcagtatcattaaattacattttaaaacgttaacaactagaagcagatacatctgggatattggttatgagaggttttcattttcttttcttaccataaataaatattatttattttattgaaattgtgcttttaagaatgctatagaaaattcaaaaggaggacaggtgcagtggctcatgcctgtaatcccagcactttgggaggccgaggcaggtggatcacctgaggtcaggagttcgaaacctgaccagtatggtgaaaccccgtctctactaaaaaatacaaaaagtagccaggcatggtggcatgtgcctgtagtcccagctgctcaggaggctgagacaggagaattgcttgaacctgggaagcagaggttgcagtgagccaagattgcacgagtgcgctccagcctgggcaacagaacgagactctgtctcaaaaaaaaaaaaaaaaaaggaaaaagaaaagaaaattcagaagggattttgtagctaataacaaatagaaacaaatgtgataaaaggacttgtatttactccttgttatttcctttgaatctgtataagaattgacaaaggcacatgtaggttcccagagttaggttattggaacagtaaggattagttgacagaactgatgatgtttcacttgaagaagagaaattttaggagacatgacagttattatcaaatatgtaaagagttattgtatggattggaaagtagacctgatctgtttcttcagacagtttccaagtttccttggcatggaattttctttctccctttccttctctttcccatcatcttacccatttttccctttccttattgtgtactctggggagatctgtaacaaaatagggaaaataagaaaaaaagagtgatctgagtcatgcagatatagtccccatttccattcctctacttgactcctccatacccaaccatttgaaaggtagaatcctgaatgtctgtctcatctcctcacactttctagagaaatgatgcagaaacttggagtctggattttttttctaaaatacagatggattcttctttcaatcttttatttatccaaagaccttggtctttctctacaagggtcaaagtgaaaagaaacaataaaaaggggggcagttatgtgtatgcaccacaagaggccctttcatttcttgtctgatatttaggttgttagaaataaaaactctccaaaatcctcagtggaactatgtgcttatttctgagataggagagcaaagaaataagttttgactgtgtattccattgaactgtggtcctggaagaaataaaaccctgcataaaaacagaaatatttcaggcagcccctgagcatgcaaaagaatgcaaccacagaactccaactaggaacttaaaccctcgagcctgcagtttctgtctagtagttccttatacctttctcccatatgtcctctggaatttttaaccccacagttaataccttcttcctagaagctatgcccctccaccaggtaagggatgctgatttatcccagtttgaagctctgaattcattcctcatcaaaggcaattatatctggaagttagcaactggaataacatttaacattgtctctggagttcacatcccagaattcaacttctgtatccaccacttactagctgtgtgatgtagagccattcggaacatcactcagaggctgtttcctcatctgtattgtaagaattgttgtgaagattaaatgagataatacaggcaaagcttgtagcatagtttctggctaattgtaagttctcaaaatacgttagctataatttttttttctaatacatgaccatttctgtagtagtgtaaacacaattctatactctagatatattatggggtagatagatttatgcagccttgcctgggactaaccactatttttgaacaatgattgttttatttttttattattttataatgtattctgggatccaaaatactgagttaaaaacaacatttttataaccagtcaaattgataagggaggcagctgtatgtgttatttcactctcatttaatggaatttagtgaaatttgatttctatcccagaatgacataggccaagtccaccagggagcatattaagttaactgtgcaactgtgagattatgagtgcaaacaaattatttgttctcattgtttctagttctatactaaatttggagggtatatgcttagtattcattcctttagaagtttctagcaaatatctagactctcaaaaatagttgacagtcaaccatccaaatatgtggaattttctttgtcaccatagcaaagcaagggcatttgaggtttataagcacctaagtcacgtggacccatagccttcctattggagaaataaggaaaagcactctttttccagcccaaatgcctgcctcgaatgccaagaggcaagaaccttgcaggaagtttaaaaagaggtgatgtttggcacgtgctgggctatttcagtgggaattacttcatagtgtggcatacaccggcctgtttgaaagggcaaaataaagaagtgtgttatgtgatacatctttgtgttttcctttcaaaaacttgaaggtgatatcactttggtctcttcttccttatcatgattgatgtacacacttgactttccattgaaaatctggcaggatgaaggaaggacagcacttcctacttttgtcgtgttctatctcctttgaggaaaacaaactgtgtttattggtttcctcttctaagaaactgtcctcttttgttaagccttgctgttctgcgagctctgtaccttcttaacagcactgcactgcctagtttccgacgcttaaatcttccttacttccttgttatcgttagcttcttgtaaagtcttaacacttaagctaagggagcatgtggtcagcagttatacaggaagtcccaatatagaattgtctcttggatgtgactctgtcattctgaaggccatggtatccatttcctggtcatttctcctgacctgccacctaaaagaactgtgctgaactcctatattctagttcgtgtccttcctgagcaattgattaacgtcccaagtttagcagcatatttagccaaccttctttccatctggggcagaccgggttgaaaatcaagtgagaggaatttatataataacattacaactatttagctgtttctagtatctttaccaaaagaagggtatttcaaagataatctttccagaatcccattctgaaagatcctttggtgtcctcaccccctgactgggtgagagtttactgaagaggtgttcacataaggaacagttttgcagaaggtactttgagattagttttggtaatagatttagaatctgaaggctaaactgctgtgtctgtgtctatacttgaaatgaaaactatgctagttaatcaactggtggtttgcgtggtcagttctgtaagagatgtggcctacaaattcttttctgtctctgatacctgaaattctttcttatgctaaatgtcagataaagccgtatttccacttaagaaagctcctgaaaaactgaagtttttctgttaatttcatggcttcatttctttaagagctagagagagaaggagaaagttatttgctatgtatgtgtgtgtacatgtgcatgtatgtgcatgtcttctttttttattgggtagaaaggaagattctgccctttctttgttaacctctttaacgtttcattttctgacctgctgccttatttctaaatcatcctgaaaatcacagcaacccctggtgggtaaaatgagcttaaaaaatttcaaatgtatttataatttctacctgccacgtttgcctgctatttgatgctggcctctgcaagtgagattaactgtatttcaagcaagcaagtttctcctgcctggcatgattgaaaaccaaaagttagccatgtttgtcatgctgctttgaccttcacttaggaatattgcttttgctgagaaaaaatgatgcacatgcatgtggaaccctacttaacagttgctgagcttagtgtagtccaacactgtcatggttacctgtccctgtgactaccttagcatgcgagatgtggttccaactctttcttatttttaagtaaaaagttcacatcttgaaatgtcaaattatttagcatcataaattatagaattttggtttgaaatcttagatgaacctcatttaaatgatatattatttcattccctttggctatttgattcaaatgattccatgcttaattaactgagatacttaaggaaaaatgaatattatagcagttatttgtggataagtagcagaaattgaaagataatttcaaaatgatttttctacctaaactaatgtgcatgagatatgttctggaatttaaataattatgcaaaatccaaagtaccttgctatattttatgtattctccaagtaacacagttcatgtcttatgatgaagtccttgctaagacagagtttctttttcagcttttccctacaataatttccattttcttcttactgcattttcattcaaccagtatgtactgaatcttagtcaaggctctgcaacatgaacttccagagatgaagctagaagcttcatctgaagatgtgtcctgtcttcaaggagcttctagcccataaagaaaagaagagtgataagtggatcaaatgagcaaataaattgttacagggattcaaagtatgtcaggaaccaagaaaaccttcaagaacatgacagcatttgaaaaagagacttgagaattgaataaatttcaagatgcagagccacatgggcaaaagaaatactctcttcagttactcagagattagaaagtactaaagtacaataagaccgtaagcagcccagtttgacagattaccgaacaggagactaagatgagaagtagtgctattttgaataagtttggaggggaaaaaagatgttgggatatctattaagagcttattgtaattcactagagggtaccagtaaggagcttgggacctggaatccgtcacacctgggttgagccttgactctatcacttattgattaaatggccttgatgaagttatctccctgagcctccattcctcttctgtaacacagggactagactagtgtctacccaagagactagttgttaggattaaatgagatgcatgtaaaatgcttacattgggccacagagaatgggatttaacaaatattccttgttattataaccattgctcatttgaatgagagatattaagtgcacagattagattttcccacctgttaagaatggagagaagaaaatattgtggtagaaaactttggttttggcaactggtagatgtgggagtgaaggagtgagaaatatcaataattccaaagtttttaatttggctgtgttgtgatattattacttgttgcaggagaaaacaatttttattatcctagagttttatgactttcatgaatcccaagctgttttatgggccagtgagcctcggcatttttcttcccctactctctactctcattccaaactcttcatctttgaaagggaggacactcctctcctcccttttatctcaaaactccttaagatatctacttataggtcatttgcttgggcaaagcttccttgaacccccaagtctagtttatggaaccttacgcagctttccatccatattaagggttcacctcagcatgcgcccgaatcacacaatattataatttctccaatagaccttaagaactataaagaaatagtccttaagatgccacatttgggaatctcatggcctggatgtgaatccctgctttgcaatttcatttagcctttcagtgtctcaatttcctcatttgttaaaaatgaggataaaagcaacacctaccttgtagggttgtgtgagaattaactgtgtgcagctgttgacgcacagtgagtgccaaatcatattaatccttgttatttcctgtgcctagagcatagtgtatgctcagtggatatttgttgactgaatgaatgaaagctacgcattactaaagttggtgatatagaaggctgggaaacgtattactaaatgagccattactgctagtctgtatctagtctgcattcagtatattattatcctgtacaattcttttaaaccaaattaaaaaaatatatgcagggattttctctgagcaatagcgatttctgatttacagctgcgtgccacaatgagggttaggatagttttccatgtaaatgacagcttcagtggtttaagttaccatgatgacatttgcacaatctagttgtacagtttacttgtaaagacatatgagagccataagtatcatgttataatttgaaatgttagcggtatttttacagtatcgtgttaaagtattttaaatgcttcaatttgggctgcaataatttgttagaacaatggttctcagagtgtggtctcaggctagtagtcttggcatcacttggggatttggtaagcatgcagattgccaggctccctccacacctactgaaccagaaattctggaggtgggcttagaaatctgtattgtaacaagccttccagataattctggtgctcactcaagtttgagaaccattggaatagtggtttcattataaagaacatgaagcctgtaggataacttagtggctattgctgactagcttcagtgatcaaattttcaactttatgtctcctgtgaaaaatgtcttgttctgggaaaaatattctgtgaaattttttaagcccagttgagttgtgcctttttggctatgtgcccctcattttggcaaagggccagtgctgagtgcaatgcagttacccaactcaattacccctgattcatttaggcaaactcaattgtacttgactttctcaggtccaactcgattgtgctttaaaatttccacactcaatttgattgtgctcaaaattttttatgtgccaccttgtaacttgtagattcagacacatatcacaggaggtacttttgagagacttggaatattgggttgttggtatttgtttgcagttatacccatttcccttcttcctttcctcttatcacctctattggaggctttagggtaagatatgttccattgaccccattacatggacaatattccagcatccacccttttactatggttggactcaagttagagatatcacagattctaggaaagtgatccttaaactgtcacaaagcaactgtgcttagtttccatttatctcattttaaagatgaaagtgaggtacagaaacactgccccttaccagcatttacatcgtcaaaatcagaaatacgactgggtgtggtggctcatgcctgtaatcccatcacttcaggaggctgaggttggtggattgcttgaacccaggagtttgagaccaggctggacaacatggtgaaaccccatctctacaaaaaaaaaaaaaaattagccaggcatggtggcacacacctgtagtcccagccacttggtaggctgaggcaggaggatcatctgagcctagagaagtagaggctgtagtgaaccaagatcatgccactgcatctagcctgggcaacagagtgagaccctgtctcaaaaaacaaagtcagaaatagcttttaagtaagacttccacctcactgaggtaaatgctgtaccttctctcacttgtgcaatgtgctcagagactgggtccttaatcatggccagctttttgaatgtgctcaatagcccacaaggccaagggattaatagtcatttgctgctccctaagaagtacttatatctggaagaattctactgaactattgtcagcaaaatctagtcttgataaaataggtgatgataaatgctgtggttcagcattattaaaacagatggaggaagtgcggggctattttgctgggttgtatggcttccaggtgtcagaatgtaaatacttaatggcttttatcacaagatgggttttgttggagattggaaggtagtggaaggaggagtgttctatgttgtaaagatctcatgacatttcagaaaactggggcctaaatacgttgtcttgcaaagttaacagtgaagagctatgagatttggcctcattttcatggtgcatgacatatgtcttattagtggcgactgtggctatgattatgcttctggagactggagaaaaagaattttctgaatttatatatttgaacagctcggaaaaagtcatattgtgaccaaccacctactatatcttatcatccagttagccaaatgttaccagtaatttaggccagctgttgatttggagcaagctggataagaagttggttacaaaacttaggggacaaccttgatttgcttaattgcctccatgcctgtgatcagtacatttgttaaggtacatttggtgtaaggtaaggaaatgtgttcattttgtaaaggatctttaaagattagggaaaaaaatactaccttaattgatggtggttgacttttccagctgttatcaaagtaaataccacacatgtgaaattgccactacagtccatctcattttgagagtatagttagaagtctgaacatgtttcatctgcctggttttccaggaaaatgtgtgatctttatcattaaagaatatcagcttaagatcacctttttttttttttttccctaagggctggtaaaacagagatagacacttaaataacaatctgttgctacttacttcttctcctgccctgtccccaaagattctctgggcaatgacttttaaatatgttctcattatttttaatgagtgtgcagaacatatgacacataacgcaacagtagataggtgcccttttactgaacctgtcggatacaatcaaacatcgcaggggttaagatgcatttttctttaagatactataattatttaaattaagatgttcaagtacacatcacatactattcaattcttgctgctgcctaaatgatgccccaccacagtcccagctctctctttaaaaagaatgttttatcccaaatgttaaaaagaccaaagaacatttaatattgttatgtctctttaagtttacacttcttaaaatctgtcccggatggcaggatattcaattataaacgagttcaatgatgtttccttgccactgattgagttatatgaaggacttctatcacctagtctttccgtaattaatcctttgcatttcttagaggtttagcactgccccccacacaccaaaaaaaggattgtttaacggcttgaaatgttgtttcaattttcttatatttcttctttctcccctttaccttcctccttttctttccattcttgcttctgacctcccatcgtacctttctggaactaagtaacactctatgtgtttctcaattatatagaacttatttacttctacttcacatgaaaatgccaggtggtggtggacataatagtacattacattaaattacattaaatgccattgaagatggcagtgatggcagtagaatagagaaagatatcagctctgagaacagcaaagctgcctatgctatgcattcgtcccataaatattggagcctatggttcccggcttatggaaatgcctgccttagcactctgcaggtaagttacagactttccacatgacttgaaagagctggctttcacccttctctccttcccagcagctatatatttcatctttagacccttgacttcccactggaggagaaaaacaaacagaaacaaatcaacagaaaagcaaacaaacaaaaaacagcacaacagaaaaacggccacccaaaacatcttagccatgatttactttcactccatctctctgaaatgaaatgttctcttctatgataatcaaagaaaggttgatgttcagaagaattgccatcttccacctctctttcccttttttctgggtccacattggagatgacaggaatcaattgttcagcaagtatttactgaacacctactattcccagtttagctgatcaaatatttattgaatgtttatttttgctagatgctgttccatgcagtgggtattctaaaatgtactaaaacatgattctttaactccaggagttcatagataatgctaagtggtattagagaaacaatataagaatatagcatggtacctgtcagtagggaaagctaatgaaagaaaaatagttgcacaagtttcaggaagaggttaaggggctaataaggacataaaagttataaaaaggaagaaattaaagttctttaaagtcaaaagactttaaaagtcaaaggactttaaaatcatgaaagatttcgtttatgaggtgggactctggtcaggccctagatagattcgaagaagcaagaagagaaaaaagttccagaaatatggacaaataatgaataacgaacatctttccgaaggcaggaaagaaaactgcagaaaaggaaggaaaggaacagaaaggaacatttttgttagagtgacatgttgttggctacttatgctatcatttaaagtcggtaacaagaccacatttttttaaaaacccatcagatgtgaatttaaaatcgaactaatgccctcctttataagttctatgttttagttatctcttgctatttaacttaactacccaccactttaagagttaaaattatgttttattatttctcgcagttctgtgggttgtgtgacttcttcccctgccagtttcgtttagacttatgcatggagctgcattgaaccagagagtctactgggcgggaaggcccagaatggccttccttacacgtgtctgtcagttggtactctaatagctgttgggtgggacaccatggtcctccttcatgtgccctcccaccctccaaaaggctagttcagtgtccttacatggcattctccaagacaacaaaagcagaagatgtagggctcataagtcttaactttggaagttgcactgtgacttctgcttcatccttttggtcaaaacaaggtcaagtcacaaggccagacaagatcccagggatggaggaatagattcctttcaggatggaaagagcaccaaatcacatttcaaggagatataattcatggagtccgatagggaagtgggagtgtgcactgttctatagccgaataagtattggtcagggatggaagattcaagttatcagcccaggactgtcagtagatggttgagttttgaatggtcgtttaatttcttgagtcttaattccgttcatgaatttcttattgggaaatcttttcccaataattcttattcttattttcccataaattcttgtttttatgcaaatacagtgttgaagatacagagtaggccaggcatgctcctttcccctacattgctgtttagcagcgtttttacctaaaacattgtggctcttgacatatacgtgcatttctctcttatgctggacaccagtctccctagatgaagaatgtgctttcccctcccgttcttctcccacctcacatagagaattactcttttagacatctacaatctgaattggcattgaagaatagaagtttagttgtatagatgttgataaactaaattttagtatttaaatgctgaaattatcaaaaaagtaatttgacaataaagagggagaagaattttttttatctgtaaaaggaggaaattgaactgaattgtcttttaagattctttcctattccaaaataacctctaagtttctgtgcatcaaatcttggcatgacactcaatacagacagtgcccaaattatgaaagatctgtatatatgaatgggaatgggctgcatgaattctcttcttagtgtttgtttgttccatacttcagaatgtctggggaacatttgacctagagattaccttaagtaaatgtagagctaacagattgccaacagatatctttctcatggctacctcttcgacccctgccatggcaacgcttgttgccatagtagtaggcacagatggagcccttcctccaatcctctactgatgccaccactgctgtgggtagcataagggacttcactcccatagccagctcagagggaagtgtgatccttcattcctgaattggaggtttcagtgtattctcccatagaacatggttaactataacccatccaatagaatgcaaattattacttactagtatgttttggagataccatggagtaaacaagcactcttggctaagagagaaatgtagccaaaatttatcagtattttttttttttaagaaaaacaaaggctcaacgtgcaggcaccaagtttacagacaaacttatggcatcagcctgttttctaactagaaattgccttgcctgtacccacacccacagtcattgtctacttaaagcttgtttccattacacattaaaatgaatgaattacaaacattattcattaaggttttggccacctttaataaaaaaaacctctgggttctggattcttctattagaaaaatatgactatgtcaacactagcaacttgttggaaactgggcgtatattttcagtgtaattattaatgcaatcacctcaattcctctttggtattaggttgcaaataaattatataaataagtattaatgcaattattaacttgataattttatgtactatgtaggcatgcaaggaaattaaacaaagatgaaggctgctacatttgttcatgtttgggatatacataacagtgacttattctctatatcataaagagatagaagtgtactagatagaactttgtcttcagctgtataactgagtatgattgtaaaaaaaaaaactgagtatgattttcatggtggttaagttaataacatgtcactattatttgtgcccttctaaaacagaaaccaaataaatcatgtgtgtcctaactggaaagaaagtaaaggcaaaaagctgcaaacaagctagtggcttacttattaagaagccaagcttttgctgtcagatagcagttcagaggttcctctttaacctgtagggtttcttgcagaaaagaatactgatcgcatgtgaatgtcttacttccttcacaaacctttgaaaatatttcccaaagattgcgttgcctctgctcttagctcaatagctctcaagggagttggcatctcttatcagaagcacacagccaggccaggggcagccggcacattgagaggccagggcggagtaatggccaaggccaccgggcaggtagtgaaaggcccctcgctgtgttaaacaaatgcagtttccttcctggcttccgctggagctaattttgtttttcacttctcttctggtatatgaacaataaggatgtataaggccattctgcctgtgaggagatgtgcattagattatcataaatccacagataaaaagcacagtggtcaatgagaacaggcattcttggatgaaataaaaggtttaattgaaagtgtggtcccaggggagacagatgattgagcgtggtattgagtagacattaattaccatagtccagagagtgaaaaaaaaaaaaaaaaaggaagaccgttcctttttttttttttttttttaaagtttccaaatctgtttctctttgagagaatatgggagatcatcctaataggatgttaggaaaacaaaatgagtcttgcttatacacagtattcttagaatactattaatgtttcttaagaagtagcagttgatttttctaatagatatttttgttcgaagttagagatctagacaaagtacaatgtgtactgttatgctgaataatggttttaaaagatatatgcatattgaattataacacattagtaaatgatttgtacttattcataaatctagaatttttcattctttggttatatctctcagcatttttttggtaggctgagattttcttctacaatttagcagaaaaaaatgaagtcgaaaaggcatctgaacatacagtcttcattaaatattaggccactagttttgcattgctgaaatatggctgcctttataaatcatacatgtttgtttagctagtgccctacttttgatgtggctaaaattatgggaagaactctacatccaccgggataacggatggtgtcaagaactgccttaacaagaaaataattggtcaggtgtctcttttaacagtcattagcatatttgaattatgagtttggttcttctttcgggtcaaatagagtataaaagtattctgaattatctgtacctaatgtgcaacggttttgaaaggacaaaaactgggagactgaatatattaagagtatgttactttgtgcttgcttacaaactgcttcccaattccgttatttaagaagaaaaaataaaaaaataaaagcaccaccaactgtcagagcaacttttagttggcttttcagttttatttagaacaaatgaatttgctccctgagtgaatttaaacttttcaatcaattgtttagatgttgatgtagacatagtcttagttttaaatgtgaaaaattgctttttttggtttaatttgaacagggtagttgccaaatagcaccagctgtcataataaagtagaagtgaatgacagatttactccaccccatatcaaaactcagaagtggatatggtgatcaaatgagccaaagtaaatgtaagatcttagaaacatttgcaagctattttcttgcatagctcagcccttcatgtgtatcaaagtgcaaacaggttacggttatgcttagcactattatggcaatggaaaaaggggaatcactttgttactgtagatatgccaaatatattatctaatgttccaaaataccatttgatgatggtgatggtggttatagtgaatcttgtttttaccaaatacactaccagtctataagatggtattataaagtattgaaactagaagcttaattagcagtttatgaactgttttttaattttaatgagaacgtggcacatactgagctacaacggaagaaataactgcaggagcacttgttgacaatgttctttaaaaaatatgtaccatacacttgttcttaggcatggcgttgggataagggacagtggcataaacataaaaatggagtggtctctgttgcccttaaagtccttaaagatgtacataataataaataaccatgatataacgtgattagtgctatgcttttattatgtatagagtgttttgaagacctagatgagagccacaaacagcaggtgacaattaagatgggatttgataggtaagagtttgctagtgggtggcaaagcagggtaaagagagagcataagttttaggtggagagaatcccatttaaatagttaaagaaggtatatgtaacatttgattaattccagtttcctttactaaacatgataaaaagtttaggtgagaggtgttgaaaactatgattttggtagataagatgaaagacatagtagtcgcttttgggagggaacttaaatacaatttcaaagaggtattgtggcagagaagtgtcaacaaaacatgtatgaagtcatcgcataacgaatacttactagatgcatacattctgctggatgctaaacaggaatcaaagttgaattaaacataatttctgcccttgatgagatcacagtggtatagcagagttaagatagacaggcaaccaggcacagtggctcacgcctgtaatcccaacactttgggaggccgaggtgggcggatcaagaggtcaggagtttgagaccaacctggtcaacatggtgaaaccccgtctctactaaaaatacaaaaattagccaggcgtggtggtgcgtgcctgtaatcccagctactcaggaagctgacgcaggagaatcgtttgaacccgggaggcagaggttgcagtgagccgagatcacgccattgcactccagcctgggtgacaggatgagacttcggtctcaaaaaataaataaataaataaataaataaataagataggcaagctggcaaataattgtaagaaagtgatgcgaatcatcagaatgggaaaacataagtgaaatgggagctgcgagaagggcatattgttcctgtgctgataaggtcagggaatagttaaaagaagaggtagcttatgtgctgagacataaagcatattttgaaatattgtgcaaagaattcttaattccattaccccttcattgtgaaatttcttttcagttgaatattatgtcagcacttgatatatacacacatgaaatgtgtttttttccttatgtatgatttcattaagtatcgtaaaaattgtgggtttgcgccatcagggaaatgattgactaaaaagattcatccacttgtggtgcttcgatgagtctttctttttcatgtatcagcaagtaaaaacggggctgtgatggattaatttgaaaaaattaattccttaggcatgaactgaactgagatagtacttgtttagtctttgaagcatacttaactttgttggaaaattaagatccattagttcagggaagaaagaagtcctgctcaacctacatccagcaaaatattgattggaagtgtgctgaacttttaaacttcttgtaattacacactgattttacaggaattaaggccatagaaattgctcccttacccttgtcctgcttttctatacatataacagcacgggagaggaacacttggaagatgaatactgaggaagagtaatgtgaaataaaagacaatattcagtagcccgagccagtattttagggctctggagccacctgaacaatccccttcaagaacctggcatgaacagtgcagggatatgcaggaagaattttcctgaatctaggctatgtatttccctacttcaggaaaatctcacaaaccaagatgctactctgaggttcagagcctagaagcaatatatgtgtcaaatagaaaatgtgatacctaagagaagggaaagatgtgattcagagaaatataaattctataatatatcattaacccttgataggtcccatgtgttccaccctcctccccctaaaaatggcatccagttggtggatgggattattagtttttattctttactttcaaattgcagcattatatagctttggcatagccccatggtgtttggagagtactttccaaccataggctgtggacttggccatgcgaattcatttggccaataagatgttagcagatatcacgtgagcaaattcttgaaaggttattttgttttttcttccttttatcatgtgataaatatacttcaggcatgtggtggtccaaggaagatgggagatatgtggagcagacgtatacctaattcatagcttggaggcaagcctacatgagcctagcatatatcagccaaacctcagccaacctgtagatatatgagccagctataaatgctttattgtgcatatcataatttggggatgatttgttatgcagcatttgtgtgacagtagctgactgataaattccttcacttttccttatgaattaattctgggtagatttcccctctcccttcaatttgtttgtagtatgatgataggaagatatattcacattttaattttaatggatttgtcatcttctataagacctaagtgacttcttattttatagtcagttgtatctgacaattttaacagagtaattgatttaattattaagataaaaggcaaattatatgtttttatctacaaatgacatgttgtagatatggtaagaactttttcattaaaatagtaaacatgtactgtgaattttaagtggttgttacccactgagatttctcaatctctacttggaatttcgaattatttatcattaacagcatactaaaggggattggtatccagcaggaatcacattagatgcaattcaaacgtgagagaaaaggatggggtaaaaagggctatgcttttattgtttgattttcttagaagctttaaccaacgaaaagaaactccccgctcatgcccctacaaaaatactgcctcttttcgaggctgtggtagtattgttactacattatagcataatttaataaatgttactccctgagccttaaagtgaaatacattcactgggtcctctaaggaaaatgaagatgattgagatgtaatccctgcctttaaaatccttgagttgggaagaaagctatattatctttattaagagagttattgtaccctaaataacggcacatatacctaaacttgaggtggctgtgtagaacactctcaaatttctactctactggtttaagattatattttttaactatggcacttcctaagatctcagtgaaaatatccagtaactaattgtctttctgtacagaaacttcccaatccaaccctccgccgcccccgcaaaaaaaaaagagaaaagaaatttctcatatggaaatgaaacatcatttatccatttatggaataaagacaagactcaattctacaaatttcagaacgtacctgctgctctgcatctttaaaagccagcatgaggcagtactccacttttgtgatactctgtttttaatactaattgtgaaatatgtcatttacacagaagtgtgatgtagaaataatggaactggaaggtttaatcatgcagctctgtggcatctctcagaccttgctggtgacctacaaggtatctctgtcctctgctcctttccctctagcccattctcccccatgttctctaaggcaccattgctttaagtgtatgctagggaaaatttctacggcatgctccgtgtaaagttgttttcatggccagggaagttaggaaaccctgcatactctgtctccctctcaaagactctgaatatgttttaactttaaaaatagcctccaagaagtcaaaaaaaaaaaaaaaaacaccttttcccccagattttttcatcatagacaccctcattctctccccatatgcgatggctgagagcctgtatattagacattggattgatccaagttttagagggagccagtttggttgccttcgttggtttctgaagccagccctaaatgggcacagccttgggccagacctcctggggaagcgccagcagcctgtggattgactgtccatagcgaagggcacctgcacatcagtcggtgccacccttgcttcctgggtgcaagtctcatctgtggatacagcaggcaccgtagcccatgtactcactttaatgagatgctctgtactgtcatttatgtttcattcttgtccttgatgttgtgctatcttttaaagatgttacatgcaggtagcctggcatcaaagaatttgtgatagcaaagatattggaagtatcttcctaagggcccagcttcccaaatgggctacttctcaggatcaggcccattatgctcccttttaaggttattaaattgttacatcaggctgggtgcggtggctcacccctgtaatcccagcattttgggaggccgaggtgggcggatcatgaggtcaggagatcgagaccatcctggctaacacggcaaaaccccgtctctactaaaaatacaaaaacatttatctgggcgtggtggcgggcgcctgtagtcccagctactcgggaggctgaggcaggagaatggcgtgaacccgggaggcggagcttgcagtgagccgagatagcgccactgcactccagcctgggcgacagagcgagactccgcctcaaaaaaaaaaattgttacatcatattgtttgttcctgaatcttatgttcatataaaaggacacattctttttttattttttgtttttttgtttttaagatggagtctcactctgttgcccagggtggaatgcagtggagcgatctcagctcagtgcatccttcgcctcccgggttggagcgattctcctgcctcagcttcctgagtagctgggattataggacccggctaattttttgtatttttagtaggaatggggttttgccatgttggccaggctggtctcgaactcctgacctcaagtgttctgcctgccttggcctcccaaagtcctgggattacaagcatgagccaccgtgcctggccacagtcatgtattttaatcactaaattattgcatgtaaaatataatacttaagacaggtctaatcaggtttctctaatctacttttaacagaaagaagtaaaaacaaaacaaaacgtcctattgttcctcaatataaacaaagcaagttgtagttgtataatttcatattgtctgaattataaaatttctatttgttatttttcatgacacaaaatattatattcatttctttaatctttatctggaaagaaaaaacttccttgtgtcactaaacattgaattttctgatctttcaaggttatatactatattcgggggagagggttactgtaggaatcttaaatctgacttgctttacttttgttagttttaatctctgacttaatattatattaaggtacaatattacattaaggtactgactaaatattacattgaacaggcaatatggaatggccattttctgatttttattttctagtattagattaatcctttacttaaagaaaattggtttttggtaagttgagtcagagatcggctcttgcttttagtagtttcctccctctaccccctttcatggggatgggtttttaaaaacatgaaaaaaaatgtctgaattataaagaatgtctagaattgtctcactcatatctgtcgtcgaaaattatttcaaaggaatagatacagatttcaggaagtcacataaggacgtatatttaagatagtcacattattggactaactataacctatatcttaaaagttttcttttactgaaagtaaataccagagctggttacaccgagctctgtgaaactcttctcttatttattgcaacgttaacttacatttttcctttctttatgagtgacgtaatattgaattttgagttaactctcaacaaattagagtacaattcagatgtgtgtgggttttctaatatatatcagagatcatagggctatacagacaatacagacatacatagtctatattctaatttatttttgttgtctatagctagacaatatagagtatatataatattgtctgtattctaatgtattttgccctctagactatatagtccatattgtctatctatctatatattctattttctatctatagtctatcatctatattgtctatctatatagtctgtgttgtttagagggtgaaatactttaaaagatcatctacatacttgtaaatcaccaagattacatcagcagtagtaagggaaatgtcctttactatttagtataataaaaatgatcctccttagatcacctttttctttgacatgtgcctgctcatctctcatctttttcttttctttaccctcagaaaagtacaattgaaaataaaatgcctccctgctgttgaaatgagtctctgatccctactctaggatgatatccacattctgaattttatataatccaattggccaaaaacctttcatgcttataatagctacccagtgcttcttcagaagattaaataatttcagaaaattaagtgtcttgcaggtgtcttatcctttcattgttgtgaaaatttatttagctgtaacaaaagttttgtcaccttaaatttcttagaatttacttaggcaaaagttaacaatggataagcttattataaaatatcctggcagaattgccagatatggcttttgctttatatattttaaaagttattctttttttaaaaaaaaaaagctcttttgtttgagttttggtaattgacaaaatgattgcatgtgaaacataattcttacataaagtaagctgctcacaacacagactaattacacatttgggaggcaaggcaaagacatccagaggttgctcgtgctgagccaagagcacagcatttaatgaaatgagggccataaaaggttcagcatggatgctttcaggtctgagctgggcttctgggaaattggatgttggccctgtggactggtggattcccctgggctttgaaaggctgggttattaccacttgcatgcgtgaatcaggcactgctttgcagtacaagacatttgtgattccagagatggccttatttggaacactcttaaggtaatagtatggatgtctccccagtcatccatcttccttcctctctttcttcctctcatgccaagtaattacttttgatatttgttttctaaaaaatggttagtatatctagcgaggcctgaccaggtagactcttcagtttcctctttccgattcttaaacccatgttggccaggctggtctcaaactcctgacctcaagtcatctccccgcctcggcttctgaaagtcctgggattacaggcatgagccactgtgccttgccccatcctggattcctatataagtaaaaggaaacattttatatatgtaccaataagtttgttttctaccacccgtcctcctctgttcatcccacagagatcatacttcctctggaaaattagctgccatgtaactagaaatataacaattacaggattctccagcagttcattctgaccaactaagtgttcagtcatgaacctgtggatctaacactttttcatcttaattgtgctgaagtatctcctattttctccactcagagatatctggcatccctcacagtaaaaactgccaccccttcctgggacttggaaacatatgaacaggcagcaatgcagcctgttgctaaaacaccttctgggccctggttgctttgaatttgactgcatttgccaattgttgattcagggcagtagttcttaattggaagtgattttgaccccaggtaacatttggcaatgtctgaaagcattttaattgtcacagcttggggaagggggtactgctaacgtctggtgggtagtagccaaggacttggtcaaatatcaggcactgcattggacagacacccacaacaaaaaattatcaggcttcaaatatcagttgtgccaaggtcaaaaaagcctaagttgaaggttctgtatgaccagccctgggcaggtgctgggcattaggcctacacctatgcaggggaggcattagagcatccattctgggcctggctctgggaatctcaaggacagagcctctagtggcaaagaataacaagtaatgaaaagatttaaaactaaatgaaattcacaagatttcccttactacgccagccaggctctgtgtgtgtgtgtgtgtgtgtgtgtgtgtgtgtgtgtgtgtgcacacacgcttgaaatctgtgagtggaaagagctgttgcctgaaagatggaaaccaggagaatccgaggtctagatgtgccactgcttgggggttcgtcatatcactaaggtctggcatttagggcacttggtagtactttatacccatttccattttgctacaaaatgctgtctggcaagatttgagtttaattttgagagttactggttgaaccaggattcttggagggaggcattcagcatattgatttttttaatgttagataaagggacatttatttctaacagaggaaatggctgtgttaactactgtaatggtttcctttaccatttgggaagtttgctattattagagggcactaattatggcttaagcctggtacagcataagaaagatataaaacataactgtacttgggtggagaatgtaaatggcatagtgtcttactgtcattgtagaaatctgtcctggaatttcttgagggtcaaatcatggaatggacaaaagttgagacacaaggatacagtatagtatggcagtgaagagtctgacagttgaactcacagagtagaatggtggttacaggcacagaggaggaggagagtggggaaatgttggtcaaaagacacaatctcagttaggaggaataagttcaagaggtgtatcctactacatagtgactatagttaataacattgtagtttatacttgaaaatctctaggagagtagaatttaagtgttctcaacacacacacatacaaattcgtaagaatataaggtaatgcatatgttaattagctcaatttagctattccacaatgtatacatagtttaaaacaccatgctgtactccataaatatatataattttgttttgtcatgatttctgttcttttacatttgctgaggagtgctttacttccaactatgtggtcaattttggaataagtgtgatatggtgctgagaagaatgtgtattctgttgatttggggtggagagttctatagatgtctattaggtctgtttggtgcagagctgagttcaactcctggatatccttgttaactttctgtctcattgatctgtctagtgttgacagcagggtgttaaagtctcccattattactgtgtgggggtctaagtctctttgtaggtccctaaggacttgctttatgaatctgggtgctcctgtattgggtgcatatatatttaggatagttacctcttcttgtggaattgatccctttaccattatgtaatgaccttctttgtctcttttgaactttgttggtttaaagtctgttttatcagagactaggattgcaacccctgcttttttgtttgtttgtttgtttgttttccatttgcttggtagatcttcctccatcccattattttgagcctatttgtgtctctgcatgtgagatgggtctcctgatgtgtcttgactcttcatccaatttaccagtctgtcttttaattggggcatttagccaatttacatttaaggttaatattgttatgtgtgaatttgatcctgtcattatgatgttagctggatattttgcccattagttgatgcagtttcttcctagcctggatggtctttacaatttagcatgtttttgcagtggctggtaccagttgttcctttccatgtttagtgcttccttcaggagctgttgtaaggcaggcccggtagtgacaaaatctctcagcatttgcttctccgtaaaggattttatttctccttcacttatgaagcttagtttggcaggatatgaaattctgggttgaaaattcttttctttaagaatgttgaatattgggccttactctcttctagcctttacagtttctgccaagagatcagctgttagtctgatgggcttccctttgtgggtaacctgacctttctctggctgcccttaacattttttccttcatttcaaccttggtgaatctgacagttatgtgttttggagttgctcttctcaaggagtatctttgtggcgttctctgtatttcctgaatttgaatgttggcctgccttgctaggttggggaagttctcctgggtaacatcctgaagagtgttttccaacttggttccattctccctgtcactttcaggtataccaatcagacacagagttggtcttttcacatagtcccatatttcttggaggctttgttcatttctttttactcttttttctctaaacttctcgcttcatttcattcatttgatcttcaatcactgataccctttcttccacttgatcgaatcggctactgaagcttgtgcatgtgtcacgtagttctcttgccatggttttcagctccatcgggtcatttaaggtcttctttatactgtttattctagttagccattcgtctaatcttttttcaaggtttttagcttcctcgcaatgggttcgaatatcctcctttagctcggagaagtttgttattaccgatctcctgaagcctacttctgtcaacttgtcagagtcattctttgtccagctttgttctcttgctggtgaggagctgcgatcctttggaggagaagaggtgctctggtttttagaattttcagcttttctgctctgttttttccccatctttgtggttttatctacctttggtctttgatgatggtgacctacagatggggttttggtgtggatgtcctttttgttgatgttgctcctattccgttctgtttgttggttttccttctaacactcaggacgctcagctgcaggtctgttagagtttgctggtggtccactccagaccctgtttgcctgggtatcaccagcagaggctgcagatcagcaaatattgcagaacagcaaacgttgctgcctgatccttcctctggaagcttcatctcagaggggcacccggctgtatgaggtgtcagtcagcccctactgggaggtgtctcccagttaggctacttgggggtcagggacccacttgaagaggcagtctgtctgttctcagatctcaaactccatgctgagagaaccactgctctcttcatagctcaattggaaaggcagaaatcacccgtcttctgtgtcactcatgctgggagctgtagactggagctgttcctatgtgaccatcttggaacaaaatggaagaacattccatgctcatggataggaagaatcaatatcatgaaaatggccatactgcccaaggtaatttatagattcaatgccatccccatcaagctacaaatgactttcttcacagaattggaaaaaactactttaaagttcatatggaaccaaaaaagagcccacattgccaagacaatcctaaccaaaaagaacaaagctagaggcatcacgctacctgacttcaaactttactacaaggctacagtaaccaaaacagcatggtactggtaccaaaacagagatatacaccaatggaacagaacagagccctcagaaataataccatacatccgtaaccatctgatcttcaacaaacctgacaaaaacaagaaatggggaaaggattccctatttaataaatggtgctgggaaaactggctagccatatgtagaaagctgaaactggatcccttccttacatcttgtacaaaaattaattcaagatggattaaagacttaaatgttagacctaaaagcataaaaaccctagaagaaaacctacgcaatatcattcaggacataggcatgggcaaggacttcatgaataaaacaccaaaagcaatggcaacaaaagccaaaatagacaaatgagatctaattaaactaaagagcttctgcacagcaaaagaaactaccatcagagtgaacaggcaacctacagaatgggagaaaatttttgcaatctacccatctgacaaagggctaatatccagaatctacaaagaacttaaactaatttacaagaaaaaaacaagcaaccccatccaaaagtgggtgaaggatatgaaaaaacacttctcaaaagaagacatttatgtagccaacagacacatgaaaacatgctcatcatcactggccatcagagaaatgcaaatcaaaaccaccatgagacaccatctcacaccaattagaatgacaatcattaaaaagtcaggaaacaacaggtgctggagaggatgtggagaaatagggacacttttacactgttgtgggactgtaaactagttcaaacattgtggaagacagtgtggcgattcctcaaggatctagaactagaaatactatttgacccatcaatcccattactgggtatatacccaaaggattataaatcatgctactataaagacacatgcacacatatgtttattgcggcactattcacaatagcaaagacttggaaccaacccaaatgtccatcaatgacagactggattaagaaaacatggcacatatacactatggaatactatgcatccataaaaaaggatgagttcatgtcctttgtaggaacatggatgaagctggaaaccatcattctgagcaaactatcgcaaggacagaaaaccacacaccgcatgttctcactcataggtgggaattgaacaatgagaacagttggacacagggtggggaacttcacacccaggcctgttgtggggtgggggcctgggggagggatagcattaggagaaatacctaatgtaaatgacaaattaatgggtgcagcacaccaacatggcacatgtatacatatgtaacaaacctgcacattgtgcacatgtactctagaacttaaagtataataataataaatttcatttcaaaaaaaaaaacaaatttaggttattcttatttcagaatatgagctcactcacccacacagatgctagttcttgaattttgtttgtactaaatgaaaaacaacttattggttggttgacacatttaccccactggggcctgaattcagccccttttaggagggacagtttcagaatatgccatgaggtgtctgcggtgtagatccatgctctctgcaaataggggcagcggctctatagctgagtcctttcccagactcctttaagaaatttcaacaggctttcacagagctatgcctgctccaaaatatacattgacataataaaccacaatggatttaagtgtttaaagtcagaaatacacttttaaaaataagtacttcagttggccagtggagcagtaatacctggatgctaaattgaatttgtttagaataaaccacagagtaaactttaaaaaaaatgaaaataaaaaaattttgatttgtcaattaaaatatacatttataaagaaaaaataataaaacactttccacatcatagtttatctatagaaaatgtgtcaccttccacaatggttgaactagtttacagtccgacaaatattgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataagtgtcttcctttgagaagtgtctgttcatgtccttcgcccactttttgatggggttgtttgtttttttcttgggtaatgtacccaaaggactataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaatgatgagttaatgtcctttgtagggacatggatgaaattggaaatcatcattctcagtaaactatcgcaaggacaaaaaaccaaacaccacatgttctcactcataggtgggaattgaacaatgagaacacatggacacaggaaggggaacatcacactctggggactgttgtggggtgggcgggggggggaggaatagcattaggagatatacctaatgctaaatgacgagttaatgggtgcagcacaccagcatggcacatgtatacatatgtaactaacctgcacattgtgcacatgtaccctaaaacttaaagtataataataataaaatttaaaaaaaaagaaaatgtgtcaccttaaaattgtatacttttgttgaaaatggatattgaataatgtcaaacatgaaaatgcagcagaccactcagaagtattcactagaggaaaagataaaaaaaaaaagagagtctgacataggaaccacactgtgcttgagccccacaaagcttccacattccaagtcttctgggctgtaaacatggcgtttatttgctgtgcacctcagtttcctcatctgtggaatggacatgacaataaacctcacaggtttgttgtgaagcataagtgtattaatatgtgtaaagtactcagaaatgaagtagtcaatcattgttagcctctagtatattgtttctgttgtattcttgaatctcagatgtcagagacttaaaaaaaattttcaaaagaaaagataatgataatgcaacctgatttctattttgcttctaccacttaaataataaatgataagtgttagtgcaaagagtggttgtcagtcttgctaagaattaaatataattgccaaaagaggaatgatttaatcataaaatgaagtgatttgaaggtattactaaagcaaaattagttcttgtctctttgtctctgatagacaaaagccagagaacctttctagtttttctcttgaaatggtgttcacaaacttacagtaggatggtttttctttaatttgcactttaattcagtggaactttattagactgaaattaagcaaatcccagagaggcctggaaacataaatggttttgaaatgttatggattctaaattgggcattttgaaagacaaaggtgaaggctaatagtttacatttagtacgaaactctggcattccaatggaaattggaatcaaataatgggatttgttttttaggtaataatataatgagttagctgaaagagctaacttgtaatagatttattaagccataaagtttcatttctttgaacaacatattgtcaaaatcttcacagacaacttcacttataagaaaattaaatgaaagaactatttctttaaaagttagctgtggattttctctatttggggaggggttgaaaatgccgcgtcaatggatctggctgtgatccgacctcttaatcctgttttaattatgggttctttgctacttctgattttatagttatatgtgactgacattcagacattcatagtaattttttaaatatgtaattttacataagagtcccttcaatgtgaccttaagatgggagtctctagatataattatagagaggaaggaaccgacctagaatgagttgatcatttccaggagtatctcattgtcagatttttcagttgaacactgtggcagtttcacatttctacaagcttgagaggaatgcagaagggagacccacaaagatgctcatgtggacagcacttgtctgttcccactgctgtatatttgaaaacactggggaccaaatatgattaaccacatacttctccctggagacctgaaccctaaatatgcctttttccaccatactctgtgtttcttgagaccagtatgcttgcggctaggtgtcatttatcaaatatgacatgaatgtttgttgtgcataatcatttttgtttaggtttaaaaatttaatggcagtgagttatactacctgaagatgcaggctgaaagcatgagttttgacaaagtgaaatttcatttgatgatatccattataaatcgtttttctctaactttaaagtaacatctcatttttactgtgtcttattaacaaactttaccaatagtgttgtttccatagtaaatgatatgttttaaattatatatgccccatattttcctgaaattttaagacgtttctacactaaactctgttccttcatctgtaaagtgaagatgttaagactccattatctctaagatctcttctgatacccagggcaccctaagtctaatgtccagccttttttattatggagaatatcttagtaaatttccaaaggcttgcgaggtgtttcagattgcatcgctctgacttgccaaacgatcctctctattgaccattaccgaatagtattccctgaaacctcttcccctgctccatggatgtgactgtggctccttgtggagagctaaacccagcctttgcctgccaggagccgattacagctgtgagaggtccagtcatcctgtcctactgattgcatctgtgtctggtcatctgagagagtgaaatattaatctgctttcttctcttcactcttttcatgtgtattcccctaacagaaaggagaacctgactgctgtgcactctctctggagacaagcgagcagctcacctttgagatccccctgaatgattcaggttctgctggcctcggggtgagcttaaaagggaacaaatccagagaaactggaacagacttggggatttttatcaaatccatcattcatggaggcgctgcttttaaggtgggtaggaatgacatttgtacatcctttgagaaggcacttggagatgtgactgttgtacttagagactgaatggagaaagtgtctgaagacttgaggccactgagactttcccgccagatacaaaaaatatatgtgtgaacagatctgggaaataactggctgctgtttttgtaccttaactggttatttttacttcttagagttacctctaaaaacccaacatgattcacattcttttttgcatactttttattactgcaataggattcctctggatttgtaaactgacaagagttgagcctaaaagtacacgatcagaaaaacaaaactaaaaacaagtaaacataaaggcagcaaataagacagttgtgcttgcaagaatgaaagctcagtggagcctgagagtgattgtagtataaattaaaggccatttatcacattttatacacttgaagaaaaccatggtgcccagaatgcatatttccttttgtatacttagagaagcttagttttctaggtttccagaaaaagaaggaagatcatgcttcagtcctttcacgttgaggtgagtatagtgtactggttagctagatggccggtgttcaagtccagctcagtccttgctagctgtatggaaatgtaggcaagggtcttgaccagctgtctcccatttcctcaccggtagaatggtgataataaataataactacttcataggtttccaggattaaatcacacaatgtgatgaaaacaataaagtgatgatagaggaaggatacacgtttgcacctcttgccaccctcattattatctcacaccgtgcaaggagacttcttgagtttgaattctgccttacctactctctccctgtgcatgtaggtaagctgctcagccttgacatgcctcagtttcctcatttgtgaaattagcagtgcctggttcctcatgctgctgttaagactaaaagagacaatatgtgtcaagtgcttagcacagtgcctgtcaccagctgctgataaatgttagccatctgaaaataatcgtgatatgaataatgtctatcctctcccacagcaaagccaagaaggccccgttacactcaacagagcacccctgcacctagaattctggctttgttgaagcaactgtcgtctcacacttacccttccacttttgtttcagactagatgtggagataatgcctttttcactgggaaataaatgtactttggacagacacctcttcagtttactccttggtttagttagcttttgtcgcataataaatagtcataatttttcagtaatatacacatcaataagcctttatttttctcatagctctgtgtgggggagctggggtttgggtaggattctgattcaggctggtgtctcttgatcccactgtaactctgcagatctgagtgtgctgcacttctttctcctgctccttggatcagcaggctagctggcgcatgtccctctcatgcctcgagctgtcagagggccagcggcagtgggtgaatccgcgggctccaagctagcacactgtcaccccacacataggccactggtcaaagcaagtcatatggctgagtccaaggttgagcagtagaaaacacactccagccacgatgaagttatggcaaagatgtagatacagagaagggtaaagaattgagtcccatcactccatctataaaactggctcagaaatacataagcaggagcaaaagcgaaatagtagtaatagcaacaacaacaatagcaatgaacatttattgtgcttagtatatgctggacactaggataggtgttttatatgggttatctaactttattcacatttacattggattattttcagtccattttatcaaagtggaaattacagattagaccctttagtgcctttcctgtggtcagatagccaggaattactttaagatttgaatccaggcagtctgactccagaacctgcgttatgctgcactgaaatgaagctcttccatatgatccattcatgttcctagagagcagggcctgttcgcctggaggtgtcttgtatggtgctatcatccttagccaagccatctaggtttgaggatgagttcttggtcatgtttgtggataccagcttgaaattagtcttcttattcctaatgacagctctatttgtagaatttactccaagtaaaattgaaactgagatgacttttcggaaattaaaagcaaacatcttagcttttttatgggcaataacttaagctcaagcagatattggcgagcaggtttaatatgtatatccatgtttgtgtaagtgagcatctccttacctaagcagtttctaacagtcctgtttcttgcagaaagatttcactttccatttatgtaaatttctttcctgacactggtctgctgagtcagacaatcacaccattaaaaaccactggacagcatatttatagctgatcttaaacagtaagaggcatcagtcatgaacttagccttcttgtgaatgtttagtatccatttgtcttgtttaccttttgcagtgtaaagggtagaggcctgagatttgttcacaaaaaatctgattaaccaggggaaaaaaaagtatttttccattctcctactgttgttccagtaatccactgttacgcctcggaaaattgccacccattctatgattcaggattctgtcttaggaaaattgttttgagactttgttcctgtccctgttgagaggatacacatgtaacagactacagtgtctctggggcagaggagagatcagcactgggaacatctttgtctcagcatttggccctaggtttttacccggaatcaacaaaataatctttcaaccagagcacaatctttttctcctcgcccttcataccactaattagttctcaaggtgtttttccctttagggaaggtggattttttgaaaactaaactactttgaaagatatgaccaaattcttcctgtgcattctgtgtgctggattctcctgggggcttccattggtctaaacaaagataggctacttcttgccagatgtaaaacccctgaatacctcgactctaattgagggcattgctttgttttgttttgttttattttgttttccttaattctcagtctactgctttctgtcatgtcatctcttgtttgaattatttctaatagaggatgtaaatctctatttggaaacaagagcagccagctactctaggacgccctcttggaagtgagtccctgactcattctaaaaaccaacagaacaataattctaccctgctcagaattatccaaatgcttaatctcaacttgatatttaacttcaagtctgtacattaagaaataaagcccagaaactcttctgtgcatgcatcaggctgcaccacttttgattacaggctgttttgtcatacggagctcttcataggcccctctgaagcataacttgtagctatgcctcttagtgtactatatggccattgaccataacagcggaatattgcttcttagagtattgatgccaatgtgcctaagcactagcatgcattacatgtttgtggtttcatttagttactgtctttcttcctgggcgtttgcccctgacatacagtgtagttgcttctagaactaaaatatactaaatacaagcatatatgtcaactgcttctgaaagaattatgagcagaatgaagttacgacatccatgagaatgattttctaaaatgttgcttttgtggttggaatttatgtggtagtgctgttgctgttcaataaaaagaagtatcagctctgttgcagttagaaaaaatacctttccctaaatccacatcaaaatgtccctaaatccacatcaaaatttgcgttttattttgtccaggaaagcacaaatgaagtctaaatgatccgtctgaagatgttagatatttttatgttcatttgctaaacattttaaattcattttgagatcagtggtttttctttgctttgcttttcatgtaccatattaactgaaaatttttagtaaaaatttttacatctatggactacacttccttaagttgcttgttttgctaccctaaagaattactttaaaaatgtatacataactagaatagtgctttctttaaagttaggtaagatattgtaagaacacactgtagtgagaataaaagtcccatgaagtctgttgtaccagttctgaatggtgtttttgacttcactatgctgactttgggagtggtatgtctcctactgaaactttgacctagtaaggtaagaattcaaatttacaggaatttttgctaaaggaagaatgtcgtatatcaggtagattgtttaggggctgctaaatagagagaatacatttaagactatcagttattctctagagaattaattagccaggtttgtgcttaataaattctcttgatgatgaagaaattaagtgaaagaaaaatgcctgacatggctaattgtaaatgtatgcactcagaatatgaaatagacataattgaagtaatttgattcttgtgtgcttaggaaatttgggattctccttctgaaggatgcaggatttcataatctgcactgtttagtaatgggcaaaagaaagaatttggaccaatacaagcaatcatgatatttttaaatgactaaactctaaatttttggagagaaaatgcacatctctagaatatccagaaacatggcgcttgatcctgaatctccatgtctcattgtcatgtgagacatttaacagcatccaaactacttaactccagtaggagctcccagcgtgactaatttccacccccatctctgccggtatctataaatcatgtgatagatctataattaatgaattcaaaggaagataaaagggacagctttttaaggaaaactaatgttaaatgatttcttcaactggccatttttcttaaaatttataatgttttctactggtgggagaaccttgaggatccttactggtagtcagtgacttctaagctgttacctctggcaaaaggaccagataatgtgagaatgtcaaaatgctattgaaactcctcaaatgtaagaagccaaacactaacattttatttctaaccacaaagatgtgatacattttaaggactttaaaagcaggaactttgcctggaaatatacataaattcataatcactatatatccaataagaatttgaccttaaaaaaggaagttattaatttaagcctaggaaaaatacattttagctaattttccgttttaaaaaaatctgaaaatgttagcatatgttaattcacatagtcaggcttatttatgaattttctaccataggaactattaaaatgtaatataacattacttttaaaatctcaaagtagctggcacagtaatgggcacctgtattttcaactaagcaggaggatcacttgagctcaggagttccagactgtaatgcagtataatcgtgcctgtgaatagtcactgtgctctaggcctgggcaacacagcgagaccccatctctttttttaaaaaatcccataattccagcatctatcattgttttttcttgctgatctttatcacttttgcatttttatttcatgaatggaaatgcaaacaggaaataaatttacatgtacactatactgaataaaattttggaatgctacaacattttgatgtgtattttggactccgtgattgtctcagtgggcttgaaaaaatttaagggttgatattcctaatgaaaaaggaaattataatctacaaaagttgatatagcatggtaatgatgctttggctctgaaaatagtaactttcccctgaaaagctatattcgtcttcattatgggtacctataggccatatatatgtatacacacacacacacacacacacacacgtaagaccagtcactaggaaaatggacacaaaccagaatgctcaaataaaactctgaccacagtatgaactctgcatacatatacacacgtttttgttctagcattctggttgtacccatttttatagtgactggttttaagcaatctcagtataagcaagtgccaagtgcataaaaaccaccaccaagaagtaaatcaataagataagtatgttgaaatggcttccgaaattctaacctagttaggcattcatgcaaattattcttaattcatatataacatatatgctttaacaagcttctttttaatctggttttctaggccaaagtaaattaagagcagaaaatcaggaaggagataggaaaggatggagaagaaactggaatgacaggaaagaaaaaagtgtaaaacaagcacagaatgttattattgtatggtacaccagagaatatttctgatggtttgaagtcagtatttctcaaactttcttgcagaagaaattataagattcaatgtggccatagtaaaggccataagttgcagtatatctgtttatgccccatatttttccagaatgattttaaaatgaaaagatttataatacattttgaaagcattatttcagaatggtttatgcatatgttaactcctatagtcaggcttattacaataagcctgaccaacatggtgaaaccccatctctgctaaaaatacaaaaactagccaggcatgatggtacgcacctgtaatcccagctacttgggaggctgaggcaggagaattgcttgaaccagggaggcggaggttgcaatgagccgagatcataccactgcactccagccggagcaacaagagggagagactctgtctcaaaaataaataaataaataaataaataaataaataaataaataaataaataaaagcttcatatgcccacaggtgatttgctgctgggacttcattggtttgttacatagaaatggagtgaggttcttaagacaataactgaattacataaatttaaattttacaatttctgaacaagtagagataggggcagtatacagaacgtaatcaaactttttttttcttttttggaattctgaaggttctctgaatatgccctggcatattcaagacagcttaggttcgtgactctctcatagttacaatttgtagatgaaacttaacaccaggaccaaaacacctgactgacttaatttagcaagcacttcttgaacatttagagtgagttagacaacagtgtatagtggactagacaccgcatacttaaaattacccattctataatctaggaaggtagtaacacaatacattaaatatataaaaaacactaatatgataagagctatgataggcaaatgtgagaagtatcgtgggtgttgagatgatgaagcatttaattctgtctggggagaaaactatgaaaggaaggcaattgcaaggcttgcttggggtgaggagtaagtagactttgaagaggtgagcaggaatgcaaagggcattttgggtagaagaaagaatatgggcaaagtcaccaaggtatgtacaccaaagtacagtctgttgtgcctggaaaatagaggtcttatttgggaagaatggacctcttcacataagctgaaatgatgtgaaacatgtagtagcttttttgttttaacaactgtactttaaaaatcttgattcattcttgcccttccattgcaattgtttttaaatgaaggtaaatgatttcaatctggaatacaaggttcttttcttagtttagggttttgggttttttggggggtttgatttgttttttcaaaaaatgcagtagacagatgttgtcatagagtgattgtagggccatgagaaggattcgttgaagataattctctccctgaatcaggtgccatcttgcctggggtccagccctattccagggaacatctgctctgcaacctgaagtcaagctttggggtttgggacctgggagttgataatatcccaggaggccgtaccaagggccccgttagaagcatgcagaggcagaagccaacatctggtcatgattaatcctctcaacaccctggactaatgtggactggccttgggccacagccagctacccctgggaaagccagcccactttctcatgcttctctcatattcttcagtggctagttcagttctttgccttggctttcttacttttcctctgtattcattagaattttagaggtaacagggcagttgaggggagggtttaacaaaaaatttgccaagccaggtggattaagccacacaacattgccagtaatcatggcagaggaagtacccaggcaccagtgaatataccacaggggatgaactacaaggtcattgcaccccccagcaatcataaataagctttagaggacacatggagtagcctacagcatacataacgacccctcactccaaagaattatctggcccaaatgtacaattgtggaaagaccctggtgtaaatattttttttttcaaaaatgagtatctgtagcttttattagattctcaaaggagtctaagaacccataaaggctaaaaatcactagcagattgtttgaaaacatgggctgcagagtgacccagacctagttcacatctgcttttagaaacatgacttgtaacaattcatttaacctctctgactgcaatttcttcttttataaaatgggggcagcaatctcaaatatacagggtttctataaggagtaaattgtctgctacatgtaaagggtttagcatgatgcacagagtagaaactctttgtcattaatatagtgcctttaataatctctaaaagtctgaatgtagaagcaacgtagcataaaggattcatgtcattaacctgagagatgaggagacctggctatgaccataccctttgacaagtcacttaatttctctgagccttcatctttacatctcctaaatagcagagagtagcatttatatcacagggttgctgtaagaaatgaatgggcaaatatatgcaaaagacatgctcaaggactagcctacattaggtgttcagtaaaagggagatgtcatactcaaaggtcttgtctcctggtcctctgtgcgtcctactgtgataggaccagctaaagctgatgagattgaaaccatgccaggacatggagaagacctaacctcataccaggttttttcgttctaaagtgcactgaagaagttacattttgtctttactctgtcctcctgattctttttaatatgttttccttccctttgggaatttcctttactcctttctagcttgaggatggagttggttatggggggatgccagaagcggggaacataattgaagtatttttgcttaggagtctgatgggagtaatagaggaagaaaaaggggtgagaaagggagagagagagagagagagagagagagagagagtgtgtgtgtgtgaatattgcaagcataacccaggtgaaataaatatcctagaattaccaagcaacatccttgaatatttgaattcatttatgtaaagtcaattgaaagttaatattctcatgcctaaatatttactagaatttaatattaattttaaaaaccataaaaagctgattgtctttgtccaaattattccaaagcaaatgggacatacacaattttgagagagatttgatgagtttttgaataatgagctcctcattgaatcaacttcattttaggtcaagactggacatagacgtgcatgtatggatgtctagctaagtaggtagacagccttttttttttttttttccctcctctgggttgctctgccatgcccctgcacagtttcctgtctccatatcttctgttgtgtgtcttgattttatattgtcttcccttccaggagatatctggtagcatattgtcctctctggttctgaaagtcttttttttcttgaagcattacccctttaggggcttgtcattgtcatctatgtagaatatagaatggtttggtgaatagggacgctgtggaattcagaacttgggctgttctgttccaattctgaccttaactagctgaacaagtctaatatctgtggaagtgccttttcctaataggtgttcgataaatggtttctcatcctctttgggcatcccattattcatctgtaaacggaagaggttggatgagatgacctctaaggacccttccagctctaaattcagtgattatattctaaatgttaggacaacatggtgcttactggcatcgccattaatgaaattacacatcatttatcttataaagaaaaagcacacaccaataacaacagaccagccaagcctgacagtgagagtgtgtggatttttattgcacccacaactctctggtgatgcttgtgatgaatgtgaatgtctttgaaaaaaaatttcagctgccctgaggtgacctgaactgtctttttgtttgggacttggttacaggaaacatgccctacttcagtgtcattctgcatgcttgagatttagaatgtaactgaaaataaaaaaataaaaaataaaaagtttgtgcttagtaactgttgatagattttaccaaaagttctcctatcttcttgtctgttatctacctcttcactctgacgttgtctcatacttcacagaaaaggttcacaagagattaccaggtgggatctcactcatatttccttccctccatctctagaggttcccataaagcttccatctttatcttgtttcttcctgtcgtagcagatgaggtgtcctgccaagacaaagcactgcaaaatctcaacatttcctgttaacctcatttcctgttaacaggactaggaccaggaactggattcaactcttctgcttcctcctcctctttaaaaaccacacatcagtctccagtcatcctaaaacgatttttagtaacaagattcagcccaatggttctcctttcttatatgacaatagagcagaaatatttctccagttatatctcacatcacataacgaaaccattcagggtgtttttgttgttccccccaccctttttttttttttttggagatggagtttcgctattgttgcccaggttggagtgcagtggcgccatcttgcctcactgcaacctccgcctcctcggttcaagcgattctcctgcctcagcctcccgagtagctgggattacaggcatgcaccaccgcgcccagctaattttgtattttaagtagagacggggtttctccatgttggtcagactggtctcgaactcctgacctcaggggatccgcccacctcggcctcccagagtgctggggttacaggtgtgagccaccgtgcccagcccgtcatatcccatttcatgtagccttatgcttttttgtgcctcactcaaaattggataacagaaatgaagagatttctttcttgtttggcctttcctgtaaatctcatttccagacttgcttcaaattagggtaaaggttaagtgaaatgggaaaacaagaggaaggcaggggacattaagctctgaggaggcggtccacttaaacggtttacatctctgacttgacgcctttgtctattgatcccattaccctgccatctccatttcttccccgagtgggtgtgtcctcctatgggcggcccctgcaatcccacgtggctaacaccctctccagcaggcggcgtgggcagtgtgtcttcaccagggcattggctctggggaacagcagctctcaccatgccctcccttttctccactatcagcagagggacttcctcgggccatctgctactgcattagtccgagtttaacgacccgtctgcacagtttccctcccaaagctgtctggttggtttctattgttcattgtgtgtgtctggctatctcatttcttttttttttcttttactttttttttcttttacatttcattctgttaatttgaccacaaatcccagatacttctcaccactagaactctttaatattttcctttccctatttttgtgttgtgcagttgtagtctagagacaagaaacaaagggaattgtcgtggaagaactaaagagtcaagattcatgggaacctttgactcactttcgtggcctggaacaagttacattttgtgcctcagtttccttttctgtaaaatgtttctgaaaatataaatcttaaattcttaggttctgtgagaatcactagaggtaatttatggaagaattctctgtaagggtaaactgttacacacctgctgttaattctgttgactttattagcagcagcagcagcagcagcatgataacattcgtaatcacagctgtgctttatagcaagcactttctacctgagtgtagaataggtagagagcatatcccctgagtctggctgtcaacatttcaagcatctttgctcctgggctgcctttggggaaatgcactgtggtcccttcaagttctgttctaggcagagcaggcatcccagtgtgtcagccactgatctaggcctctgcttatgagggacttctggctggagatggtcagtgcctcattcactcaaaagtgaatgagaccacagtctgggctgtgtattcatatgccgaggttctttgtgctttgtagtaagtggtatttcttcctgaagatgctggttgaaagtactcattcatcagagcctctttgaaaaaaccttgacaattctttttgtcaagcttttccaccagaaaatatcagggcgaactggcccttttctacacacctctgtgttctttggcagacgagcaactttgtggttgtgttagacaaaattatgtggttgtttttttttagtactgttcagtagagctagcaatgatatcaggagatacattactactgtcaagcacacagcatttatgcatgatgcctctttgtgcctgaaaaggcaaattctcctttcaagagttgtgactacctcctttggtttccaaacccccttcccttgagtcaacaacatggtctccgccagagcaaatggcagaatcaggtcagattagcatgcttgccaaagatttaggtaagaggcattatacaaatgtctaaattattgcagctcaggactctaagatttctaaaaaatactttcacacaattcattatcactggtatttgtgactatttgataagctccagagcctttttctgccatggaaaataaatcacttctaacagctaggttttctttttttctttttttcatttttaaacttgaacttttccccaaaacgccacatgtcatcaccatacttttctctgttgaatattgttttcctttcttctgccttaggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggtgatgcaaatcttgattctcctcagccagttgcccaaattgccaccagaatatgcagacttccattcctagtatggcagctagattcatatcgagaaaatatgccccagaagggctttgatgggaaacaggtggttgtgtattttaggtataatagaaaggtgtaaaaatgtgcatataaagtaagtcatttatcagatgtaacaggtctataatttctagttttttcccccagaaattccaagagctctgaacttgttcataaacatctttatatacttttttggttgatatgctagcagtgtccataccttagaaagtgtctaatcacatgtgtacaatgtttaatgtggagatcattgtaatgcagtcagctctctgtattctcttccataatctgcatataaataatgcagacctgagacttaactaatttaacatttgatttattaaacaagctgcttgctcatgttattaaataaatgggagtcttgttttttgaaatcttttattattttttataagttttttaaaatatcaagaatattttcacttacacatggagtctaagtgtatgatagctttaataataatattcctaacattatacatataaacataaaaatacctaaaacattattttctcttatatgaagaataattattaaatgctcataaaataattttagaaaaagctaagaagaaaaagttaatagtactgaaagtttagaaaaacatcagcaaatcacacattttgtcatatcaggatattctctaaggccaaattgtgtttgtgtaataaaataatatacaaaatttaaaaaactatttaaaaagctaatataaagtactagttttaataaagagttcagcgtaataattgaaaaatgaaagctttatcaagttaatcaagagttaatggtagtggggctcattgtagttaaaagcttcagctctggagtttcgaattgcttgggtttcaatcctagatttgctatttcctggctatgtaagtacatacataatttagtgcttggtattcatagatgacagatattgctgtctgttttatcccttaatgtgtccttggtttccgcatgtagtagatgcttgataaatattgagtgaatgaaaatgtcacatctgagacttacttcatctcagagagtaaacttgagtagtaaagttatatactctatcttactttattctattatcagctacgggcaaggagtagctataccttttatgctctcctttatataagctcgcagatgttaaataaatttaaattggccaattactggagactaaatataatgaacttattttcaacatttgtgtctgcttaagtgacagtgttccataaatatttaatgggctttacttatgtacctagttataacacccttatctgccacttcctgccctgagagaattggccccatctggtttaggatagttcttactctagagccctaggactccatggaacccgtttattggagagagttgaaaggatggactgcgaacgcctgagtcatcccttctgtgcatctgcatatcagatctcccttaagactttttaaacaaagatacctcaactaatagaagagtctagaaaaaactgctgtagcataacatacctgtgcagatagcaaaagttaaaaaagaaatgactatggttctaaaagagttagtagatgacagcagataggcgttatatattttggctcatcgagttggcacactttactatttgcattcccctttactgcaggtattttcattttaattctcacactctgggtagattggcgttattccatcagaagaaagtatgaaactctcatttgttgcccgccatcagaagtgccatgttaatgtagatcaccagggaattgatcaagaataagaactgggtcaaaaagcaatttctatgaggacgtttaaacaagatccatttttagtttccctaatatttacatgctttccatggggaatgagcaggcacttgactctcggctactgagcatctctgcggtacccatgaagattaaagagcattgtttcttataaagacagaagactaatgtacagtttatctttattaaattgaaaaaaattgcaactgtttgatcttcaaatctgtgtttcactgtgtcagagcatattttgtgtgctcatgtttttgctgtattctctggtggaacagcacttgccctccagtacaataaaaagtatccataacctagaaaaaggtctcagcactgttgatacattcaggcaaatcaattagttagatttgccaggaataccaaaatggttgcttgaacattatattgatatctcaaaaattgaagaagctacttaagaaaagtcaaaatatatagttgttgggatttttcccgcattacccagatgtacaagatatgtaaacagttttgatgaggaccttgtgaagaatacataatgagcccttgattgaatcaaaattgttttaaacagaaacatatttttcaaaggatgagcttgaggttcaattgtaattctatttgagcctagagacttggtattaaaaaatgggttatgacctgattttgtttttcctttccccaaaacatttccctccctgctgccagctcatcgtggcaaaagcagaatatgtttaaaaatccattatattttttattggctgggacactaatggagggctctgcgacggctctattttacaggctgaatactttaattaggctggttactgatcagttgttgggatatcgattgtgtcatttatcaaagagctggggaagcagaaaaaaattttttgttcttgttgttattgttaaatcaaagcacaaggctgagcaaagcaagccctagctctctttcctgctgcagctccagctttaatttaggactagcttacctcctataccaggctcagtttgactagcagttcagaagaaagggtaatacactgggtgtgggaaaagtgttacaagccttgacaaaaagctaaaggaccttcagcagctgaaaacattttaattattaagaatgcataaatggaatgttttagatattttgtgtgactagctcaacactgaatttttataaccaaagaggaaaatataaatccaatgctttgttttagccaaatgctatactcagaagagctctgggaatcagatgggtgctgctgtttgtggtacattcttctcacaaatggtcaagggaacagccatgagatggcttccaaatcatttacctccttaaaatctgttattgagacaaataatacgaacaagagcataccctaattctctttgctccaacctttttggaaaaaaaaatagttaagagttctctatcatcagcctcctccaataattccttcttcagcacctgtggaagatggatcgtaggggtgttactctggatacagcagttttcagaaaactgtgaatgtgtttacagactgtaaaaatcaaaataggaaggggaaatatagggggggaaccctcaggagaactgctgtctggcgtcacagcggtttgatttagctcctggccaaagacctagtatctgcacagagacacactggtggtatttcagaggcgaacctgcttgaattctgacttgtcctagagcatatgcacttaggcgcagagagagagaggaaccagctggttggcagagaaacacccttggcatgaactgtattcttgtgttgacactgccacaagctgtattccccagatggaagaaaatttgaaagaagccagttataagtgggaaaagagaataataaagttaatcctcttttgtgttggctatcagcactcctaatccttagcaccacagtgtcagtactttttattttagactcaaagatgttttcactgatagggccattttgagtttccacagttgaggacttaagtgtaatagactcttgaaagactattcatacagcgatcattctttcactttgcttcaactgaccaagttggaacatattaaaaatgcaaatgtaatttttacttttatctcttaggatcctgcagagtgtggggcattttccaagccatgctttgagaactgtcaaaatgctgtaaccacctctaggcgaaatgataatagtatcctgcatccacttggcacttgcagtccacaagacaaacagaaaggtaagagtctattcattttatccactgcaaatggagtgagaaaacacaaaagtgtctttttatctaaaaaaaaaaaaaaagagtaaaggggagttaattagactaagtgcagactttgttactcggagtcacaaacactgagagagttgggggagagctgactcagaacttgtgaatcagattcctggcaatgtctctagtttaagtgacactttctgtgcttgctgccccaaacatggagggttatatataaaacaaacgatcactggagaatcaaagatggcaaactgttatttttaagctcttctaatactggaagttaccaagtataaataaataactaccaaaatttaaaaatgtatggatttataatccataaaatggtcatagcgtgattcacagatgatcctcgattctaatatgagtatgataaatgggtgaatatcctaacctgaaaccatctcgtgatggttggaatgttcttgttattgtcttgctacactgttttgccttattatctaatgtggatcccatttctagctgactccagatgtaaaaaaatctgggttttcctctttgtcttttaaaaaatatacttcaggtcaccaagaaaattgttttatctccctgtatctcttttctttaataaaatgaattttttattacaaaaacaatacatattcattgcagaaaatttagagaaaagaaataaaaagaaaatttaattttacttatacttctatcaaagatcctaatcagtaacattttatgtatatctttcaggactttttaatgaaaatattttatacaaaaaatgaaataatgaaatgtatgtaatgtttaggaaatttctttttaaaattaatagcacattatatgcctcttagtcattgaatattcttctacaatatcacattcagtagttgcatagtgtcttttgaaggtaagtaccatatattatgtaatcagtccctatattttgaacacttaagtgttatcataatttaactatgtggaaagaagttccaagctgtgaaattactccatcataacatacttgtaaatctgaggtggctctagaattaaattatctcattagaatgggatgttgttttttccacagaattcctccattttagcaagagtagtagcaacagctgctatcatttattaagtgtttactgtctgttagatactgtgttgagcaatttgcctgcagactcaaagtggataatgttatcttcattttacaaatgaaggtctagaaagtcagtaaataatttactcacaaatgcatatttgatacatgcacagtctggattcaattcctgtctccctgtcctcagtttgtcttccaaaccacagcatgggtctgacttatattggtctattgaaactattggagtcctttcacctactgagaatgcccattagaagctgactttagaccgggcacagtggctcacgcctgtaatcccagcactttgggaggccgaggcaggcagatcacctaaggtcggaagttcgagaccagccagcccaacatggcaaaatcccatctgtactaaaaaaaaaaaaaaaaaaaaaaaaaaaaaaaaaaattagtctgatgtgatagcacatgcctgtaatcccagctactatggggggggaaaaaaaaaagaagaagctgactttacttagtatacagataaaaaaaaaatactcagtatgtcttttctcatcttaaagaaattatggtggcaggcacctgtagtcccagctactcgggaggctgaggcaggagaatggtgtaaacccaggaggcggagcttgcagtgagccaagatcgtgccactgtactctgggcgacagagcaaggagactctgtttcaaagaaaaaaaagaaattaaaaattttcttgacagaacaagattgccttctgaaatcttaaattgcagtagcaaaagagcctgggaaaggaatggcaagttttctgcaaaataaaacagtcttctttctaccttatgatcacgaatgtggacatttgtattaaaatatctagatttcatgtaacttgattggcatttaattctctagcaacgtgtggcccagtgtctgtctaagtctagagtttaattcctagttacaccagtgacatctaaatgaacactaagtaccttttgtttttaatgtctataaaatacagttatgtgccacataatgacattttggtcaacaacagaccacatatatcatggtggtcccataagattttaatggagctgaaaaattcctaatgctatactataatttttatcatcattttagagtacacttctacttattttttaaaaaaggtaactgtaaacagcctcaggcagttcctttaggaggtatccagaagaaggcattgttaccataggaaatgacagctctgtgcctgttactgcccctgaagaccttccagtgggataagatatgaagggggaagacagtaatattgatgatcctgaccctatctaggcctaggctaatgtgtgtttgtgtctcaggttttaccaaaaaagtttaaaaggttaaaagaaaaagtataatagaaaaagcttatagaataaagatataaagaaaaaatatgtttctacagctgtacaatgtgtttgtgttttaagctgttattaaaaagattcaaaaagttaaattaaaatttataaagtaacaaagttactgagattgaagaaagaaaatattttttagaaatgtagtgtagcctaagtgccttgtgtctgtaatgtctatagtagtgtacagtagtgttttaggccttcagatttactcatcctcactcactgactcacccagagcaactgccagtcctgcaagctccattcatggtaagtgtcctatgcaggtgtaccaatttttatcttttatactggattttcactgtagcttttctgtttacatacacaaataccattgtgttgtaattgcctgtagtattcagtaaatgctatacaggattgtagcctaggagcaataggctataccacagagcttaccagagtaagctaatccttctaggtttgagtaagtacactatgatgttgatgcaaggacaaaattgcctaacgaagcttttctcagaatatatcctccttaagtgacacaagatgtattttctgaagacattgagatacttaagtaaatggaataatatctctgcaaagaatagcaaaggctaaactaatgaaaccatagaagtagttaatgtgtaaggatacatccagaaaacaaaaaataagaaaatccactccaagtgcatgctaaaaaatacaatacaataatcatttggtttggaatttcaatagaatgttcagactttgtatatcttctgtacaaatagagtcctttgggcacaagtggcctcagacaaccactgggagattttgtctcttcttttcttcccaggacgtagatttagttagaacaatttttacatcagtgaaaaaaatatataaattaactatctacaagtttcctgtttctctttcttccaaagtgactccattaaacattattttttcaaaagtagagaaaatctattattatattttctttgtggatctgtgctaccatactagattataaaatttaggcctatcaaaacacagacttattacattttcattgttagaggccagtagatgaaattttcttactttttatgtaagtctattgatttagagaccaaaaaattatagcagaatatataaacatgatgctataaaagagtatcatggccatcacgtctttgtaatattaatggcattttatatttagggaactattgggagttcctgagtttcagatccatgtcaggtggtaacaggccactaaggcttataaaacctgaatgttgattgccactaccagtttttttaaggatcttctttagaaaaacaagattaacttgacaaaatgtaatgtctagtgaggagaggagctgttacagccaaaacattggcttttttttttttctttcctttttcctttcctttgtatatttaagaatccaatgttgatattctgtgttccatttatttttgtaataatagtacataccacccacagttcttggtttttattttttttattcctgtcaagctgttacacagaaaaaaggcatttttagaactaatgtttatagaaatcgtaataccagaaaattcacatttgtactgaagaattgctagcaatgccggtagtgaaataagtgtggtgcttcaagatggtaatagggatggaggctgtgtcccaggggcttcctataaaatcctgttaagcatttgaatggtaatgaaatgcaccaacactgtattttctgaggaatcttgctggcagatcttaccctgggccgaggaatagcctcatgcagtttgcctctggttagcattacctctcatttcactgcacttgtctcccctatatagctcttttcctgcttctcctttttcagctcaagtgcactcctgtcttaggcacccactgcccccaaatctgcccagcatcacccactgggttaggcctttcatctccatctcaaatcaaatgtggtggttctgtgacctgtctctctggatccgtattccctggggtcctctgagacacatcatagtagaattatttctaatgtgtatctttctggggaccagcatgtatctacccctctatagcatgtaaagcactacgtctggaatgactatccaagattgaattatacgtttcaatttggctaatgtttattggatacctccattgtgcagaatacactatcaggagtggtgaatgcagtagtattattgtccttaagaatagtctgaagcaggagtcaaaaaactttgtccttaaagtgcaagatagtaaatatttcaggttttggactgtaggtctctgtcatcactcaattctgccatcgtagagcagaagcactcatggacaatacataaacaaataggcatggctattcagtaaaactttatttgcaaaggcaggtggcaagctggttttggaccagggccatagcttgctgacctgttgtctaaagttacaatctcttttactcattcttttctgatgtggccttggtaggatagatcccacaacacaaataacaacaaaagatgataattaaaaagaagagccatttggccatcaatgaagtaatgactacagggagtgctgtgtcaacatttacaggcatagatatatacgaaatgaccatcaagaagactgtacctcgtacactcaatgaaatccagaaatattattataggagataagagttccagacttttacactgaaacaagggcttaacaaaggtgtctgggcccagaagaaaataaaaattccttacagcatctgaatatgttgtttaaaaaatgtaacaaggggccgggtgtggtggcttacgcctgtaatcccagcactttgggaggccaaggcaggcagatcacgaggtcaggagatcaagatcatcctggctaacacagtgaaatcccttctctacttaaaatacaaaaaattagctgggcttggtggcaggtgcctgtagtcccagctacgcgggaggctgaggcaggagaatggcttgaacccgggaggcggagtttgcagtgagccaagatcgcaccactgcactccagcctgggtgacagagtgagactctgtctcaaaaaaagaaaaaaaaaaaagtaacaaggatagagagtcaacaaataagatacttacctcaacaaacaaggtacttacctctacaccgatcaccactttaaaaaaaaacactgaaaaacacataaacacataaagaacgataaatggttcacatgagtgtaataaaaattaaatttaatgattgtaataaaactagctagagaagagactgtagaagacatggaaaaacgagaaagaggaacacgaggagaaagttatctacagtctagtaaaagaaatagacatagataaatagataatagcttgatagaacaataaatacatacatagttcattgcaaaagtggcatttgataaatgctatccaagaattactttacataatattaagtaatagataaacctaaagtgtcactggatagataaagacagtgaaagtctatttcctggtcctgtcactgcacaatgaggtttggcagctgtgctccatgcagtgattacaggacctaggctccttccactggtggctgggcacctcgtcacctggctttcaggtgatgtagatggggaaaggaagagagagtgaggaagctgcaccctctcataaccactgagactgggaatgacatttatcatagcagcccacattccatttgcaagaactagtctagggacaaagaggccctagcaatggtgtccagccgtatgcccaggaagagaggaagagcacggatagagtgggcactggtcttcttggccactgttataaaagtgacagatccttggcaacagcgaaggcttcatagtaaaagtgatatttgggtggaccttgggagaagggtaggattttgacaggtagagtaggttttgcagttacataagcaaagatactgaggcaggaacacccaggggtgttggcagggaatggtaagctaacgggtaatgggagataaagttgtttgccaggatcatagacctttattccgtaggcaatgtgtgcagctgaagtgattttgagcaacaagttacatgatcacaaatacgttcaccatcactgtggaagatggactgagaggttgaggatagaagatgagagccaacagaaaggaagttgtcccaggatgtccattgtccccaatttacattacagtccttctgttctgtttctcttagcaagtcttgaatgcctgactgctgccaccactaacaaatcaatgggcccctagggttggaggtggtgcaggggcacagtgcaggcgctgcctttgtgcttctttccccctggtcacctacttagcaggtctgcttcaagcttcatccccaggggcatgtcagctgtgctacaactacctccacatcagtctagtgcctggggcagagcttggagcaagtccttgccttgtgtatttctcagggttctgcagagaaacagaaccaagttgtgtgtgtgtgtgtgtgtgtgtgtgtgtgtgtgtgtgtgtgtgaacagatttatgataaggaattggctcacatggccatggagacaggcacatcccaggatctgcaggatgagtcagcaagctggggttgcagaagagttgatggtgcagattgagtctgaaggccggagaaccagaaaagctggtggcgtggtttcagtctgaagacaaacgggcttgagactcaggaagaactgatgtttccgtttgggtctgaagatagaaaaaagccaatgtcccatgtcaaagtcactcagtcggggaattctctcttattcaggagagaggcaatcttttttgttctattcatgccttcacgtgattagacaaggcccaccccattagaggggacagtctacttatttaaatgtgaatcttgtttaaaaacaccctcacagaaactcccagaataatatctaggtaccctgtggcccagtgagattgacatataaaattaaccatcatatccagcacgtggacaagccaaagcaggttttatcaccaacagcagttctcaagggtagagatatttgtcccttattctgtcattcagggacaaatcaggtacatatcttatcaaatatgtcactgtaatagatacaagtagaacttacaatctatggaataataatcctctgtttacttaacagtatgcatttacaaatcactgcttaaatataatttagtttggcccggcgcggtggctcacgcctgtaatcccagcactttgggaggcggagatgagtggatcatgaggtcaggagatcaagaccatcctggctaacacggtgaaaccccatctctactaaaaatacaaaaaattagccaggcgtggtggcgagcgcctgtagttccagctattcgggaggctgaggcaggagaatggcgtgaacccaggaggcagagcttgcagtgagccaagatcgtgccactgcactccagcctgggtggcagagcgagactccatctcaaaaataataataataataaatatatacacacacacacacatatatatatatataaataaaatttaattctcatattcctccagtaaaggtattcttgttgccacttgatggctttaaaaactgaggcttggagaagttgagtaatttgccaagttcacacagcagtagggttggaaacatggcagtcttgctccaaaaaccatgcactttaccacgatgttatataatgcttttcatacactagggaatatggttagtaattatgagcattcaatgaaataatatacaaggcttaatataatgtctgctgtataataagatctcaacaaccttacttgttagttgtggtgatattagagatacatgtctattcttatagtacagaacaaactggaaaagtatacatttttagtagatgggaaaaccaggatttagacccctgtcttttccttataaggccttaaactcagatgtctccattatggcacagatagaaaaaaagagcgcacgtttgtgtgtttgtgtgtgtgtgtgtgtgtgtttatctccactatgtctaaatggtggacagatatactatatcgtgattttttaaaagaagtttttgctactgaagcaaatgctttaatcaccatataatccagagtattcactatagagacttgtttacaaaaatattaaggcataaaacagatgactttgttaatcttccacaaatcacaggtaatgagtatgtgtcagccttttgttggtgggaaaaggtagtcaagatctgtggagtgggtttgctaggggttgcctgcaggtcaccagtgtaaaaacatattagcaggcttagatttcctcatacaagcagtattcattctcataaggatccttcagttctgtatgagaacttatttatttcagggctggtttatgtgttggctaaaactgcgtctgagagagatactgaaaccaaaccaggcatcgaatggttctgcttccactttatacagcttcatttgttctttgtttataggtctattgctgcccaatgacggatgggccgagagtgaagttccaccttctccaacaccacattctgctctgggattgggcctcgaagattacagccacaggtattgataaaatgatgtatcgtaaatgctccttgttattgtttttctgggagaacacagcaaccttattcagcaaacttattttaactctatttctttctggaatggaaatcttatagtatctataattcctttccagcgaaagcttcagtgaaagtttctcatagctaatagcttagattgggcatattttgcttcctggtatttgttaagattcaccttaaattattaaaatatttaagaaaatggttgaactttcatttacaaatttaaaaactagagccatggagctcaaagaaaagtgacatgggaaggtataaaacaaaactgagaaaataggaagcttatgggtttttattagtaattggcaaaccctagaggtattttaaaaatagatgttccaagaaagttaatggaatctaaaaattaaagcaacaccatatataatctaaaatattgaagagggtacccaatattatatccattctgtaatagaaactaaaaaaatcaataatttttagaatcacacaagaatgagagagatttactaagcatacatactatttgacaaggggaattcatagattttgttcttctgatgagttttaaaaatcattaaattgtccctttgctattttctatatttactatggctgttagaaactgtgtattttattccattctgtgtcccatgataatcctgtgaaatttcttcatttttcttgcagcaatgctagtgtcattcctattatgttttttaatacagtctgctaaaaataaagcagcatgccttagagtatagctaactgtattaggtggaagctcacctatatttagctatctctgattcttatacttttgaagtcagttatcttgctaactacagtttcgtgaactagattgataatcataataatattctagatcaatgtctctaggggtttcataaaagaaaatgtggacctatttaattttgtccattcatttccattgcctgcctcgattctgaattgaaaatgacaatttggtggcataaaaaaagccatttaaaacataatttcatttgttctaccttactgtttatcctgtatatatgtgcaaaatgtttgggatggtgcaaagctgaatcagatataaaccctgtcttcaggaagctggtaggctgacaggtaggctcatgggacgactggaacacaagggttccaagtgatatttaccagaaggtatagataaaatgctctgagcatctgaggcagaggagaatgcctccagataaaggaatcagggaaaatactatggtaaaagtgtcatttgagctgaaccctaactcatgaatagcaggtggacatgagatgagcccaggaagaaagggcatttcgggagggaagagcagcagaagaaacagcatagagacgggagagtaaattgaattgtacaaggtggagctgatcagccagatgataaagcccagagtgcaagaataaggtatgcagacttcatttggtagatagtcaatcttattgcagggttttcgcaggtaatacacagaatgaaacctgggttttttgtgtgtgtataacatggattgggtgaatggaagaggtttgatatcccctggaagccaggactctttggataccttttagggcaactgcagtcagaggtactgagcatctgtgcaggggaggctagagagaagcactcagatgagaaaccttcaagggagagaggtggttcagagatcacctgggatttagcaactgtctttttggcttcaaagtctccacggatttctttccttcccttttctgcaaagccattcctttgtgaattggggagagaaaaaagtttatattgctcctcgctgctgtaaatcttcattacatggtatgaactagtaacttccatcttcttttcacgtcttccttcctagtcccgtgtgttttaggcctctgttctcacttctttattagaactgctctcttaatcatcaacggtaatctcctttcagtcaaaagtatgacgttgtcttagacttcattcttcttttccactctgcagtatttggttattaagtcatttattcacttactcatccattcaaaagtatttctggagctctgagccagacactgtagaaagaactcaaatggattggaaagcatccctgcctgcaagaaatgcagcgtcctcttagagacagacacgcagataattaggatgcagccagctaagcattagatacaaaatgcaatgggagcctagaggaagaagccactaactttgcctggagttgtcaagtaagttttcacaggagagcagtgtttaagcagtttcttggaaaacggaagaaagctctctagacagagaagtggcgggaagggcaatttaggttaaggaaaccagggatgggaaagaatgcagagtgtgttcagtgtggctaaagcttgtggtatctcagggaagaatcaatgggaagggcattgtctgtcctgctccatgggtgccatgcttctccggagagcagtggagaagcattgaagcgctttgagcctggagatgacagtatcaggcagagcagtttcagtgatggagggtggagggaatggcagaagccgccatagacaaggaggctgctccgacttgggactagcaagagaagagcagggcctggatggagggatcagaagcatgggtggagaagaaagggcagagatattttaaaaatggaaggaacaagtcttaagccttgaaactctcccctcctaggatcgtgtgacctgcaccatcctgcaagctgctgcgttgcctaggtgaccagcagcagcaggggttggatgtgtgaaacttgggatggaggaaggactggaagggagccaggaggattgagcaagaaaggctctcctgccttctgcctttcaaaaaaaaaaaaaaaaaaaaggaaaagccctctcaaaggaaaaaagggtgttggagggatgaggctaatcttgtaaaagagaaaactgctatggcgtgaggaaagaaaaacaaatttgatcaaacttaatgcctgtacaaaatgaaatcaggaaattgctcaacctatttttactattatgcaatgattattacagaaaagtttataatatgtgggtctaagtaataaataaatataaaggaaataaacttactgtgagatctcaggcagagttgaagctaaatcagcagcagacagaatatatcgaatattattaacagtttagacaacattgggctattccccacatgttcatattctctttctctctctctctctgtctgtttcttcatgcacatacctgaaactactctcactcatagaagccaattgttgaagtccatctgtggacacctgagacttcagacatcatggtttttgtcttgcctctcaaaatcttcatcccccaccttttcacctcagacagttcttgaacattcattgttggctcttatacatcttttacattcctggtttgtcaccatagtcaaacactggcatatgtttcatgctacccttacttattcattaggcagcataatttgacgttgagtatcgtttctatttggtagattctctggtcgttcatgctgaaaacacggcctttatctaagacatgtctttggcctgctgtcaacttccagcttccaacagccttcactgcagcccactcagccatgagcacatgctaactcccttcaaaattaaaatgttgtatttcatagttaatcattgtgtcaccctcttaatgcaaacactcgagatatgtagcgtaaagttacaaaccgttttactagtctaacttacatgtctaaaatattttcacatgaactaactcaatacggcactcactcattattctggtgctctatatgcccacattggctctaatcctatgacttatattacactcacttgcctccttaatatccatcaatctgatatcagccttatttgccttatttccattttgtaccgcagcaaagggggggcccttttatgaaacgttttcaaagtgtacacttggtcacaatcaaaatgatggtaacatatatgtgtatgtatatagatagatatgtagatatctcattatgatcaatttaaaggacataatcagatgtgtacataagagcatttgttacattcatatgtacagtgcagccttttatttctttgatccttcttgattatatgccaacatttgtataaaagttcactttattagacagatcctagcttgatgttactgcatcgagtgtcattgccaccttactttttaaacggggattgggatcattgctacctaagagtctgggaaaatttgagctcttattcctaatttgtgaattaacacctggcttaagaggataaactaagacaatgagtcaggttcaccaacacattgttcagttgggtagattctcagtctgccttgagcagagcactttaaatgcaatctgatctatgttttaatgagggtcctacacctcctccctggaggctttcactgctttgattaaggatttagttttctattattgcatgatgtgcaccattctattgaaacaaaaagcaaacctaaaatgtaagccacatagtaaaaggtgagcaagtcttcactaaaagtgaaaggcttgatttttgcggattcgggatcagcaacaacctgtgtcccaggctggccaccatttcagccagatcttctggctctggtcccagctttgcccctggccagctgtgtgacctggcaatgccaactctcctctttgagcctcagggtcttatctgagagatgaggtgacctttaatcccttctggctcttaaactttttgattctatgaaggccatgagtctttctgacactaaacccacatcatcacaacagatcaaaggatggaaaacttaagtgcaaataaaggtcgaataacacatttaaaggcaagtgcttccaaacaccaagactcaggggaaagctcatgtttgcagtagtgtctcagaattcttctataaaatgggctgaaaaaatgaaagtattgctattaggccaggctagtgtcaataacactaagtgggtccaggatttttgttcacaattggcatattttgtcattactagataccatatctaatacactttatatatcaatggcttcgtgtattgagaatgtacccagacaccaggaaagaaatagaaaaaaaaaaaaaaaaggctacataaccctaaagagaggatttaaacttcttgagaaatttttatgaaaacatgtgaaatctcttcattggcaaatgccttaggccctcattcgaagaccatactaacctacagaaataaagaaaaggattcttaatagctcaggttgatcaagctcttactgtgtgctaggtacttttctcaatatataacgtaacttacgtatcttacaaaaattttaaagagtcataaattctattcttatccattttatggatgaggaaactgaggccactcaccctgacattttcctacaggggccactctcctaaccatcaaaccacatcacccttctaaatagaaagagaaaagggctcctagtcacagacttgctgagagtctgacaaaaacagagatgtcaaagaaactgtaaaaagcacaggtaatgggaaaaactcagaaatttatagtgttttgggaagcaaaagtaggacattttactgatctgcttatttgttaacttacctaatttatctgtttctatagcacatactctgtaccagaccctaatgtccttactttacaaatcttcactcattctattctctcaacaaccttgtgaggtagagagtgtaattttactcattttatacataaggaaattgaagcccagagaggtccagtaagtctcttagttgacactgctagtaagtaccggagccaggatttagagtgggccagacacaccacagtgctgtgctggttgatgggtacttcctttctgggggagggtggaggagatgaggtctacctttgtcacccaagctggagggaagaggtgcaatcttagctcactgcagcctcaaactcctagactcaagtgatcctccagcctcagactcccaagtaactgggactacaggtgcatgccaccacacctggctaaacaggtacttccttaatttacccacggcattataaaaagggaggttcatttattcatttggcaatactattattgctgcatactaattttaatattgcttgaaagcagtattgaatatggagggatgatgagtttcaagaaaagattaaacttattttggtatttcaggtcgagattctcttgtacattttagaaggattttctttcaaaacagttatttttgctattgttttgttgtttatagtatcaaactccaactgtttgaaaaacccaacatcaatactttagattttgtaaggatacatgatttggattttcactatatttgggattagaatagcaattataatgagatgagccaccatatttactttccaaacagatgagagtgccaaggtaagaaaatggctataatttagtttattaaaattatataaatttatttctaaaacaagaactaagtcattgtctgtaattctcttatgtaataccctctatcctcaagcaaaataaataaaatattcagcagaaggaaagttatttgagattgcctacaagtactaagaaaactataatgggcatttgatgtatcttgtgtcttaattgtcaactgtgctcttcctattatttccttttggcacttttggtgagcagactgtctgcttagtgttaacattagttttaggaaaaagacctaaataaagtagaaaaccaaactcctacaggcatcagtcattcaacaggatggttttctctaaaggatacaaccctttcacttgtgttttaaaataggcatagcttagtccacagaaatcccttaacctgcttttgggctctgctaatatccagtgacatcttttgaagtgctagtgttttccaggccctctttacccacttaaagttatatagtgtacagcaggatcccaattagcagaaatcagtgaagagtaaaacacgatattgcccagagaatattttatttaaattgtacagtgtgataaaatacatgaaaacagagttgctacatctcataaaagaaacctgagatttaagaattagttgaaaatatgtggttgggagctgcgcagagtgatgagtggctgtgttcaaaatgagaactgcttcctcattttttaaaagattttattctaaacctaaatacaacatatggcttccttccacagctctggggtggattcagcagtatattttccagatcagcacatcaacttcagatctgtgacaccggccaggcagcctgaatcaattaatttgaaagcctcgaagagcatggaccttggtaagcaagggtgaggtgacatccaggtcagctctccagcctcagcccatttatcttcccaaatgtcctggttttgtttcttcaactcaaacctcagggaacaaggtctgcagaagcctggaggaagggataatggccatcccaccttcctatctcttcgcacatttaattgtaattacccactttgtgaaacaaagagaagtgatttatttttacaaagtgatctataaactatcctcccatcatagatgacaaaaatgattccttctggaggatctgaattccagaggcatctttatctcatccatctgcctttgcatttgcaccctcgcttctgccagggcatttccactctgtgcgggcatacctgttgcagagcctgggaaaatcatgtggttcaaagcatcctttgccttagtgcttcacttccttctattcttctccatgtgtgatggatagagatggcatcagtgcagaagattcagctttttaaatgcccatccccaaatcctgtgacactggaggggaaaagggtctcttgggcgtgccacactgagggtgtcaaggtaccctgtgtccatgcctgaacaacctcactgaggttctgagcaccatggggaacttcgtggtgactgttgggtgccagggcagagcaagggcccctgttaactgtgttctgaaagccttgggacatctcagataccctagagcatcactgccctcccatgggctcttagagagaacaccattagagaaaagtatggatacaataaattctcagcaaaatatccattgcctcatgaatgcttggaggccaagctttgcaattgttttttctcaaggcatattatatatttctttagtaacaacgagaaaatagaataatcaaaagtgcgtgctccaccaaacgatctgataaatagtgcttttctgttactcacttacaggagttcagaaaaatgttcagtcatgatgaaacaagagaaattgattctattttgtataaattaactaaatgactgggatgcatttgctgtaatcgcctgtagtgagagacagatagaaaccttaacaaggaagctgtcttgagcactggtcagaaagagtattttctcaagcgtgaacctttgacaaaccaaaggaataatttgtgacagtgacataggttattactaattatttaaagagcagttcattttcatagagtgcttgataaacatttcctgttctgtcttcccaatttctctgtaaagaagatgaatggatcaaaactgctcttatttttgaggagagaaatatatttgttttcctcatttaattaaagcagccactattatgtttctaaaaagaaaaaacagcacccattttaaattaagagagaaaaaatattatgaaacctgtaaaaaataaaaccaaagacatgtgcagaatcaatatttttgtttacattttaattttattattattattatttttattttgagatggagtctcgctctgtcacccaggatggagtgcagtagtgcgatctcggctcactgcaacctccgccccctgggttcaagtgattctcctacctcagcctcgcaagtagcttggattacaggtgtctgccaccacgccaggctaattttttttttttttttttttgtatttttagtagagatggggtttctccatgttggccggggtgttctcgaactcctgacctcaagtgatccacccaccttggcctcccaaagtgctgggattacaggcgtgagccaccgcatccagccgttttgtttacatttttattaccaaaaactgttttttgagttttctcttctaaactgaaatagtcctagcaaaatatatgtagttagccgtcattctttgcatttttttatacatatgccataaatgacaacgataatagtaaggtttattcattttacaaaattggtcaggttacgagctattttcttcaggaccctagtaccaaactaaaagcattggctaaaatgcaccatgcagtggaaatactcaacagcatgctgtaaaaacaagtttagagtaatcatcaaactttgctcctttccaagaagtaccaggctaaagccaacagtctttcagaaggccctgagagtcagcattctagtaccattttgatcccttctccccagaacagtcaagtcagggagcctaacaaatgtgttagccttctcaatatgaaattcacttaggtgataccgcaatggtaaacatttgaaagtgtcttttctgtttcattagaggaatagactattcgttttccatttatagcactaggccaatgtaagagattaatttatttgctcaaaaagtaggtgactatgtttataggaataatcctagcaggatcttgattctttaaagcgttttaacattctttaaaacgtcttaataagtagcctatttaggatgaatacacaattcatgatgtctatttttgacctggaaaaccagcattttcatatggttcaaaatttaaaaaaaaaaccttctatttgttacataattaatttatattggctatttctcactttataaagtctgtaggaatcttcaaaggctgatggatcctatcagtagccttgtttttgtttcatatttgctactaagaccaaactagtattttaacttgcatgttaatgagtcattgttcatctgctcaagctattttaaaggtgagtggcttccatttacttattttcacttatattttcaaagacagacaattccaattaagaaaaaataaagcctccttattcccatcccttttacctattcatcagacacaaatatagtctaaaatgtgagtgctcctagaaagcactagttgcttccccatctatgtacatgtccacatcacatatcatttctttataatagttgcatagtgttacattcattaatcttcatttacagcttactttactcttccccttttaatggaatgtgggcttcattggcagttcttttgttgttgttttggtgggtttttgagtcgtttgtgtttaagattttgcaatttgtttatttatagcctttgccacgttaccatttgttaattttgtcctctttcatttataaaatattgttacatgggatgcaagtgatttttttgcaacccattatttgtctttttagtttgattgtgatatttctcatcataaaaaaggtttcagtcttattctcaaatattttcatcatttcttcttttgtgacatttgggttatatgtttatctcattttcctctggtacttttagaggctttaaaaatatttaggactctatcatatatttttatccatggggtatgagatggaagaattttctcacataaataagcaaattattaataacatgtattgacttctccgttctttccctattaatttgaaatttagtcacattgaatagtaaatttgcacacatagatgtgtgggtttctagacatactattctgttgatatattagtccatctcatgtcagcatcaccccatttaaattatcttgctattatgtcttgttttgattacttacaggataatcttcctttaatttttcttcctttgtgaaattactttggctcttcatatgtactcattctcctgcatggactgtacaatcagctaatcaaaatgagtttaaagatgaaacaggaatgcttccactgtggggggggggtgtgtgtgtgtgtgtgtgtgtgtgtgtgtgtgtgtgtgtgtgagagagagagagagagagcatgcacattaattataatgtttgctattggcttctgatggaaacatttgatcaagctacataagtttctttgcattcctaacttcctaaaagttttttgattaaatcatttattttttttaatcaagaatgaatgtttaattttagtaagtgattttaaggcccttactggctgataatgtggattttgttctttattctattagtgaaataaaagtgagttaattaatagattccccaatattaaatcttcgattctttttcaatgactctaaatttttctctttacttgcaaaaatgtttattgattaactacagatatgtatattaaacacttcttgagatggttaacacattatatgctctaaaatgtaggtgtacaactctgataacaattttactcagtgtcattaattcctatatatacattataagtataatgtatatgtagcccttttgaggctgctttgccttgggattttgtggatacttttactggcatgcatgtggtcacatttaaatcagaacagaaatgattaacatgataaataaaaggaaatttgtttttaaataattgcatgtagtcatgctaattcaaaggggttagggtgtcacttaagagactggagagtggatacttctgggttttggagaaaatcaatcttttcctactaattgtagacttttccctatttatttaaattaccagaattactgtgttcagtctggactcctttaatttgttcataattgagcttgtgtgggtgttgagttggaagctctcaggagctgaataacacagctgcctctttggcctttggcatagggttttcccccaaagagctgcccttgttggcagtatgccaggaagttacattcaaagactttttgatgaggcataaaaatctttaatttccaggcttggtgttttatgaccccataatactgtttgagaattagtctgaattattcaaaagatagcacttcagtttgttggccccctttgttgacctactctgtagccccattcagagttaagtttaaaatgctgtttctcacaagatactgtttttagagttttctatcctgtttcacattggcctcccacgcccatttcagaagggtgttctataacacagtttggagaaggctaagggcagtgcaaatggaagatgctggccagctgccctgttcagtaagaggaaatgagcttaaagtgatgcatgaggcattcagacgaaattttaggaagtttcctgacaatgaagattgttaacattccatgtctcatagtcttttaagaaagagcatgtgtcctgaaaaactctccctaaaatcaagacgataaataggttggctgacttcctttcaagattagtgattcaccagttttattttctgttagttacttgctctaatttttttaaattaggaaatgtttttagacacccacaattgaagtaatttataagccaactgagttctcacatctacaaaggtaaatatttgagatacattttgaatatgaaaccttttatatatgtcagatattcctcttagacagtacatttctagtatcagctcaaagatgagcatgaaaaaagccccattctactgctctaatactttctttttaagattatattcatatagtgaggtacttctatatgaattattgataataaagactgaatacataggataatttttataaaattgtatattctaataagtgtgatgctggtttgtattaatatataaaatatattttactatttttatttatatccatggatttcttttattgtccaccaataagtagtacctctgaatatagttaaaagctgaattggatattactgtttgggatacaactttgacttaaagaaaagaacctgttttgtaaagaaaaattaatggtaatattgtaagaaagtgtctatttgtataatagacaagtatacaaagatgaagtcagctatatactttaagctctagtaagtcaaaataaaggaattatagagaatgttctttcattaagtaaatgtttattaagtgcctactgtgtgccgggaagtgcattaaacactggagatgtggtaaataaatgaaagaaatggtgcttgctgcctgtacctagattagaaccccaacaggaaagaaaagctcaagagttaaggaaaaactaccaaaaggaaattctgacattatgataacttatctcagggaggaagaaagggaagaggcatctgaagacactcatgtggctgcctcaagaactcactgataacctcggctatgtagaaaagaggaagagagaagcaaatgattaaaatatatacatatatgtacatttttactgtgtgtgtatatacacatacacacacacacacatatatatacacacgcacacacgcacacacgtagtaaaaatctgaaataatatatgcaggaagaggtaaacagctgcatgagaggagacttgcaaaacctagtaaaagttagacagccaagctatttttaaagcatgaaaaagaaagtgtgcgaggtggcccattgttttaaacccctgctagatgtcaggtggaaagcaaagccactcagttcctgtgttagtattatcctcatacataggagagaatgatggtcaaaccaaaaaagcatggctgccaggcaatggaaaactagacaatttacatccctgtgcactaaaaggcttgtgattataaagtggccgtccctgatcatcagaaattatgaagagtaggcctcacactggaagacaaggaagcaaatgatcaattttcagaaagataatgaattccagaaacaactggtaatctcaatgctgatcatcagatttccatgtttgtgaaattaaaaaaaaaaaaatgtggtggtcaccagcaatctcaatggagtccttgaaataactggtgtctcctttcctttttgatgggatttctaaactgctaagtcaggaaaatgttttacatataggttatgttgatgtttataaaagtatttccatttgttttcttattgagacttatgggtcaaattacatacagaggtagacacagcattaaaatgtcccttcctgaaatgtgctaattaatgtctcattgtcaccttggagaaaattaaataacatataccataaaacgacatctttattgtgttctgataaaactcaacagaatttgatgaagattggatataggtaatttggcacatatctaacttaatatttgtatacttccctgtctgttatacaaagcaaacagacctctttcagtcttagttaatttttctttacaaaacaggattttttccttaaagtcaaagaagagtaaagaaggaaaaggcactcttcacaaattttcaagaaataccgtcttagagaattgggtgatagattgacagaattagcattcagatgatttctccagaattgaagaagatagaatttaataaagaatgatgcattcattcaacaaggatttattgacacttactgtatgccaggcaacatcccaggtaaataagacaaaggctgcagtcttacagtgttttcattctcgttatgtaaacagatggtaaagatgtatacagtgaataaataataaaatttcacatgatagagattcaaatagaaatgttttttcctaaagccaaattcaggtagagagaatgactgaggggacgtgaaggtattttagatgggatagtgaatgataaaggttatgtcctaaagtcaggttaaaaaagattaattgtataagtgtaggatttacgagagtggggatagtaactattgaagtaatcccctggttcttagctgcttgcctgacacggccatccccagagctagttctgtgttttcagatcaaaggagaaaacagctccactttattctggcctggtcataacacatttacagttccatattcaattatgggtacaatattttaataactacaaagacagtatagaatgcaatccagatattggtgagaggcctagaaaccatgtttagtaaaaaacagttgaaagaataaagatattatgcctgaaagagagatgatttgagtcataggagagctctcctcaaatattttcatgcaaatattgaaagactcacatatgtttaaaattaatcagtaccccagatacatcaagcaatgataatcacatcagaagatacatcacatttacaagttttgaaatcgaaaaggataacagtgatggaaaacggaattctggtttatggcatgtttggtatgaaaggaaaaatatataaattaaaacagctcctgaagactgaaaagagaagcagaactcaccaaaattatgagaaagagaccatcatatatttttcagtgtttgacaagggatacaggttctttttattttttgttagagtattttaatatgattatgtcattaaaacatattatagggccgggcacagtggcttacacctgtaatcccagccctttggggggccaaggcgggcagatcacctgaggtcgggagttcgagaccagcctgaccaacatggagaaaccctgtctctactaaaaatacaaaattagctgggcgtggtggcccatgcctgtaatcccagctacttgggaggctgaggcaggagaatcgcttgaacctgggaggtggagtttgcggtgagcggagatcacgccattgcactccagcctgggcaacgagagtgaaactccatctcaaaaaataaataaataaaacgtattataatgtatatagttatatgttttaactacataactgtattataatatgtacacagattataacactgtgtacatattacacagaatataattgtagtgagatgaatagatgaaaagttgaatttagagaacctacctgtcagaactcaggctgaattcttagacatctctagtggtaaaagacttcagatagtttccagcacctccatccacggcaggcctctttcaaaacattaagaaaaccaacatttggattaaccaaaatttaacatgtaattatattttagatgattgctacatttaaagtgaattatagactattagtagtagtaactgaaatgtagaaatatagatcactataatataacttgatcaatatttcagatgtagcggaataaggcagattctgtttaaaattcattaaaataaccatttgagttggaagcaaaggtgtaaaaatggttctctatgtcaaggacatgcttttcatatccctgtaagtctctatctatcctttcctcctgctgtatttttgcattccctaggaaacatactttcaagaagaatttgactttgtattcattcttactactattaattggaaaacaatatcttttgtgtaggaattgtacttttataatgcttcatatgtttctagacttgtctaaaagttgtggcaaatgccaggccatccctgtcatacccctcccatgactaaatgctcacaaatgccataaacttagctgcactcttttataagttattgaatgagtgaataagaggtacaactttctcaaatgcccccatctgaaacaggaaaacattcggagtaaggatcatccctcttacataaaaacacttaacctaatgcctagaacatccctaatgcctagggatttggtggtgtcattagtaatagtagcagtcatggagagggtagtgttggtagtataattagaaatgagcttctacatctcctacaagtttttcttataattagtagtggacttgaacagtcaatataagtaaattctcctaaagttaagtattatgaaatgctgggagaaaagttaacctgtggatttcataggtatatccttaagtcaataatggggccacaaatggtctcaaatgttgccaggcagtttttcactgagtgtattttctcaagctgggggcatgtttaatggaatatgtagttaatttaaaatgtcactgtctctaagagaaatgtaagactctatttccccagaagagatacaaaaaaactataaagtttagaaaaccttaaccaatgatattctgccagtaacaaacccacgcagatttttactaaattgacctctgtgtacttagaacattgtctgtgctctgattagaaattttggtcaatggaaaaactgccctattctttaaaatttaaatattctgggctcctcttaaaacttggattagaacatgaagtgctttcttctttttattttgtactgaggctctgtatctaggattctaagccttttttttttcactttttatttttttactatacttttactttttactttttatttttttactatacttttactttttactttttatttttttactatactatactgggatacatgtggagaacatgcaggtttgttaaataggcacacacgtgccatggtggtttgctcacccatcaacccatcatctacattaggtatttctcctaagactatccctcccctatgctcccaccccccaacaggccctggtgtgtgatgttcctctccctgtgtccatgtgttctcattgttcaactgccacttatgagtgagaacatgcggtatttagttttctgttcctgtgttagtttgctgagaatgatggtttccagcttcatccatgtccctgcaaagttcatgaactcatacttttttatggctgcatagtattccatggtgcatgtgtgccacattttcttaatccagtctatccttgatgggcatttggattggttccaagtctttgctattgtgaatagtgccgcaataaacatacgtgtacatgtctcttcagagtagcatgatttataatcctttgggtatatacccagtaatgggatggctgggtcaaatggtatttctggttctggatccttgaggaatcaccacactgtcttccacaatggctgaactaatttatactcccaccaacaatgtaaaagtattcctatttctccacatcttctccagcatctgttgtttcctgactttttaatgattgccattctaactggcatgagatggtatctcattgtggttttgatttgcatttgtctaatgatcagtgatgatgagcttttcttcatatgtttgttggctgcataaatgtcttcttttgagaagtgtctgttcatatccttcacccactttttgatggggttgttttttacttgtaaatttgtttaagttccttgtagattctggatattagccctttgtcagatggatagattgcaaaaatttgttcccattctgtaggttgcctgttcactctgatgatagtttcttttgctgtgcagaagctctttaatttaattagatcccatttgtcaattttggcttttgttgccattgcttttggtgttttagacatgaagtctttgcccatgcctgtgagctgaatggtattgcctaggtgttcttctagggtttttatggttttaggcattatttttaagtctttaatccatcttgagttaatttttgtaaaaaatataaggaaggagtccagtttcagttttctgcgtgtggctagcaattttcccaacaccatttattaaatagggaatcctttccccattgcttgtttttgtcaggtctgtcatagatcagatggttgtagatgtgtgatgttatttctgaggtctctattctgttccattggtctatatatctgttttggtaccagtaccatgctgtttttgttactgtagccttgtagtatagtttgaagtcaggtagcatgatgcccccagctttgttctttttgcttagggctgtcttggctatatgggctcctttttggttccatatgaaatttaaagtagcttttcctaattctgtgaagaaagtcaatggtagcttgatggggatagcattaaatctataaattactttgggcagtatggccattttcactatattgattcttcctatccctaagcatggaatgtttttccatttgtttgtttcccctcttatttccttgagcagtggtttgtagttctccttgaagaggtccttcacatcccttgtaagttggattcctaggtattttattccctttgtagcaattgtgaatgggagttcactcatgatttggctctctgtctgttactggtgtataggaatgcttgtgatttttgcacattgattttgtatctggagactttgctgaatttgcttatcagcttaaggggattttgggctgagacgatggggttttctaaatatacagtcatatcatctgcaaacagagataatttgacttcctgtcttcttagttcaataccctttatttttttctcttgcctgattgccctggccagaacttccaatactatgttaaataggagtggtgagagagggcatccttgtcttgtgccagttttcaaagggaatgcttccagcttatgcccattcagtgtgatattagctgtgggtttgtcataaatcgtttttattattttgagatacattccatcaatacctagtttattgagactttttagcctgaagcagtgttgaattttattaaaggccttttctgcatctgttgagataatcatgtggtttttgtcattggttccgtttatgtgaaggattacattaattgatttgcgtatgttgaaccagccttgcatcccagggatgaagccaacttgatcatggtggataagctttttgatgtgctgctggatttggtttgccagtattttattgaggatttttgcatcgatgttcttcagggatattggcctgaaattttcttctttggttgtgcctctgccaggctttggtatcaggatgatgctggcctcataacatgagttagggaggattccctctttttctattgtttggaatagtttcagaaggaatggtatcagctcctctttgtacctctggtagagttcggctgtgactttgtctggtcctgggcttttttttggttagtaggctattaattactgcctcaatttcataaagacagatatgaactttttcttatcacttgcttttgtttcctaaaccattgttcatatttaaatgaaattctgtgttcctttttttttttcttttttttttttattatactttaagttttagggtacatgtgcacattgtgcaggttagttacacatgtatacatgtgccctgctggtgcactgcacccaccaactcgtcatctagcattaggtatatctcccgatgctatccctcccccctcccccaaccccacaacagtccccagagtgtgatattccccttcctgtgtccatgtgatctcattgttcaagtcccacctatgagtgagaatatgtggtgtttggttttctgttcttgcgatagtttaccgagaatgatgatttccaatttcatccatgtccctacaaaggacatgaactcatcattttttatggctgcatagtattccatggtgtatatgtgccacattttcttaatccagtctatcattattggacatttggcttggttccaagtctttgctattgtgaataatgccgcaataaacatacgtgtgcatgtgtctttatagcagcatgctttatagtcctttgggtatatacccagtaatgggatggctgggtcaaatggtataataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcggcaccacaccacacctattccaaaattgaccacatacttggaagtaaagctctcctcagcaaatgtaaaagaacacaaattataacaaactatctctcagaccacagtgcaatcaaactagaactcaggattaagaatctcactcaaaaccgctcaactacatggaaactgaacaacctgctcctgaatgactactgggtatataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagcaataactaaaatcagagcagaactgaaggaaatagagacacaaaaaacccttcaaaaaattaatgaatccaagagctggttttttgaaaggatcaacaaaattgatagaccgctagcaagactaataaagaaaaaaagagagatgaatcaaatagatgcgataaaaaatgataaaggggatatcaccaccgatcccacagaaatacaaactaccatcagagaatactacaaacacctctacacaaataaactagaaaatctagaagaaatggatacattcctcgacacatacaatctcccaagactaaaccaggaagaagttgaatctctgaatagaccaataacaggagctgaaattgtggcgataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccgaagccaggcagagacacaaccaaaaaagagaattttagaccaatatccttgataaacattgatgcaaaaatcctcaataaaatactggcaaaacgaatccagcggcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggcattgatgggacgtatttcaaaataataagagctatctatgacagacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgatcgtatatctagaaaaccccattgtctcaggccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgggaaggacctcttcaaggagaactacaaaccactgctcaatgaaataaaagaggatacaaacaaatggaagaacattccatgctcatgggtaggaacaatcaatatcgtgaaaatggccatactgcccagggtaatttacagattcaatgccatccccatcaagctaccaaagcctttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagcggaaactggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacaaaattgacaaatgggatctaattaatctgtgttcctttttaaagaacttttgttttcatataagaacatcttcctaaaagtatgaagctaaggatgcttattcaaagaatggaacaaaatacttaagttctccttgcaaatatgaaccaaatccattttagttttttgaagtgagaatttcattagttgaaaatgttatatataatgtgcaattaaatatacaattaataattaaaatatacaattaaataattaaaaatatatgatataaatataggttaaatgaagtttagcagtttcataattatcccttctgaatattttgaatgataaaatttgttattggcaatactttatgaagtgattaaagacactgtaaggagagacaactatctgatttttagatgcagtagttgcagtttgttctttaaaaagcaaaatataaaaaaaaattagaatgaatgaataaggcctagtatttgatagtatgacagagtgactatagtcaataatgatttaattgtacattttaaaataactaaaggattactggattgtttgtaacgcaaaggataaatgtttaaggggatgataccccactttccatgatggattattatgcattgtatgcctaggtcagaacatctcatgtatcccataaatatatacacctactaagtacacacaaaaatacaaaataaaaaattatcttaagggataaaacagggccagtcatggtggctcatgcctataatctcagcactttgagaggctgcgttgggaggatcgtttcaccctgggagtttgagaccagcctcagcaacaaagcaagaccccatctctacaaaaaaaattttaaaaataaataaaattttttaaaaaataaaataaaaagaaaatcagctttagtcttacatatttttattctcttatatacctacctgtgttcttatattctaatttttctcaagtgattgtaccaaacatatttctttaaatttgtattaaaaacagtctaacctaaacattgttctctggatctttacttctacaacattatcttttagttgtaaagtttactctggaataaatgtagcgtgattcacttgactaatattatactctttgccataaaagttgtttccaattcttcacttctagaaacaggaatgcattgagcctgctagtacatcaacctttgtaaacaatcatgattatgttatcattataatttctatacgtgtactccccagccagatgatgtattaaagatatgaggcttttgattcatatgaccagttgccctgcagaaaagcagttttgctcgtatcagcagtatatggaagaatctgggtgtcatcatttttttttcatttttgccagtgttataggcttaaaaaggttattttattttacttttaaaatcacttctgtggttaaacctctcccagctgtttgactgtatgttttctattgtgaatgatctgagcatttcctttataaggctgaaaatttctaaagtaaatatcactttttggaattaaaatgttactctacattaaagatcaaatttcagcccttgctcacaggggaaaatagatactttgctttcatttaaatgttaccctctctgaagtacatgctaatgaatacatttgtgtctttcattaagtgttcagaaaaatgtttaactaaacatgaggcagaggcagaattcagatttatttatgataaaactgcttaatctgggtcaagtcaattaatctttctaaaaataatttatttttggtttttcatcagaaccccagaagccaatatacttgacatacagcagtgctggctgctttagagcatattagtacaaagactggcatcaccataaacacctactctgcttttataagactgaaaagtgcttgaaaatacaatttcagctccatgtgaatgtatgtatccatacatacaatagatgtatggatgcgaaagtcatccatacatctattccctccttccttcattcatcatttattgggtgcactgtctatgccaggtaatgttccaaatatttgagacatatcagtgacaacagacagtatcttatttctgtagcttacctttctttagtggaaatactctcatgaacaaagtttgagcgatgaggtaaataaacgataataacgcaataagtgaataaagttgctggaaagatatccagtaggacaaacataacactacaaattgtggaaagaggaaacatgactggaaaggctagtgtttcaatacccacttggtttctagtgttcataagaaaaggtaactagcaacactatccaatgaaggtataaaaattaaagtgaaaattaaaatagagatcaaattggaaactgactaatcaagactgatggttttaagtgggctgggaataagctaatctgtcctctgctgatccaggaactaactggcataatccccagtccccaaacgcttcagaattgtcttgaaagaattgtgagagcctgaaaaggtttcagcttggaattccttaaaagtaaaacaagggggtaccaatgaattggagaacatttagcatgttttcaaaatttggaataaattatcatagcacccaaattgaaggaaaaatgagttccattagaatttttttattttcagctttaataaataagtagatgtcaggtaaatgatctcagtgctttctctgtacccagaaaggccagagggaaatcttaggtgcccagtcctctcacttgaggctaatagtaccaccttatcaaagattgaagaatatatttgttaatataaacagtattcacaaaaatgtcagtgaaactaacagattggcggttttagtagtgactttaatgataaaagtctcggaaatgctgacaaagttaaacaggcttcttaaatacgggattgctcacaaccattagtgcatgttttgtacgtttccaggcttcaagaatcttcaggatgtaataaatgcagcatttcccaaactcatttgatcacagaaactttgagtacagactatctcataggtctcatcctttgaggaatgtccttagcaaagaagatgtgagtttgcttgtgagatttaaaggtgatgtgcaacagccagagtagggtgaggaaggattgccaacaagctgggacacgtggagcaatgctgtgaagtggggtgtaacctgagagagaatctccagggcagagaagtgtccacagccactaagcaagtaggaattaactgcagagcagcaagaatgaacagggctgtaatcaactaagcatacattaaccatggacggtgatgatagaatgtaactgacagcactgcaatatgcctccaaaagaatggcaaaagaatggtaaagataacctctgatgttactgattatctgtggccagaaacctttgactctcttttacatatggtaaaaagatcaagccctaatatttaagcttcagtgcctattaatctagaatatgaagattaaaaagaggaaaagcattagtagtaactgtaatcttcatagctgtatgtcaggcatagtttttttgcacagcaattccatcgccattttacagatggggcaatcagggcttaaagatgttgacttatataagatatctcagctagtaaatggtggggccaggatttgaactcaggcacatttaactttgatggttgggcttcagaccattatggctgtttcaaataaggcttgtcagtttcccagtcttaactcaaaaacagacgacctattctctctccactcttttttaaattctgtctttcattcaggacccattcaaatcttgccttctctaggggactgtcattttttttttccagctccttttctgaattcctaaagcagtaactattggttattcaacttcacaagtaattaagaaaattgagatactatatcttagcacagaatggcatactcctttgatattcttttgagtgagcattttttttcccattccaatcaggttataagcttctacaggtgatactgtatacttcttgggcacctcccttcaccacttagcatgtgtaggtgcccactaaatccaagatgaatgagtgaatgaatagtgttggagcaatctggctgcaatctcagaaaccccgtggaccacgatgattgatttggctcatcttactatctgggcaggttcccttttcctacatcaaaagattgaataaataaaagtagaaacaaatgattaaatgacaagtgaataaaagtgcaaattaatggtttgtttgagtaggaaaatagaatgaggataaaggtagcccagaacatagcaccatacgctcatattcacttacctggttttgtccacttaaaaggaaagtgtttgggaaaggctgataaaaatgaacgtatttaaggaaggaaccaaacacaggaaataaagaaggtcaaaggcttcaatttcattaaataaagaagaatgaaagcagttgtttaaaacttgaagaaaagggctgtgtgctttatttcctaattggaggaatctatgaataaattaggcaatcacttgacataattggtttaggtcatgtgaattcacttgcaccacaagagagggtaaattagatcaaattgtttgtggcccctcctagtcttctgttcattacaggcattcttttttccttttgtattcctctgtatcttccttttaggttttttgtttgttttttaatctcaagaagtatgtgtttttatttatattattttaatgtataagatgtttttccttttggttgcagaacagagtagaagataatattcctgtaataaaaaaatttgtgtgcttcttatttattaatcccattttgattttttcataaaactgtttgcacaaaaataacgtagtctgtacataaacacagtgccatgggaattatattcaaaacatgcttgaactgcttgcttttacctgaagcaacatgaaattgaattacattagtatagagcaatttggttgcatgtcacttgtggcaaatattgtgtaagctgaatatttagagattttgttcaccttgggtcacacagtattagttgtcacgaaaaataccccaaggtgataccaaaaaaaaaaaaaaatcctgactcaaagaagacaattgactcaaaataaattgagaatattccattccaaatggtttaaacacttggtacagacccaatgtagcttcataatttatgcaaatttttatctgcaaagcaatttttgtatttaggtttaatcaaagagcttaataatgcaagtacaatctatttactgtcacctcatatgctaagacaactgagaaacattaaaaggccctacgttcgcatgacccagtttgtacagtagccagcataacttcttgatgttgatggatatgtgagttaactctaaaatgggctaaattaactaacccattagatatctaaatgtgtatccctttaaaaaatagtacttacttaaagggcttatccgtgaccaagctataatttagagatgttgttatattgaaaatgtggtcacaaagtcatttaagggcaagaatttctaaaggcggctcagtctaattgtccaccccactgggaaaactgatgatatgcttcgtcattaatggattgggaatatcatatctgtaaaagaagttaatagccttaaattgttgtttaatatgttattaccatgcacttttctaggtgtgttttagaaggttcattttaaaaataaaatgctggtgtgtaagagaaatacttggagaagcttatttcaatgaaaagagaaaaatttgtttaagttggagaagatatttactatggataatatatgtaaaaccaagaagtgatcctaagagttcactttggattacattgttcttttttttttttaattcagcaacatcctgtaaagttacttgatttggaaatgccaacattcttaaaataggattaagagacactgctttaataatcgctccctattatccacatgttctttgtcattcaagagaataaaggaataattagaaaatacttgacaaaagattaacatccttaacatatgaagagctcttataaattatgggaaaacaaatatttcaattcggaattggaaaagtatatgacaattcacaaagggcaaaagaaatttatttgggacataaatatgaaatatattcaacctcacaagtaattaagaaaattgagatattatattggcaaacattggcaaatgctgaaatatatatgttccagtggtacagaacatgcttgttggccatttaaatgaatgctgctttctgtaaggcagagtggtaattatataggcaccttaacactattttcatcttctacccagtaattctatttctaaaaattatcctaccaaaaaaataaaagacttgaccaagatggaatataaaaattttccctatagttaattttccagcaataagagaattagtgaaattatataatattaatctaatctatataatacactattatgcaactaatagaaatcttcagaatgcttcatgaaataaaaaatgttaatggtaaaatgccagttaaaaaaagcagagtatacaattatagtagtgtgtatgtgtgtgtgtatgtatatatataatcatgtacgatgtagtaacatttcagtcaactgcagactgcatattagtcccatgagcttataacagtctatgtttactatatcttttctatgtttagatttgtttagaaacacagatacttaccattaggttgaaattgcctatagtattcactatagtaacgtgctctatgggttaacagcataggtaccataggctaggccatatagcctaggtgtgtagcaggctaaaccatcgaggtttgtggaagtacgtgttatgatgttcacacaatgatgaaactgcctagcaatgcatttctcagaacctatctcagtcatctagtgacgcatggcttataaatcaaagaagaaagtttggcaaaatgttaatattgactttctcttagtggaagttacgtgtataatttttactttattttttatatgtttctgtatatttcaaatctttaccacaaatatgtattacacatataataaaatcaattggcagtataaaactaattttaaaatagaataaaaaagcagaagcctgttcatggtaaaaagaaatgcagatatttaactacaaaaaggacaaaaggggtatgaagtatgtttaatgcttacttcgtatcattgaggacttatcacctggaaagacaaataagaatatttatggggcagaatgatgacatgtttgttaagaggttttaggtcaacacagaacagtactctttatcagttaaaatagcattagctacgagcacattccactgcaatgctcagggatccgtaccaaactgttgttgtaagcaggagttcatttgtcttatgtaatgtgaagcctgaataaggccaatccagggtctccgtgaaggtaccagaggcctaggctccttctcctcttcactctgccactcttgactttctggctctcgcacccatatttgtcactgtggagtgtacagatggcttctatgtcttcagcaatcacatccatgtttcaggcaaaaaaaaaaagtaacagaaggcaaaagggtacgccaacattcttccctaattcaggaaatccagtatcagctaagaagtgctgtccagcaaacttctactcttattcattggccaggactatcacatgtcacatactgtctagccagaaagtagctagggaaaacagggttgtaggtggcattggatcagtcaagctacatgtctgccatagccacccagtgtgtctgtaagtttctggtcactgcatgtgtgcagaagtgcacagacagcctcattagttaggcagaatttctgagttgctttagatcttagtcctgagagactattattttaattttgttttgacagaattgtagaataagtagaaaaatgataagagagcaatgtcctgattctctgtccactgccaaagtcaagcttggccaattatatttaagctggaacagaggataagaagtgagagttgcttgagagaatcatagtaccatcttcaaacagagaagctagtgaaggaacaagatgcaggaaggagacacccagagagaagaataaccagagaagctagtgaaggaacaagatgcaggaaggagacacccagagagaaaaatataacaacaaattactattttttcttaatgtctctaacctactggttttaaattttatatatatacacacatacatatatatatacacacatacatatacacatatatgtatgtgtgtatatatgtgtgtagataagtatatatgtatatatatgtgtgcatgtatatatgtgtgtatatatgtatatgtgtgtgtatatatgtgtgtatatgtgtgtgtgtgtgtgtgtgtgtgtatatatatatatatatatatatatatttttttttttatttttttgagatggtctctcgctctgtcacccaggctgcagtgcaatggtacaatggctcactgcaacctccacctcctgggttcaagcgattcttctgcctcaacctcctgagtagctgggattacagacgtgcttcacaatgctcagctaatttttgtatttttaatagaggtggggtttcaccatgttggtcaggctggtctcgaactcctgaccccatgatccacccaccttggcttctcaaagtgctaggattacaagacatgagccaccacgcccagcccaaattttctatttttatgtcctaaattgttgaagcaattcttctgatcgaaacaggcaagggttttatttttcttatgagtcactataggcacaaggcctagagcctataagctttacaaaaacctactgaagtatgtgagatatgaacaaaattattggctgtaatgtatgaacataaatccaagtgtgaaattaataaatgtttatccctgaaatggaagcttatgccaattttagtaattattacacttagaatttattattttaaaaaatatcaattgcaaaaaggttacacttttggtttttttacaactcaaaagaatttctaagtatgcagagagattgctaaaaaaatcagtcaatctataattaactcataggcaaataattgtaaatagattttgtaaatctctttcaaatttttacagcaaaaattttatttaatgtaggagggggatggggaggaagagagagtagcaggagagaacacactatgggtacagcccattgcttttaccttttccctccctttattatttgcctctgagatgtccaaagaaatctctggtcttaggaaaaaaagattttaaaaattactgcctgtggctgggcatggtggctcatggctgtaatccaagcactttgggaggctgaagtgggcagatcacctgaggtcaggaattcaagaccagcctgcccaacatggtgaaactccatctccactaaaaatacaaaaatcagctgggtgtggtggcacgtgcctgtaattccagctactcgggaggctgaagcaggagaattgcttgaatctgagaggcggaagttacggtgagctgagattgcaccactgcactacagcctgggggacaaagggagactctgtttaaaaaaaaaaaaaaatgctgcctgtgaggtcactctggactctgggtctagccactgtctgtttgtccagttaatgttttctattagctcaactttgttcgagattcttaatataactcaatactttccaaaaagctagcagatatttaatatgtatgtgtaatcgccttttctgcagaaaggagcgtgatttaagtgagctcatctaatagatcagtataaaataccagatgagttcactagagtgtgtgaagaactttgtgcatcccatttaagtgaatggttgtgtgctctgaaatgaagagacagcacataaacccccaaagttaataaactctaataaacaatgaatctggatgacaacttttcaaaatctattacacagtagtagccctggttttgcacagtttgcatattaaacagatgatagtagattctgggcagaaatatagacagtattatgtacttcaattcgtgccagaagagaaattttttgatagcacttattgtagccaagaacaaagcagctatacaatccccagccagaaaccaggtgccaaaattaattcatgcaagaataaaatgggttggcaccttatggtaaagtcataagctcttgaggaaatgcacaggaaagttctgggtagcttgagttactacgtctttatggttacttccattctgggctggctcattaactttgcaataagaaataccatggaatgatcagaaaatgttttcacccagccaggaaatctcacaaccacaggcaaaagtgccatgaagagagcagacatggttttcagtaatgtaagccctgcacatgatttggatatagcaggcttacttgtcacgtttgtaggagccacataacttggtaggttagcaaatcacactggatgacagaatcaggattcaaaaaggtctcaacagggagaactgttgagccgcaattcagaagattaaatttaatagggatgaatgtaaattcctgtatttgggttcaaaaaaggaagcaactgcttcctgccttactcccatccaatttattttccacgctgcagcctgggtgatcattttaaaacacaaatctgatcatgtcacttccttgctaaaaatcccttaacaacatcccattgccctgaggatgaagacagaactcattaatgtggtttttgagattctctatgactggccccttcctttctcttccgcctgttctctctccaggctccctctcacactgagcaccccagccaaatggaagatcttagggttcctcattttaggctgcttttaggttctcatgttttctttgcccgaaacacatcttcccaatttcctatacatttccagaaaagcccaatccatgggctactgttaggtgcctcattaccaactttcaaggttctctgaccagccttttatttaacaaatatgtattgagtgcctactacatttcagacatgttctaggctccagagataaaacagtgaacaaagtaaagctcatgtccacgtgaagcttatgttttcttggggaagatgccaggcagtaccaagtcttttgaagaaaaatggagaatgataagaagataatgatggacagtcagggttgggaggcctgctttacatagggtggcgatgggaggacctctctgataagatgacatttttggagataagatcaaaggaggtcagtgaactttgtggctatctgtgagaatagcaccacagtatggaaaagagcatgttccaaaaccttgaggaggggcatggtttgcgtgtcctaggacttgtggtgaggctggattgggtgaagtaccctgatccagggcagagctgtgcagatgatattggaggggctgctgcactcagcccaggcagggcttggaagctgtggaagcctttggattttcttctaaatgtggttggaagctaactgggaggctttaagcaaggggctattataataagatttttgttttggtttggttttagtttttaaataattacagtagctttgttgtggaaaatagaccatagggactaaatgcagagtcccacagattagtcaagagatgttacatctgtcaaggtgagagctggaggtagctttggccaggtaggtttgctagcacttactccactctttgtgattacttgtgtgttagaagccctgccagtgcagggctcaggactaccttgctccttttacaacctcagtgcctagcatggtgcccgatgtaccaccggctctccgtaaacattcatcggatggagatgatctggtttaacggcagttagtacgaaaaacgacttcaggatttttagctgactgcacacagttgatgagccagcagtagcccggttcagctgccaggaaagctaatgctgtcttaggtggcattaaaaactttggtgagggtgtcagtgaaagggagatgtgggtcctagggtgctccatgctgtttatgctacactggactgttggcctgatcctacactactttttcccttgtatcttctttctaataatggcatatttcaatcacgaggccacacactttggattcatctgtggttctttctgttgcttcattaccatgtacaaacaataaattctctatgatatcacctagcactgtctctctctctctgtctgtctgtctccgtctctgtcttatttttcccttttcccctgctctgacacaatgccaacagtagtccatgcctgtcttggtaaaagtttccaggtgcgtgagactctaaacaacttattataactcttatttctgagagtatcaacaattatttttaaaaacattatatgctggacacatagaggggaacaacacactctggggcctattggagggtggagggtaggaggagggagaggatcaggaaaaataactaatgggtactaggcttaatatttgggtgatgaaataatctgttcaacagacctctattacacaagtatacctaggtaacaaacctctacatgcgcctctgaacttaaaagttgaaaaaaaaatcccagtaattttctcatgaaaaatacccagaaagttaatgaactattagaccttccaatataaaaaaaaaaaaagaaacacatatgctgtttcatataggttggtatgaaattctactttagtagatagtgttaagtagtagaaatatgtagttctttatggcaaagtcattagcaaaatcttctcaaagtcacacagtagaaggaatttgtgctttgaagtcaggaacccttcagatccctgctgttccacgtacaaactttatgtcataacccttcttagcctaagttccctcctctgtgaaatgaagataataaaacccaactcaaagagtttttgtaaggattaaatgagataacacatattgaaatgcttaccatgatttctgacacatgctaaattggtaataagttttcatttccttcctatctgttaaaaaaggggtcactagacaatgtgaaaacatacattataaatagtggaaacagaggtgtgttttccatcagttaatagtgaataatggccgtttgccttaaggtagcctgtgccccttttattgatggtttaatgaatatcaatttcttgctgatagcagaaatatttgtcaaaggtctgagaatcatgaaagcttttacaatttgagtggtaaacatagtccatccctgacagattccagaaatgagcagagaatgaggtttcctaggagcaatcttgcacaaatagtcttttctctgtgtcaggtgggaaaaaaaaaagatggagcagagacttcatagtatcgttgtaaactgtaactgtttattttgtaaagatgagtaaaatgctatctttgccttcattgaggttgtccataaatcagtgtagtacagagtagaaagtggtacgtattcttggaggaaatgctaaagtgttctgaggcaggatcgggagcagagatggagagaatattctaggaagtacaggtcccagaaggagtaacagtgcagcatctaaacatgtgagatcagcggcattttcaacaagagataaacacaaatgagaaaaaaacaggaatcactctatgtgacttgaagatgaatagaggataatataatggaaaaggtaaaaagggtacaaatctgggatacaaagataaagagaatattattcataggcagtgaaatattagtgaaggtttggagtagcttagaaaaattatgaaagtgatgtttagcatggatgaatgttgatgtggtaaataagatgagtagtagagttacagagacagaggtgggtcaagagcaagttggaggcaattgcaaaaattcagccatggaataacaaaagccataggtccaggtatgagaattcttgaaaggaagacctgacggctgactggctgtgactgctgctcatgaagacagcatgtatgttgtcaggacaggagaataaccctgagcctagatatggtttcttttcagtctgcccactcagctgctttctttttatggtcctgtattcaaaaaaaccaaccaaccaaccaaccaaccaaataaaacttgcctgttctcagcaatgatttcataatatccttatgtaggaaagaagtaagtgatgagacctccaaaggatattgtcctcagccactgatcacattcttagcttagtgttcttccattatgtttccttttaattttgtagttatgtgataagtatatatttatggggtacatgagatgttttgatacaggtgtacaatgcatactaatcacatcagagtaaatggggtgtccatcacatcaagcatttatcctgtcattgtattacaaacaatccaattatactattttagtcattccggaggctgaggcaggagaaatggcatgaacccaggaggtggagcttacagtgagccaagatcacaccactgcactccagcctgggtgacagagtgagactccatctcaaaaaaaaaaaaagaaaataaatgggccaggcacggtggctcacacctgtaatcccagcactttgggaggctgaggcaggcggatcatgaggtcaggagattgagaccatcctggagaacatggttgaaaccccgtctctactaaaaatacaaaaaaattagccgggcatggtggcaggtgcctgtagtcccagctactcgggaggctgaggcaggagaatggtgtgagcccaggaggtggagcttgcagtgagcggagacagcaccactgcactccagcctgggccacagagcgagactccgtctcaaaaaaaaaaaaaaaaaagaaagaaagaaagaaaaagaaaaagaaaaaaaaagtacaataaattattgttgactgtagtcaccctgttatgctatcaaatactagatcttattctgactatatttttgtgcccattcatcattcccacttccccaccgccactccccagaagccccccgcccccaaccccccagcacacactagccttcccaacccctctggttatcatcattctattctctatctccatgacttcagttgttttaatttttagatcccacaaaaaaagtgagaacattcaaagtttgcctttctgtgcctggcttatttcatttaacataatgacctccagttccatccatttgttggaaaagatagaatctcattcttttttatggctgaatagtacctgatttttttttcttttctcataattttttattccatgggtcgaaagaaaaagaaagagataattatttttgccaacctggaactggccattcaagccaacatgcttgaaactttcttttatcttccataaccatatttttttcctattttttattatactttaagttctagggtacatgtagtacctgattatttatatgtacattttctttattcattcctctgttgatggacaattaggtagcttccaaatcttggctattgtgaatagtgctgcaataaacatgggagtgaagatatctctttgatatactgatttccttgcttttgggtatatacatagcagtaggattgctggatcatatgggagctctatattgagttttttaaggaacctccaaaccattttccataatagttgtactaatttacattcccaccaacagtgtttgagggttcccttttctccacatccttgccagcatttgttattgcctgtcttttggatgaaagccattttaactggggtgagatgacatctcactatagttttgacttgcatttctctgatgatcaatgatgttgagcaccttttactatacctgtttgccatttttatgtcttgagaaatatctgtgcagatattttgtccatttttaaaatcagatttttagatttttttcctctggagttgtttgagctctttatgtatactgtttaataatccattttcagatggtatattagtctgttctcactcacactgttttaaagaactacctgagactgggtaatttatgaagaaaagaagtttaattaactcatagttctgcaggctgtacaagaagcatgactgagtggcctcaagaaacttacaatcatggcagaaggcaaaggggaagcaagcacatctttacatgtcagaccaggataaagagagaaaaggggaaagtgccgcacacttttaaacaatcagatctcatgagagctcactaactatcatgagaacaaacagcaagggggaaatccacccccatgatcaaattacctcccaccaggtcctttccccaacatttggaattacaattaaacatgagatgtgggtggagacacagagacaaaccatatcagatgggtagtttgcaaatattttcacccattctgtggattgtctcttcactttgttcactgtttcttttgctgagaagcagctttttttgttttgttttatgagacgaattctcattctgtcacccaggctagagtgcaatggcacgatctcaagagtctcgttgtgtcacccaggccagagtgcagtggcacaatctctgctcactgcaagctccgcctcccgggttcacaccattctcctgcctcagcctcccgagtagctgggactacaggtgcctgccaccacgcccggctaattttttgtgtttttagtagagacgaggtttcatcgtgttagccaggatggtctcgatctcctgatcttgtgatccgcccgccttggcctcccaagttctgggatcacaggcatgagccaccacgcccggccaaaaaagctttttaatttgatgtgatcccatttgcccatgtttgcagttggttgcttgtacttgtggagtattactcaagaaatcgttgccgagtctaatgtcctggagcatttccctgatgttttcttgtagtagtttcatggtttggggttttatatgtaagtatttaatccatgtagatttgatttttttttatatggtgagagataagagtctagtttcattctcctgcatatgaatatccagttttcccagtaccgtttattgaagagactgttctttccccagtgtatgttcttggcttatttgtcaaaaataagttcattgtggatatatggatttctttctagtttctctgttctgtcccattaatctatgactctagttttatgccaggatcatgctgttctgattactttagctgtgtagtataatttgaagtcaggtaatgtgattcctctagttttgttcagtttgctcaggatggctttggctattctgggccttttgtgatatgacatagattttaggattgtctttttttctgtttctgtgaagaatagccaaagccattctttcttaattgatccactggtcattcaggagtgtattggttaatttccatgtgtttatatttagttttcaaaatttatgtctttactgatgtatagttttattacattgtagtcagagaatatactcgatataatttcagggttttttttttgcatattttaagacttgttttgtagtctaatgtgtggtctacccttcagaatgatctacgtgcttaggagaagaatgtgtattctgcagccattgtgggaaatgttctatgaacatctatttagtccatttggtctataatagtgagattaaatctgatgtttgttgatttttctgtctcgatgatctgtccaatgctgaaagtgaagtgttgaagtctccagccattattgtattgggatctctctgcctctttagctttagtaatatttgcttcatttatctgggtgttccagtgttggatgcatatacatttataattgctatatccttttgctgaattgagccctttatcattatatagtgaccttctttgtctcttttcataatttttgccctgaaatctattttgcctgatggaaatatacctactcctgctcttttttagtttccactgggatgggatatctttttttatctatttattttcaatctatgtctgtcttcttaggtgaagtgtatttcttataggcaacagattattgcatctttttttttaaatctattcagccactctgtgtctattgattagagaatgtagtccacttacaatcaattttgttattgataagtaaggtcttactcttgccattttgttatttgttttctggttgttttgtggtcttctcatccttctttcattccttcctatcttacttttagtgacagtgattttctctggtggtatgatttaatttctttctttttcttttttgtatatccgttgtatgtttttgatttgaggttaccatgaggcttccaaatactatcttataacccactattttaaactgatgacaacactgactgcataaagaaacaaactaataaacaggcaaaaagaagactaatgaaaattctgcactttaacttcatcctcctgctttttaacttttgattgtttctgtttatatcttattgtactgtgtatgtcttaaaaagttgttgtagttagtatttttgatcagtttatattttagtctttctgctcaaggtaagagtagtttacatggcacaattacaatgttttaatattctgtgtttttctatgtacttaacattactagtgagttttgtaccttcaaataatatctcattgttcatcaatgtccttttctttcagattgaagaactccctttagcatttcttgtaggacacatctggtgtagatgaaatccctcaggttttgtttgggaaaatctttatttctccttcacgtttgaaggatatttatgccagatatactattctagaataaaaagcgttctttttttccttcagcagtttaaatatatcctgtcactctctcatggcctgtagggtttccactgagaagtctgctgcaacacttactggagctccattgtttattatttgtttcttttctcttgctgcttttgggatcctttctgtatctttgacatttgaggatttgcttattacttgtcttgaggtagtcttatttggggtaaatttgcttggtgttctatatctttctcttggtttgggaaattatctgttacgatccctttgagtaaaaaaatttaccctttgggtaaatcccttttacccctgtctctctctctgcctcctctttaaggccaataactcttagatttgctcttttgaggctgttttctagatcttgtaggtgtgcttcattgtttttttattctttttattctctgactgtcttttcaaatagcctggcttcaagctcactgattctttcttttgcttgatcagttctgctgttaagagaatctcatgcattctacactatgtcaattacatttttcaactccagaatttctgtttgattctttttaattatttcagtctccttgttaaatttatctgataggagtctgaatgacttctctttgttaccttgaatttcactgagtttcctcaaaacagctattttgaattctgtatctgaaaggtcacttatgtctgtctctctgggtttgggtcacttgtgccttatttagttcgtttggtgaagtcatgttttcctggatggtcttgaggcttgtgattgtttatcattgtctcaacattgaagagttaggtatttattgtagtctttgcagtctgggcttgttgtacccatccttcttgggaaggttttaaatcggttcttggggtcatcaattccacgctttggctcttcaagggaattgagtgttgtgaccttaatcttcggcccctgcaaccataactgcattagggggcaccccaagcccagtaatgctgtgactcttacagacttgtagaggtgccatgttggtggtcttggataagatctgggagaattaattccctgaaattaccaggtagtgactctgctctcttcccttattttcccccaaacacataaagcctctctctgtgtgctgagccacctagaaccggtgtagggctgacacaagcaccctgtggccactacgactaccactggtactgtttggggtcagacctgaaggcagcacagcactgggtctctccctaggctcacagtaaccactgcctggctaccacctacatttgcttaggacactagagctccgcaataagcaggtggtaaagccacccaggcttgtgtccttcccttcaggacagcaaggtccccctggcctcgagtgagtccacagatgccgtccaggagccagggcctagagtcagaaaccttagatgtctacctggtgctccattttcttgagtctgagctggcaccaagccccacttttccctcttctttccacaagcagaggactctctccccacagccaccaccaccacgtccatggcaagtactgcctgtctaccactgatgctcattccaggtctaaggactcttcagtcagctcatggtgaatgctgccaggcctgggactctctcttcagggcagtgggctctcctctggcccagggcagatccagagatgctgtctaagagccaaagtgtggaattggtgatcccaagaacccgctttgtgctctataccactacggctgagctggtacctaaggtgcaagaccaagtccctctccttttctcaagcaggagaccctctccgtagccaccatagttgggaatgtgctgggccataccataagttagcatgtctctgagtctcacccaagacccatggcaagtactgcctggctactgctgctaattattcaggacccacattttctttagtcagcaagtgatgaatcctaccaggtctgggttctccccttcaaagctgcgagtttccttctggcagagtgtgtgtctggaaatgtcatccaggagctaaagcctagaatgggggccccaggactctgcccagtgccccctactgtggtagagctaggattcaagttgcaagatgaagtcctcttaactcttccctcttttctcctctagcagaaggcaggagtctctcctggagccgtgagctgcactgcctggggttgggggaggagtggtgcaagcactgcattagccgcccaacggctgtctcactaggttattaccccccaagtccacttactccaagcccagcacagcatcaagacttgcccagtaattgcagtccttagggcctagactacctttcaagtctgtttaggaccccagagcgctttagcctgcagtgccaaggcttggcagaactcaggttctgactgctgggatgggcaatttccctctggctagggctggtctgagtgctccctccatggactctggctgtgttctgcctggtgttgctttccaccatgacagggtggaaagcactgagttccagtgcaaagtctccaatcactatgctctccctccccaaggtgcacagattctgtctgtaccatgtgtcttcttcaggggagtggaggacgtgggagtggtggtgtcagcaaatcaagactgtctttcctatccccttcagtgcctttttcagtgatatgaagtaaaagtggttactgtgatcactcacctgatttttggttcttatgaaggggctttttcatgtgtctagtagttcaattcggtgtgcttgtggggaggattatcagtggaagcttctatttggctctcttactcctcattacgttttaagacttaagtggtcttagggccattggttgtatgatttagaaggctgtagttataagaataaagatgtttcatatgttaagtagattaactatttttttttttttttgagacaaggtctcactctgttgcccagtctggagtacagtggtgcaatcatggctcactgcagcctcgacctcctgggctcaagcagtcctcccaccttagcctcttgagtagctgggaccacaggcacataacaccatgcccaactaatttttgtattttttttttttttttgtagagatggggttttgccatgttgcccaggctggtgtcaaacttctggactcaagtgatccacctaccttggcctcccaaagtactggtattacagatgtgaaccactgcacccagccagattcactatttttaaacttatttctggaaaattaataccatactatgaagcttgatgtaaaattaatatcacagttttcagttattgagtctaagaaatggagctatgagtcagggaaagcaagggggttagagtgtacagagaaacataccagagaagagagatctgcatagcgtgaactccacgtatagttggagggttttccttaagtattgcacagagtattcatcagagcatgcatgtagggaactaccaaggctaggccaaaaggattcaagaagcagtacccagagcacactcaagagtgagaccaatgtttgttcccacccacaagattggagaaaatatctcataatccgtaggacattggataaggtatgcaagaggccattgcctctgttgtacagcacaatcagcatagagtaaatgctgctatagtcctgcctagcagatcataaaggcaagactcaagaggatcactctttccaagtaactatattccaatgacattttaaaaaattacaggaagggctaagcacagtggctcatgcctgtaattccaacatttggggaggcaaaggtgggaggattgcttgaggccgagagtttgagaccagcctgggcgatatagtgaaacccctacgcacacacacagagtgtaaatattagccaagcatagtggcacacactgtagtcctagctacttgggaggcttgaggccaggagttcaaggttgtagtaaactgtgattgtgccactgtactccaacttgggtagcagagccagatcttatctgtaaaaaagttttaaatacaaaaagtgtatttaaaattacaggaatatatatgacacaaaaaggtaaaatttctaatatctggaatccaataaaatattaatatgcatgtaaagaaataagacatataataaggaaaaaaattagttaaaaccagaactgacacagatgttagaattagcagacaaagacatttaaattattatagttgtatttaatacattcaaaagccaaaggaaaattgatcatattaagtatagctatggaagatataaaagaagacccaaatcaaatttctagaaaagaaaagtttaatatctgagatgtaaaatactctggatgagagtaacagcaaattagacattgcaggaaaccagacaagtgaatatgaatacacacagtagaaatatacaaactgaaaggaaaaagacacacagaattgaacagtgaattgtggggcaacttcaggtggtttcagatacatgtaattggattcaccaaatgagagaaaaacagggacagagaaaaaatatctgagaaaacaatggtcaacatgttttcgaatgtaatgaaatctggaaactcaaattcatgaatctcaaatgaacctctaagtacagacacaaaaaatgaggaaaccacaccaaggcacattataaacaatttgctgaaatcatggttaaagagaacatctaaaaaacaggacgacacatttcatacagagaaaaaaagaggaacagcagcagatttctcacaggaaaaatacaaaggtgtcatcgtgtaacagtatctttaaaatattgaaagaaaaatactattcaactagaattctttaactagcaaaaatatttttctaaaacaaagaattttccagaaatacaaaagttgaaagagtaaatcaccaacaggtacactatatgacatgttaaaggaaggctttctggtagaagaaaaatggtaccagataaaaatatggatctacataaatgaagataatcagaaattataattacttggatgaatgtgttttaaaattttccttatttaaatataaggttaattgtttaaacaaaaataatgacaatgtagaatggggtttttaagacatataaaaatatattatttttatatgacaataacagcacagaggctgtgaggggagacattgaaatacagatccctctctatttatgatggggttacgttccaataaacctatcattaagttgaaaatagtataagtaaaaaatgtgttgctaccaaacatcatagtttagcctagcctgccttacatgtgctcagaaaacttatattaccctacagttgggcaaaatcatctaacacaaagcctattttacaatatactgttgaaaatctaatgtaagttattagatactgtactgaaagtgacaacagaatggttatgtagttacttaaaatatgtttctacttaatgcatatgacattgcaaagccaaaaaatcatacactgaaccattttaagttgatgaactgtctgtaagtctatatactattgtaagatatacataataacaaaagaacactctaataataatacaaaaaatacccaaaagaggcagagtaggggaaagggaagaaagaacagataggacaacagcaagatggtatgttcaagatcaaccataacaatagtcacattaaatatatatgttagaccataaaaggcagaaatggtcaattggataaaaaaggcaagtcatggccagacatggtggctcatgcctgtaatcccagcactttgggaggctgaggcaggaggatcacttgagcccaggagttcaaggctacagtgagctgtgatcatggcattgctctccaatatgggcgccacagcaagtcccactttagagacacaagtaacttaaaagtaaaaggaaggaaaaagacataccctgctaacattaatgaagagactactagaatggtcacattgatatcagagaaagtagatttcagaaaaatattaccagaaatagagtcctttcatagctttaatggaaccaaatcatcaaaacaatgtaattattctaaatgcttatgcacctaataatagtgcttcaaaaaataagagaaaaatacatcaaacaacaggaaaaataggcaaatccaaagttatagtcaaagattttgacactatgtctcaataattaatagaacaagtataccaaaaaatcaataaggctatagaagatttgaacaatattatcaactatcttgacctaattaacgtttatagaacactctgcacaacaactgaatacacattttttttcaagagcacatagaacatttaacaggacataccgcattctggactattaaaaagtcttaaaagttttgaaagaattcaagtcatacaacatatattctgtcagcatagtaaaattaaattagaattcaatagcagaaagaaatctggaaaatctgcaaatacttggaaaataaattatatacttcttaataacacatggatcaaagaaggaagccagagagaaattagaaagtatttgaactacatgaaaataaaaacacttcctataaaaatgtgtgggataagaaaaattgtgagatgtcactaagaggataatttataacactgaacttagaaaaggaagaaagatttcaaataaatgacctcagctttcacttaaaaaaatggtaagagaggctgtgtgaaatggctcacacctgtaatcacagcaatttgggaggctgaggtgggcagatcatttgagcgtaggagtttgagaccagcctgggcaacatgactagaccccatctatactgaaaatacaaaaagttagtcgggcatggtggcatttgcctgtagtcctagctactcgggaggctgacgtgggagaatcacctgagcctgggaagtcgacgctgcagtgagctgagatcacaccactgcactccagcctggacaatgagaatgagaacctgtctaaaaagaaaacagaaaaagtagagtacagtagtctccaccccccttgtctacaggggatatgccccaggacccccagtggatgcctgaaactgagtatagttctgaaccccatagtgctgtagaggatagtactatacaccacaatggatctgataaccaaaatgcttactaagtgactaatacacaggtacatatacagtgcggctactgtgcacaaaggggatgattaatggtttgagtgcaatgaagcaagatggcacaagatttcatcacactactcagaacagtacacaatttaaaaagtgtgaattgtttatttcttgaattttccatttaatattttagactatgattgaccataggtaactgaaaccaaagacagcagaaccatggataaggggaggctttactgtaaattcaatccaaattaagcataagagaaataaaaattagagcagaaatcaatgcgttagaaaaaatttggtaaagtcatagaaaccaaatgccagttttcttataaagtcaataaaccattaaccagactgattagtataatataaaacaagacgtgtgaacattattaggtttgagagaggggacatcagtacagatttcacagatattcaaaggatgttaaggcaatattatgcacaataaatttgacaactaaaatgtaatggacaaagattttgaaagattcaaatgatcatattcatgcaagaagaaataaatagtgtggaaaccttgtagatattaaagaaactgaattatagctaaatactttctcacacaggaaactccaggtacaaatgacttcactggcaaatttgacttgtttcataaaaagaaataataacaattctacagacattcttccagataaataaagaggagtgaatatttccccaactcattctatgaagccaacattactctgataccaaaatcagacaaggacattagaaaaaaaaatttagattgatatccttcttgaattgatgtaaaaatttggcacacacacagatgaaagactgtgtgaagacacagggagaagacagccatctacgagccaaggagagatgccccaggagaaatcagcactgctcacaggttgatcttggacttctatcctccagaaatgtgagaaaataaatttgtccaagccaccctcaaaaataaaaactaataaaaatttagtgaattgaacccaacaatatataaaaaagataatatatcatgaccaagaagattttatcccaggaatacaatgtgactttaacatttgaaattgatcaatggacacatattaacagactaaaacagaaaaagcataaccatatgatcatatggtggacacatcacgttactgacatcactgatcagtcgcagtgacatcagtcacatcagtggacacagaaaaaatacttgatagaatctaatgtcatttaatgaaagttttatacacatttaaagagtactatttggggacaaatttgtcgtataaagaagtgcaagagaattataaagtacaacattcaggattgtggttacctctgagcaaagagggaaaggaatggcactgggttgaaacacccatagtgcttcaaagataaaataatatttttcttcaacacagtggttgatacacagtgtttgcttaaaccctttgtttgtttgtttgtttgtttgtttttgagacagagttttgcccttgtcgtccaggctagggtgcaatgacgcgatcactgctcattgcaacctccgcctcccaggttcaagcaattctcctgccttagcctcccaagtagctgggattacaggcctgtaccaccacgccaggctaatttttttatattttcagtagagacggggtttcaccatgttgaccaggctagtcttgaatgcctgacctcagatgatccacccgactcggcctcccaaagtgtaggtgggagccaccacactcagccagttgttatcctttataccttacacatattggtattttttcatgctttaatatttagtaaaagcaatttttaaagctagtatttctgttcttggcctttttctgaaattatcataccagaaagacatttatttcctgtatttacagctttggaaactcataacatttgcaggttgaaagaagagctgtttgtatgaagtattcagttttttttagaaatatagtgtgatttttctataaacagagggaactggtatttcaagtatactacgtgaagaacaagagtgtgattagagccaacaagccaaaaaatagagaggaatcactaccctagtggtcagttatatataaccgagagaaagacagcaaagtgagactagcctgctaatcatatatttttctacatttctaaagttcattactcaaaatacaagtgaattatatttattccaaacagttctgttacgttttggtctttatttagacctgtcccagaattggaccccaattaccttctcctacccttccttgctaggaacttgtctgaaaattctgccacaagaattttacagtgtttaaatacatttacactacaccattcctataattatatatatctcacaatgaacagttgtctcattcatgagtctagaatcctttgctgaatggacatgcccaaatttggtgtcatttatttattcttacacatgccgcattcactcagcagacattaatgagtacctgagcggtgctagacgtggtactaggctaaaatggaaaaacaagacaaatgccctgctgaaggtgtttaatgtgaaacagacccgtgcacaaataattgagatatttgcaattcagaagaaatagtatgtgttacttagattttgtacctaagtacaaagttgcatggcctacttaaaaaccttcttctatagccaggtgcagtggcaccggctgtcattccatctacttgggttgctgaggcaggaggatcacttgagtgcaggaatttgagtccagccagggcaacatagcaagatccctgtctctaaatttttttaataaataaaaatgtttaaatttgtataatgtaaaaatgtttaatgttgtgtagtaaggtaaaattctatttaaaaacaataataaaaaatatttctgggctgggtgcggtggcttacgcctgtaatcccagcactttgggaggctgaggcgggtgtatcacctgaggtcaggagttcgagaccagcttgaccaacatggtgaaaccccgtctttactaaaaatacaaaaattagctgggcctggtggcaggcgcttgtaatcccagatacttgggaggctgaggcaggagaatcacttaaacccaggaggcagaggttgcagtgagccaagatcgcaccattgcactacagcctgggcaacaaaagctaaaaaactccgtttcaaaaaaaaaaaaaaatatatatatatatatatatatatatatgtatgtgtgtatatatatatatatatatatatgtatgtgtatatatatatatgtatgtgcatatatatatatatatatctgatgtgctagagtacagaaaagctggcaaaagtggtgagatgtgaaaggctatcataatctatttgtgaacacctacttctgttaggtttcatgataaatttttacatcaagttgtctcatcctatgaggccttatctacattttacaaataagttcagtaagcttgaaaaaagactcagtaattaaatcatactcacagatgtaattagcatcagaatccagggccttttaaggtcaaagcttgggatcttcctttttattttcatgctactcccttccccaggagtaaaggtgttctaggtgctaaaaggcatttttgctcctcccagatcaattgatgcaaataattattcacctaaaacctttattgtctttatgaaccttcatgtctgtctgaccttccactcttcctgaagcatatctttttcttaatgaaactatttaacatattttattctaacaaatatgtcatttgtatctcctcattagaccatggggttgagtatctgattcttttaagaaaaacagtgtgtactgaatggattaaaacaaattaacaaatttatgaaggaattacttggattttccaatattctttaatgagctaaagatgacagtgtaagaacatatgaaaagtattggattttcgcaactttcaatttaagactttctaaggttcatagagaaagaaaaggaattttaaagagatcactgaagagttgtgaacatatggatagttggataacgatgaagggaataagccctccttttttaccctatgtcaccatggctgagagatgcattatgatattggaaaaaaatttcagctgctgagttctgattagctcactctcagagctgcagcacattcgagatggaacacagtgcttttgggaaagcttgctaagataaatgagataaatgtttgcaccattatactaattccctagcccccttttcagcaaaagccttgttttgtgtgtgtgggtgtgggtgtgtgtttgtgtgtgtgtgtgtttcaatagatggaagaattttttaacacatgaaaactcacattgctgaaaactcaaaaagtcttcctaagcagaatcattatgccaaattgtcattgacatacgaaaacactatagattaatgcagtaatagttcatggttgctcaggaagaaacttaatttacaatttgaaacaggtttgcattccttagaaattctggaaatcaatcagtggcacagaaattgatctgctaaaggagaggaaaattgatttttaatattggcaactacatcaatttttttaagttctgaaggaacaactcttgaaaacaaatttattaactgttaagggattacttgatatttagtttcctagcaaactatccaaagagaagtatttatggcctcattagaagatgtatttttattgtgccaaacatcaacttcaaaattgcagtctctattatttcaaagatatggaaatcaaaaattaaatgaaatggagttatctatataagactaccattgcatcatattttagagtggtactttgcctcaaagtatctcaatatgaatagtgagaatctgaacacatttgcatattccccattcgtgatatagtgttggcattctaaaaaagaataactgtagctgatggcaatttttatctgaagagacttgtgcatgatagcaatatacaatcttctgtcagcataagaagagcatctggggcccattaactcaccaaatctgccactgttctgcaaatttttattaagcaagtgtagtccctaatagtcacttatgttatagaatgcgtatcaaatgctatcaataagcaaggggattgttttcccccagtgagaatgcatttgaagtgtataagaaagcttgacaaaagaataaaacactttaagtgatcactatattaatataaatgtatcctactgggaagccaatgtgtgtaagtattatgtgcactttgatgtttgccactaactagttctcagagtgccatctttttcatagattttttcccctgtattttctttctctcaattctaatgatgaactggttgaaattaagtgaaaagacacagactgtttatttatgctttttaaaaagatgccattgatgctgggcagttctaattagcttcaaaggcttacaaccatgagaattagaaacataggccatcaggctgctgtttctcaaacaagtcttcctgaatcagagaacacaccaggaaattaacaagcatccaagccaaagagtgtcctctttattaagcaccttatgataattaggtaaaataatgtacatcaatcttgaattgaatatgaggaagcatgaggttagtctagaaatcctattatctaaataaatcggaagaaagatcaagaggaggcagtccatggtactctctaagtatgtaataatggttataataaaataacagttataaaaatatttatgaattgcagcttcagaaacctgagcatttcattggtatctcttcaattattgtaatatccatttacgataatcaagagcaagtagtaccagtccttgggtaaaactgaaggataagaaagggaatgaaataacctttaaatacaaatacttttttaaaaaagaaagaagaaagaaaaggagaaaaaattctgtcatcagaacgagaacaagaaacttagactcttgctccatcaacactctcttactcaatgcttttaattaatactttactgttttggaatcaaagacctttcccacaccaggcccatttatttttcaatctcttgtaaataagtcctttgtttaaaatgacacacctgtcacatttcatatcactaccattccaatcactgtgctaaatattatgcagtgaaactactagacgtaagcttaagccccaagagataattttaatagtagctctaagttaatgtgagttataaaggaagttggtattaattataacacttgccatttaaaaaaaaacttggtggcatgtgtaattttacctcattttctcatttgctactgttatttaaattacttcccagcactaagcatgtgtataaaagatgattgttccaaatttaaccttttaaataaaatgtattctatcaattaagtcattatagttccctctcttttccattatgtttattcatttatcttctgtcctaaagatagacatctgtgtcagtgaatatttcagagaaaggcctctaatttttatgcctatcacccatttggattttctacaatgtttttcaaatagtttatattagtgtttgatataatttcaaattgtcaattaaaataatgataagtataagaaataataaatattattcagccaaaaagttaagaagataatttgttaagcctaatatggccagggaatttgcaagtacttaaatcagcttagattttttaaaaaagataaaaacaaagcagcaaaagccttacctttgtatgaatcccttcttctgaatgactatacataataaaaccgtacagtctagtgtactttcattgcctttcttccactgcaggatgatttaggagccaggtaaattgctaggtcgtatcttttgtggttgtggaatgatccatacaataacaatgtaaaagtacctagtgcccggctgaagcatagtatgttctcaattattttctctctttagttctttataatcctgagcaaattaaatcacgtaccccacaaccgtcatcaaatacaccacctttaccactctcacaacttccatttatcaaatgttttcatttattgagaattatgtgtctggaactgtgcaaagtgcttttgtacattttttttcatttagttccaactctctgtgtactgttttttcccccatttctcatatggagaaactaaagctaaaaagaacttagtggccgggcgcagtggttcacgcctgtaatcccagcgctttgggaggccaaagcaggcggatcacctgaggtcaggagttcgagaccagcctgaccaacatggagaaaccccgtctctactaaaaatacaaaattagcagggcatggtggcacatgcctgtaatcccagctactcaggaggctgaggcagaagaattggttgaactcgggaagtggaggttgcagtgagacgagatcgtgccattgcactttagcctgggcaacaagagcgaaactccgtctcaaaaaaaaaaaaggagcttagtaacttgcctggtaatgctggcattcaacccacatctgtctgattactagctatgatgttagtctctctttctattttgtttctcattaatgatgatgacagtagttcatatttattaagtacttattctgttgtcttctaagtaccttgcatatatttgcacatgtaatcatcaccacaaacctgtggggtaagcaatatcctcttatgatgagactgaggccacagaaagttaaaatgatttgcacaaaactgttgtttccaaacaaggattccaattcagaaagattatttctcatctgtagaatgagaatggatattttagcttgaacccatcagaatcatcaatttcaaaacatgttaaacaaaattatagctaacatttagtaagcttggtcaccacagaaagataactattaatagcatatattcaaataaagagagtagttttccagcatatagttagttgcgttgtcttatattccaggtttctcaggtaatgactcttctgtgactcttatcacaagtgtaatggagtggttaagagtgccatatttaagttcaggcttctccatttatgaggtgtatgtcagtttctttatctgtaatataaggatagtaataataatactttccaggtcgttgtgagaatcgaatgaatgaatagatacaaagtgcatagcataaaacctgtgtattacaagtactcagaaaatatgagttcctatggttatttttaatcattatcattgttttctaatgcttttctacttacagtgtagattgattctatgtaagtgctttttaggcctgagaaaaacagaatttggctcacaactggtgccttataaatacttacctcccaactagaaataaaacaaaaagtctaacaatatttttaagcagttgggaacagaataatcacagatatgtagtgcttttatctagaaaataaagaaatagcttagaaaaggagggctaggtgggagtgggaagattatgtatagtaactgggtcaattaagactgaatgttgtgggcagagaaaaaaagggacatgttactctgagatcaatctagtgttaggcgaaatggaagagattcttcttgttagcaaatttcccctcgccttgcttcaacccttgagaccacagttttgtgtactaacatagacagtggcacatggtaataaacagcttttgttgaatattaaagtgatgatctatgcagagatgcttaaggattaagaactttgcatctgtgttcatgaaggatgtgggttagcagttttcatatcatgtatttttctgatattagttagtatctgggtaacactagcctcatagagtggcttgggaaatcctctctctttctaatacattttctgtagaattggtcttatttatttcttaaatgtttggtagaattcaccagtgaagccatctgggcctagagttttgtttgtgggaaagttttacttataaacacattttttttttcaaaaaactactatagggcgacccatgttatctaattcttcctatatgagcttcagtaattgtgtcttttaaaaacgaatccgtttcatcagagctccattaatctagagttagtttttccccgctgttgaggcaagacccttcttcacattcaaatggatgcccttcagttatgaagttttctactctggctgttggaaataggcactattcccagccctgtgtgaacttcggatgctgttcctcttccagtttggaatggttctttgccaactcttgggttaattttcttacacacatatgatcatcagtattcaactacatatatgaggagatttttctgaagatagtattgctctttcctctctggttctctgctctgcaacctctgtctgctttggcttcctgggatgcccagcaccatgccctcaagctggggccatcactgttctgcttgggtgttggctttcccgcacggctgcctggaggctttcttcagagaataagctggggcaattgtaaagttcacgtcatttgttttccatctcttgggatcactgcattttgttgcctaatgtctaatctgttgaatgccattgtttcttgttttgtctagtttttaaaattgtttcaaggggaattacaaatctgttcccttttactctattttgactagataacagaagtctaattcttaagtatttaatatacacacagacacacacacgtattgctgttatgctgaaagaattttattatattgtatacatccctgggtctatgaatttggtttctcctcttgtaaatgtggaagaaacaacccagttaaaataactgaaagtattgaaaattatgagaaaatgaagttatgttcataaaagatctaataaacatatatttattcatagctgtcttcaagatatctaccaataaaagtgaggtatcccagggtaggctgggagaaaaaaatgtttctcaaatctctgccagtaaaagatttaacttattatgaatctgcattaatttactgtttaaaaattgtctgatttacaagccggtctgatccttgtctcttttatttcttctcctcagtgccagatgaaagcaaggttcactcattggctggacaaaaatcgggtaagaaattccttgtaactgactatattcctcttcctggaaatcactggctgtgttttagtagcagttggaacctgtttctatccactagtcactgaaaggctttctaattaatacatgagatgtctctgacttccacaaagatgacttattgcttggctgtgtgtatagtggcataatgtatgctgactcagaatgtttgggaggaaagaataaagatttccaaaaagatatataaaaccaaaaatcttaaatctgtactctagctaaacacttaaaaaaattgcaagaaaacccaagaaagttcaagattctttcccatgatgactttcatatttaagtggcgggacagagaattccagaataagaaagatacgatcatttttttctcctcaaaaaagaataggattttttttcttttttttttttctgcctgtcatcaaaatggattgttccagggatgtatgcattatttttatttagagacatgaatgagctccctagatattctctaggaagtccacaaaaatttctaaggatctcttaggtctttatcatgtgtgagttaccttcactcctaaaatccaagctgttttttcattgccaagtcgactgccttctattcctttttccttcctccatcatcatttattcacattagttgaaaacatttaaagctactaagctagcaaatagtggagtaatccctttcctctaggggcacattgttttggaggagaaaatgtccattttgctcatagcattgcccctctaaacaacagaaggattatgattttctgacatccctccattggtgaaacaaagaagtctttcccatcaccaagtgtctcccgtgtttgtgtgccaattatgttttcagcagtaagtggccttgatgcctcattacctccatcatgttccagggcaagattatgatttttttcctttcttctttctccagattctcttgtgataacagcagggaagggctggttcacaactcttagatttttttttcttgcttttcctaataaaaagcctaagaagttagatcactgtgaaagagatttctatgggagtgataaattgccacatgctccttgctcccaacatcctcttccattaaattctctactactggacatatttttaggagcttcagaaggaagttctcatgaccagggaaccccaaggataatctataatatcttcatcttaaatacattctactgcttatagttctcttatacatattgttataatacctgaagatgaaaagccttttcttagtactgggataggcttcaaggcaaaaagttgaagtccttttctggaatttttatcaatttggtttttgaaaatgagcaaataataaattttctggctttttccaggaaatcaaatcttattctaaccttaatttccaagcacactactattaggtggcaattaaaagtttgtcactctttttagatgagaactttgtcatctttgtatattgccataacattttatgtaaatttcaatgatctgtctttacatagtatgatataaaatattaataaagaattatgctaagtgcaaaatttgaaataataatcttccaaaaaagttttagtcaaaaatggcagaattttaaagctgtcacacaggttcattgcaaattccatacagcaacttcactttagctgatagaaatagttccaacagtctttatgtcacatgaaccacactgtttaaatacttctgatgttttaaagaatatttctgttactaattagtactgttattccaacatgcactatttttatatttttaagtgctattataacgttattactacttcacgtttttcattgggcatctgtagaaatgctgaaaaataaccagccacttgataactttggagcaaaagtggcctgcaatgaagagggctaaacaatcaccaaaaaccatatactgtagagtcacattaaatgagagcatcttgtaaaacactagaaacggttctgagaaagcacagagcagcattagaggaacatactcaaataaggttcaaaatttatgtactctaagaacatacccttccccattttttgttttttgttttttgtttttgtttttgagacagaatctctctctgtcacccaggctggagtgcaatgccatgatcacagctcactgcagcctcaacttccctggctcaggtgatccttccacctcagcctcccggatagctgggactacatgtgcatgccaccatgcccagctaacttttatttttatttttattttttttgtagaaatgggattttgccttgttgcccaggttagcgtcaaactcttctgggctcaagcaatccacctgccttagcttcctaaagtgctgggattacaggtatgaaccacagagcctggccactcccccaattttttacatttctttcttttggaaaattagtcttgaattataatgatcctcaggaactcacccctcacataaaacatagctcccctctgtgcgttgcatttacgtgaagggatatctcattgggatttggtggtggtggtggtggtggtggtggtggtggtggcggcagcagcagcagcagagggttaagggttctcttgattctaacaacctctttcagttacaaaatcattttttaaattcatttaaattcacctgtagtctcagtcggctacaggtcatctgtgaccactaagcaagttaccaggttgtattttaacttataaatctctacttgtctcaccattctttttttttttttttttttttttttgagacggagtggctctgtccgccaggctggagtgcagtggcgcgatctaggctcactgcaagctccgcctcccgggttcacgccatttctcctgcctcagcctcccgagtagctgggaccacaggcgcccactaccgcgcctggctaattttttgtattttcagtagagacaaggtttcaccatgttagccaggatggtttcgatctcctgaccttgtgatccgcccgcctcggcctcccaaagtgctgggattacaggcgtgagccaccgcgcccagcctgtctcaccattcttaaaaggaatcagttaacttctttttgttgtgatattgtccccttttccaaattctttcttcagaatatttaggttaaaataagagtttttttttttttttttttttgagacagattctccctgtgtcacccaggctggagtgtagtggcacgatctctgctcactgcaacctctgcctcccagattcaagcaattctcctgcctcagcctcctgagtagctgggattacaggcatgtgtgtggtgcccggctaatttttttttttttttgtattttttttttatgctaagagtctctcgctctttctctttaactatagaaatgtgagcagcttttatactatccaagaccaacaggaagttaaacaaattaaattgtatatactgacctaaatctatcatccagcctcttattcaagatgacattcaacattttaataaattcatctgagttaaaatttcttgagtcagctacttagtctgtaaagagctatttcgtgccaagttccatctgttggtctggcttgggtacctcccaaatttgtgacaatatttttggtacccttttcttggcttaatttttaaatggttgatccttcggagctcagatccaatcaaaggcccaggtaaaataaatctttataatatttttgacccaaaaatgtagtgttcccctcaccccttctggaattagtccagtattcttgagatttctctaacccctatttcaggggcttccccaaaagggcattgtatctcattaccttggcaaggaagatagcaggatgattctcctgtttctgagttggtagaatcctcctccaaatatgagagacatttaagtctatggtatggtgagacctgcccggagaagttagaaataaaataccctttgtttggttccttgaagaaaaatcacaagtttcatagagccttgaaaaaccaaaaacgtctttaacctctttccttgtttcactaattgaactctgacaaaattcaaattctagcaatgcctggagaaaaaaaaaaaacagaaaaatgtattttttaacagtaaaaccatttttaaatgatttaaatattctgagggaacattaggatccagagaaaatgacatcaaatttagcacagctttttttttattgttatgctttaattttgcttatactcagggtcttaaagtgtgtctttaagaaggaattctttcttattttctttctgtctactaaaatgacacttcaaccaatagtttaatgctcctttatgttcagacagaaagggcttataaattttactttttttagtgtcttcttttttttttgttttgatttactgcttggaactgttttaatatgtattgactgtctgcagagatctttgctgacccagctctttaagatgatgcagtactgaagaaggccgatgagttcttctttatgagctctgacatattaattagcaaaatggactaaaaagcttggctattcctgttttaatttcttatattctcaaacacctgtccatatagctgtaaaacaggcaagtgtgtgaaagtaatggttggcagcaagtccagaccttttctgagacaactttatcaattaatgagcaagtactcattaacaatctagggagctatttctatgtgaggccactaagtatgtttggtatcctaacacagtttgatgaaaaaactgaagctcaggtaatttaaatacttgatctcagctgggcatggtggctcacacctgtaatcccagcactttgggaggccaaggcaggtggatcatttgagatcaggagtttgagaccagcctggacaacatagtgaaaccccgtctctactaaaaatacaaaaattagctgggcatggtggcccatgcctgtaatcccagctacttggaagcctgaggcaagagaatcgcttgaacccacaaggtggaggttgcagtgagccaagatcacaccactgtgccccagcctgggcaacagagcaagactccatctcaaaaaaataaaaaataaaaaaataaaaaacttgacctctcagctggtaactagtttggggtaaggatatgaaccccagcattgtatggtggagcttatgctttggggcaatttatatttcactagcacatgccttatgaaagacacagcccctacatgacacacacacatatcaagctatctgatacatctttacttgcgttgtgtaacctcagccagctgaactaggaacacaatagctttaatttatctaccaaactactgtagttccttgagtatgagagggacatctaatctgatcgttcttgcctttgtttccttacatgtatgtgtgcatgtgtacatgtacaggagtgtgtgggccaagttaagagctgtatgagagagaagatgtgcatgtgacgtgtataaattataccaaaggcacacgtgcaggtgttgtgtatccttataacaaaggccaagagtttagtatgcaagttactacttcagcaggccttacattttgttctaaatgcaatgtgtataaacctcaaatccagagtgttcaaatgtgacctaagaaatttctagatccttgcaaaagaacagagcttttaaaaccatagggtgattggatagtcactttaattcaagagcaatgagttattaaatgacatttcataaattgtgttgagtcttattattccatacttttatagaatattaaaatttgaatgtgcatttacactttggaacaccagttatggccatttaaaaaatatttgcatcttctaattggattgcaaattttcatgaatttttatggttattattgatgaggagctaaaattttcaagttaatggttagtgtacttgaactcttttctttcctcatcgactcattaagatatgacagcatggttctctatttggacaaacatctttattggatgctttctaagcttttgtcatttgttttgttggataaatatagcattagacacaagaaatatatacatttctcacatgctgcagccttggtttatatttccatgggattcaggaagttgtcataaagaagttagcaatatgtctagcgttcttcctatacaaagttgattgtgaagcaactctagtatttccacatttgcaaaaaaaattactgaataatgtggtctgtaaaattcaatgaattaaactgaattagaaacaaatatatcagtcttttccataaaattctttactcctcaaatatggagcaggtgtatgcatctctaaaattcatgagtaaataaagagacaacatatgtttccaaatcaagtttcaaaataaattattttagttccactcatgtttattaaatgcccactctacacagatattgtgttaagtgctagagatacaaagtaaaataagacaagttctcagccttataaaatgtttataatatggtagaggagaaaaaatacaaatgcctaattcagtatttgtttgacaccctcatgctaaagagttcaatgcaaaaacctcacagaggaaatattgcttaattccatttggaattggggatggctgtcacgtttcagaaaggatatgcttccatagcaggatctgaaagcaaaatagaaactggcgatacagaaaaggtcaatgagccaacacatttcaggcttctggaaagttctgagaacatgaaacatcatggtatatttaagaaattttaagcagttcagtgtggcagcagtacaaagagaaagtgacaagataccaagttaagccaagtaggcagagattagaccatacagactcacaccaaatgaaaaagtaccattttatcctgtaggctcagataatctaaacagattaaataagaggtcacttttatattctagtaatatcaatcttttggttgtaggaacctgaagggaccccccccccccaccaaaaaaaaaaaaaaaggagagagagactaatagtccatataagagatgatgttggcctaagtgtcagtgattagcaatggaaggggaaagaaaagtaagaaatatttaggcaagaaagctttgagtattttttttaagttaaacttaatgggtaagtaaaaaagggtatccaacttgattttcattgtacttgtcagctattgctgcaactatgctgcataataaaaccaacagtaaacatttatttcttgatcacatatctccaggtatactggaatttgctggtatctccagtgtttgggtttagctccaacttacaggttaggaccagcttttctgcaggtgttgaccagcaatttcctgcggcatttacttcttgataacaagagtgagaagatagagacagggtagatagacacttaagagtaaaatgtattaacacaaaggctctggccgcccccctacaaaggaggccatggaaccgatggaactgatggaggaaatgctgggactgtgggtcagtgctgacacacccatggccatacgtttggtcttcttggccttggctgggctggtggatgggaagccagtatggatcaccttgtggatggatgcaaagagaccaaacttggcgggcactggaagtacctggggaagcaggagagactcacactgctgtcatggccccacagcctggagcctcccctgcctcctctgcctcttcagagcccagcagaaagacagagaaagaagcctccttggggttccattacccacactccaaggtggaaatctttcagatggttagatgatgaaggtagtagaaggcaaggatgattgggagtagaaggaagagtgacaggctagcatgagctgtgcagcagcaagattccatatgagcaaagtgcagaaagtgagaaaaaaggaccaagttggatctcctcctaaccctgacctgcatgatatgggtgtgagaagcttcaattgagaaagctgctgagaaagtagaattcatagtggagaactgcatttcaattaagaaaacaaaaacaaaaacaccacagaggtggtttgaaagaagaggttgggttgaaaatgaacagtattttgtcaaccatggaaggatagttggactcaagaaggcaaggtagaagagtctaggatagaggggagaagtaggacagcaagtcacgttggaagacacacagagtggtatcattagttgtagagaaattaaaaaaaaaaaaaaaaaaaaaaaaagctgagatgctctgattctagtgaccaagggagattataagctacctacttgcaagacctttcattttaaacatctttggaaaatctagtctgccaggattcaccaaatggctgtctagccattctagcaatgttttaaatcttaagttttttcagctaaatcgtagccgacacctcatattggaagtacacattaaatactcaacctggaaaatctgaaggtgagctcttacataatggacctcccagtctatgttgaataatgtatgtcaagctgaaattttatttctaaaatctgataaagttataatattgccagctaatgttgagaaatattttaggatgtattggttttcctaatattgctattacttcatgtaagatgaagggtgtttaggtgtacgagtttcaaacatgaatactgtttattggaggtaagaggaagccttaaaagacatatatttcaggaatagtattgcctccttacaaagcactcttttgttcctacattgaggctccagtaatgtgatgaatttcagtattttattttattttattttttttttttgagatggagtctcgctctgtcgcccagactggagtgcagtggcgcgatctcggctcactgcaggctccgccccccggggttcacgccattctcctgcctcagcctcccgagtagctgggactacaggcgcccgccacctcgcccggctaattttttgtatttttagtagagacggggtttcaccatgttggtcaggatggtctcgatctcctgacctcgtgatccgcccgcctcggcctcccaaagtgctgggattacaggtgtgagccaccgcgcccggccgaagttcagtattattaaccagttatacgaatgcttccatcaccttgtcatgacctgcccttccagccttgccttttgccaccatcaccctccatctacaggttcccaactcccagctagtcacagttactctctgaccatattttgcccttttatgcctcggagccccagctgaactcttgaagacgcacctcccagggaaaccttcccctgctttctcaggcaggctctctcttggtgcccaggattgtttaacttcaagtgtctctaggttctattctttcacactttcttgcctcaactcacacttctgctccagagccagtcagttcctgtaagagatagggagaaaaacagtttttttctattctcacacatacaacacagaatactaagcacagcacagaatgcttcaattctggtcaccaaaatgtgtatggtttttccccacacacactgaccagttctccagtggacagcaactcggtgtcctataattcaattcaattctgacactatctacctggcgatagagtcagaatccacagattaagctcttagttccacaagcctgtcccattcagaagccagtcccacgtcctaagttgtgacttgggcctctgaccaacgagctgtaattcacagttcccatgactctcctcaggttcaattaatattctagagtagctcacagaactcaggcaaatgacttacttaggcttactcatttattataaagaacattgcaaaggatacacatgaagggctggatggaagagatgaatagaacaaggttgtgggaaggttctaggagcttccatgcactctctccaggcatctccgtgtgttcagcaatctaggagctttccaaaccctgtgctcttgggctattatggaggcttccgtaagtaggtaggattgattacattattggccattggttagcaactgaactttcagctctttttctctctctccggcttagagggtgggactgaaaattccaaccctctagtcacttggttgattcccttggcaggcagccccaaatcctgaggctattcaagagctcttgttcatcagtcatcttattaacgttcaaagatacatcactttggagattccaagggttttaggagctgagtgtcaggaaatgagaggaaaaccaaatatatattttatattacatatcacagcctcaaagatccctctcaggatgttttttttaaaaaaatctcctttgatcaatagtcatggctcccttatattattaatattccccaaatccagctttttttcatacaggaaggaaaactcttatctattgcatagagtggggcaaccaatgataaactcatttagtaagctagtatttattgaacatgtaccgtataccaggctctttgccaactgctacaaatacaaagtggtatagaatatggattctgcccctaaggttctcacagtttagtagcaacaataggaatgcaaacagtgacaataccatgtgcttatgtataaatgcaaatgcacagaaaaagtaacagtggttatctttattgaagaggaagattatggttgggggtcaaagggaccttctgctttatctgtagtatttgagttttacattcagactatatttaatgtactatttaggtaacaaataatttatggattaaaaaataacatttttaaacttaaaccatcacatacaaaacctagtaatagaaatattgtacaaatggaaagatctagcatggggactggcaaagattatgggcagaagaaccacaggaaaagggagcttctagtttctgggaaggagatgaaaggctgaatcccggagtcatactggaaacctatttgggaacctatttgcagcacagaagtattttggaagaaaagagaatagagaaaggcttaaccatgagacctgtcatttatgggttgctggaaaagaaaaaagccataaggaaaatcataattagggaatattaaacccccttgtcaatttttggtatcctagagggcaaaaacttagtcctagtaatttatttaataaggtacccatgcaatgccatgtacaaaaagtccttttttagaggcccatgatgcccaactgtatccaataaaaacagacttataattagggggttaatgaagaatgtgtgaaatgaaagagaaaacttaaaggaacctagattacttctccttgctaaaataagcaatgcagaatcattcccactctactgataattagaaaccgcatacccctacgaaacagcttacaaatttcaccccatcaaaagagaacaaagccattcaaagttaccttttgaatgaaaacacttttattagccaatcagttttttttttaaaccaagcaaaccaaaccacaactgcaaaagaaaaaaaaaaagacagtttggttttagttttgtaaaatatcatggcatgccctcagtgagctgtgagagatatttagaaatactggcatcaaactggtgacagagacattttactgctgcactaacaggcctcacagaaatactactgtaggttgatttagtagtctggtggcccataccctattttaaatggtttatatgggcaaacattctttattttgaaaaattatatatttaaattaatgtacattagtaaaagactgatttttcacttacagcgctgctacatgtttttcgcaaataaaatttttgttcaaaaactgagttatttttaaggaaataagaatataaaatgctatatgaaaatggcagaatattataaaatggtaacactaattgttgaggtttgaaaagcactgattaattctgtaagcttctatcagcatttccatagtttctgtcatgcttctttacaaagttcagggaatcttagtttgagcaaagagtctctacccagaccttcaggatacattaacaatgacctacaccctgggtgccttttcctgtccgtagtcaaatgccttcatttctggttgaacactggcttcttcagtgcaagaaatgtgcaaagcttcaccttttacttactataaacttctctcaataaactctaacttgagttatattttcaaatatagtcccccagcaggccatttcattggagagagaaacataacagatgcaatggtacacttccatgtgggcctggaaagccttaccagatgcagtcagctttgactttttcctctcttaagccctgacatttaccagcaggaaatcaggttgatcccacaagaatacatcccaaagcctcactttccaccctttcccgagccaccgtcacctggagagcttcagtgaggaaaactctcctcaggcctttgcacatgcattcgattagcccagagtgatcttccactctatacggctgattcactctgattcaattctcaggtcaaatgttctttcttcaaagacaatttctgtgaccaccctatctaaaatagtcacccaacaagaagccagtttctctcaccttactgtttacctccttatagagctaatcacagtctgtagtaaatgtgtgtgcatttattgatgtatgtaacctactgtctgtttcccctacctccagaagtgagcttcatgaaggcagagactttgtatccccagttccaaaagcagtgtgtggcacacggcaggcatcctttacgtagtacttgctaaatcttttttcttgatacgtctttttgcatatttttgctctcaaactttgtgtccttaagctttatgtgtatgtcttgtcctaataaatagctggattttgttttgatgttcaatgtgacaacctgaattgtaactggggtttaacacatttacatttattgcaattactagcatatttagatttatgttttattttcagttttaaatttggactactttttaatgaccttttttccctctcttgtcattttaggctgaattgctttttaatcccatttttttctgatagtgatttgaaaattatacactgcatttttggcatgcatacctaacaaaatctaaaattagtctgtatctaatccttctcccaaacaatacaaggaactgagaaccctttagctttccttacctgcttccaatttttatatgatttccattttgttttctttcttattttttggtcccgcaaattatatattaatttcagtgttttatgcattcaatatttgttcagacttctccaagtatttaccaatttcttaactcaccatttttctttgaatctctgaccttccctcttgggtctttttccttcttctgaagtatgccttccagacattctttaatgctagtctaatgatgacactgttttgtttattagaacatgtattttccttggcaactagtttttgttgggtatataaagttagacttatagcacattggagatcttcttctattgtcttatggcttctgctctgaaaagtcagccatcagtctaattggcttctctttacctttgataagtcttttatctctggttactcttaaattctctttgtccttgacgttcactttcactacagtctaggttttggtgtagatttctttatattatccttcttggtatgtggtatgactcccatggctttatatcaatgttttttatcacttctgggatattatggctgttactatgcctcttgctcattctgtctcctctttgtggaattcttactatttagtaaaatgatttttaggccatactctctcaactgtatgtgttaaatcctttttgatatttttctgtcttcttgactctgcactccattctgagtacaagtcgagtatctcttatctaaaatgctggagaccagaaatgcttcggatttcaaatttttctggattttggaatatttgcatatacataatgagatattttggggatgggacccaagtctagacataaaattcatttacatttcatatacatgttgtacacataggctgaagataattttatataatatttttactaatttgtgcataaaacaaagtttgtgtacattgaaccactagaaagcaaaggtgtcactatctcagccacccatgtggtcagtctgtggttgtttggcaccaccatcattcccaactctgaatttatatgctaccattaggtagtcattttttatacttacacacatgagtagttaatgacaaaaaataggaataccattaatacagtaaaaaataatgtgttcaggtaaaaaagcagcacagtggcatcaccagaatacctatgtcagctgctcagcaacagcaacaacaaacagtggcatatgaggtcctatgtggaactttccacttatagcatcatgtcagtgctcaaaaagttctggatttaggagtatttcagattttggattgttggaatagggatgtacaacctggactaatttctccagacctatcttctagctccagtttagtgtctaaatctcacatctctgctgactctcattcatggtgactttttctttataagtttggtaatttccatttgggaggtcatatttggttggctttaatgtatgagaatcttggggagcctgatttgcatgtgcttttcttcagagaggatttagatttgtttcttctggagtactggcaggacactgctaacctgggatcactttcatataatttcttggctgacagtttaattgattgggagaaaataaacttgatttaatacctctaagaggtcagtattatggttgcaagttctcaaaggaatatggtgattttttttaattgttgtttttcctatctagagccagagatgagacagattttcttagactggctttgcttaaggaaatgtatcagggggatgaggcttttcagcccagtcttctactaaagttgtaggccccttgagggtcactgctttaactctcctgcttttgactttgactcccagatcctccaagataccaccattgtgtcccctcccaagctccaggttcctagattcagcatttacctaaaaggcaatctcaaattgcaagtttgcttgcctaccatcactcactgttggttttttcacttgtttttttgtttgttgaagggctttcctttaggatttcctttaatttcctatgaacaaatcaacccatttaaatgtgcatttttaatctatccaagatctatttgtggcatgtgaggtcatgtgcagagttttattcatattttgagaattgatatattattggaagcagaagtctagagtctaataattgtttgttaaatgaatgaatgaatgaatgaatattctttgtaaaagactgaattcaaataaaccattgggtttaatgcagatttaactctcctacatttcactttgactcccacatcctccaagataccaccattgtgtctttgcagaatgagtgaatgaatgaatgaatgattattctttataaaggactgaagtcaaataaaccattgtgtttaatgcagattagagcacacatgaagccagacatggttttatttcactggatctcttttgacaagacaatccaatataaaatgccccttagaaatatatggaaagccatgtgacataagaacaaagtgggaaatgatggtcataatatgctgagaaagtctgaaatggaaaattcctttcaataagaaaccacataataaaaagttctcgttatatttgtagttacaagctatggtttattactctgtctagagattcttgtaatgattcattgttattggaagaaataaaatagggttcacaaaggagcttttatcagattataatgtgccctatcataaagtggggaaaaagaggcttatctggctatttgtagtccttgcccatgtggccatggatcagatactaattagaattctttttgaacccctggaatgctctgcagagtgaattccatgtcatgaccacacttgaagagtagtgcatgagaaggctgtttgataagtcctttaggtactaaaacaaatcaaaaccagtcctatttattctaacaaaagcctctctcctcatatgttctctgctttgcaccaaatgatttttggcttttcatctttctaaagtctagatatcctgatactttcatggaatttttgtgtaacttaccagtcatgtaagactgttaccatagagtaagtggtgagtttggcaaagagaatggattgagaatttggatcaagacagcccatagtcatattgctgaagagctacctttcctattggagtttacaagggttaaagaaacaccactatttctctaggatactaccttggtcaactttagtaaaacagatgatgtactagttgtgtattgtggctgaagatatcagtaggcttttatttttcttcttctttctctgtgcttttttctcctttgtttctataaattaaaatttctgggcatggcaacgagaactggctttgcacacacaatacccttggctccaaggaggtcatagatttggatcatctcccagattatacatctgcccctctagcttgcctttcagagcatatggctgtggcagagggggcagattacaaatcacctctgtgttgtttcaaaagtataagaaaggggaagcaccttttcctatgaccataaagttgttacttgagtgttaaaagacaacgattttcttgtgaattgtcttcagtgagttaagatgcattcagtgcattgcagtcatagaagtcacactaaacactatgtaggggaatacatgacatgaaaagtcctgacctctgtttttgggaacttacatgtcagctgaaatggctacagcaacacctgcaaagagggacaactcagagggtccatttattgctttacattttattctcaggtgctgacaaataatttttcttaaaaattatatttctggatatgaatacatattggagcaatcaattcatttcagagtatatcagccgtcagggcttcttttgaaattgcaggcattgaaaattctggatctaggcatagaatcctaccaaaagacaatacagagctagattgaaagcccaaggtactgccatgggggtaatttatgaatctggagaaataacagagtaagaagagatgaaggaaaagaggtggatattagagaagatatgttattcccttttctaagctcatctgtgttctgaatctgtacccaactatttatttcagagccttgttctattagttaatggttctttctcttctgtcttcagattttccctcttgattggctccttcctttaatccaaggagaattaatcaaggtgacaaaggtggtggggcaaaaacagtgggaatatatggaagcagcaaggaacataagaggaggtccaagcaaaagcagtggataacagtgcaaacaggaactatttactgaaagtccttactaaggagtttccctttatcatttaaatagcaaacagaatgaacattttaaagtaaaattctgtcatttcacttcttataaaccttcaatatggaacaattatatgaccacatgcaaaaagaaaagaaaaaataacctccgtctataccttacaccatataagaagctaatctgacatggttcacagatcttaaatgtgagcactaaaactataaaacttctagaaaacaaatgggagaaattttagttacagtgggttaagcagaactttttagagcactaaaaccaggaagtacaaaaaaatcaacaaattagatcttctgaaaattaaaaatgtttactcttcaaaagatactcttgagaaaatgaaaagacaagtcacagactaaaaatatttgaaaaacacatatccaacaaaggatctgtatacagaatatataaaagttccgaacccaaggaattgccaaaatttaaggataagcaaaggcacaagtagactatttactaggttattttagacaaagagtaatgagaagtggaagaagattgtcagagagaataggacacaaatgataaatgtattataaaatgtggcagagacaggtggataggacttgacacttttttatatttgtaaacaagagacaggaaggacccaaagctgacctgagactttgaggctagaagatcagaagaaaggtagtgcctttaatagaaagaatcatgaagaagggtcaagttatgagaatgaaagtatgagtctggagctccagagagatcaatcaaggttagcgatacagatttagaagtcatctgcattagaggtggtagttgaatattgaatttgtccacaagattgcacagattaaattaagtaataattctttgatgggggtaacagccattagttttttggttaactaaaagcctaagatgaaggcaaaggcagttactagagttaatgatcagtctcatttttgctattatcatgttcagtggtttgaaacaactagaatttttctctgaaaattagcagctgcatggaaatgcaaagtttctagcagttacaaattggatactaagttaaattgacttatatatttatatttacagaggatcttaaacagaaaaatgagatctttgttcaagtttttaaatattagtgagacatgagaacatagaagtcatacaatgaaatttgcactgattttgtgaacataatcttatgatttcttttaaaatgcaattatatgctttctttaaatcatattagttgtctgttttgatcaactgacaaaagtcagcttatccacatttttccatttagtaaaaataaattttgaataaatgatgatatggtcttcctaaagtgattagtaatacaaatatagggttttctctttttgttgttttcatcttcagagattagtagaaaatttttcttgttatttgaaaatacttttttttacacacatacatataaattacaggtttgcaaaaagtgacttcattttatctattgtaaactggtgattcctgtttatgtgatcataaatcttagtttgcctacttcttgcttgtgtttgttggcattaatgctgaagttttgacaaaaattactttaacttttgcttccctcggaacaaccagggaaaaatatcaacagcgaaaccggatagatgtggcaccaatagcttacttcaaataaattaatacttcattttttaggcaagaatggtaatcggttctgttctattagcctcagtggtgtgaacatagagtttcatcacattattgtgtgtaagatatatttacaagagacttagacaaagcaaggtcttccaagaataagcacaaaatgtctatacacacgagccttcagggaagattggggtgatacatggaatcgatgcactttcaagttggcggatctgatcatcagtctctaaatgttagtaatcatttggtttatttacttttgaaattaatgtgaagggctctgtagcttctttttcttccttgggttttgatgtgctgatgtaatttggacattgcttttctgcctacaaatgggacgattcctgatatgtgtagattagggtgaaatctcaggtgctttttgattttctactttcagagaaaaagtagaaattgctgctgatataccgagacttcaccgaagagatgttcagtgtaatataattattttgatgtcacttttcattgttttattcacaaaaaggaaaaacaatattttataggaaaacattagtaacaagagagatatcttaatttttaaattaatattcagtgctctttttaacacgatatttattaggtgcaagttacatgctattgtagtaaagttaaaagattattcaaatctttggaattttcagagatgaattttatcaaatacatatttttaaattaaatgggctatcaagtagagtttagaaatcttctgttcatacagatttttatcattttagtacttcatctgtgatataaaacataaatcttgagagaagggcttttgatttttgttaaaagcagcatgcacatcctataaggcatcagtcagaagactcattagaaacatcatactaaaaagttaaaatgtttcttacgctaagattatatcaccaaatccttgaaaagacatagcttcttatcagattgttctttgccttttagacttccgtttcaagggagaaaaagtaatttttgactaaatgtctattgatttaatgtctcccagacccaccaaatagagtttattcaacactaaaatgcagttacctctagaataaattttgaaagctgaaatggaatttggcaactgtttaactcgacacagaaaattcactgaatttagaacaagaagtaaagtgaacattattttatttaattcaagatgcagttgtattttaagaagacataataatgagatggcaaaccaaaataaataaatgaaaatgaattctgttttctaagctcctaactccatgcaaacattataggtcaaaaatacaattattgtagtcttaattggagtcatagcaacttgttgcttaatttataatttctctgtagtcacatatacagatatatagttttgagagagttaatacatggaaaatacttagcttagtgcctagaacactgaaagtactcagtcagtggttgcaattactgtggtgtttgttgctattttctgttgcattcttgtgtctcttttgacctttctcccttgcttcactctgaataatttcaagaaacatgattttggcttaactgcttaactagatttgaactactgattctattcttttagcaattaaaggattcttttcaatatttggtctctgattcaaccaggaaagaagagatgagaaatggtggtgttctttttgttgatttatctagaacctgtggttttcagactcaggttgagggaatataagtgattttcaataagatatgccagttttagggcttgttattgacttgcccctatagtcagggctgttaaaaggattttcaacaaaaacgatctcatcctcaatcttaatgtgctaaagaagaagacaataaaagaaaaaaaggcattcctctcaaacaatttgaaatatctgcagttattttttcagagtttttactaaaactcaagctagtctagctcattgtgaaattttacaaatgcatacttcggatttattttcaaaggggagaaatcattctaaacttccctgtttcttatttttcttttacagtccccatgctatttctccatttcagccaacactgttaacagactcttttaacatttatatgctcttgcaaattatggcataaaaaactatttcttgacttcttgctatgtactgatattgtataaggtactgtgaggatccacaaaattaaaaggcatagatttcagagagggtaaaacttacacatgggaaacaattaagatcaagtgatttataaacagtaacctctgaaatagaaggtgccaaattgtgtgacacagacaatagggcaacagggctcagagatgggcaagatcagcggggctgtattcatcaaggaaggatttggcttgagcttcagaaggattggttggatttgtatcactgtagaagagaggggaaggcattccaggcagcagggagagcaaaagcaagctcagaagcagaaatgtcatgcaaatgtcatggtatgccctaattttaatgattccgcagtcctatgaggtgactttaatctcactgtaatttatatcagcagcaaaggatttgagtttacaagctggcttcatttaaagaaaaggcagatagaggggtgaagatagaataaatacattcaacaaatagtaatagtcaataaaaatatgaaattttaaggttctagctattctaagcatgtccttcagtctgatgtttggttttaagaaggtaaaattcttagggcatcataaagaacctcaaacatttaagataactaatctaatctctaaaccagaggaaggatgtttttcttaatactgtaataaaagaggctgccaccatattttatatggcaccaactctattggttattaatcaagttcttaggctaaacttcaggccttctctcatcccaggacctttagctagtgagccctagtgaacatagccatcattcaactccttgccttctccaatgagaaagaatgctgacacagaaatgttttagagtcaactgcaagaactcattaataccaagcccaagaaggaactgctgatcatcagggatctgatcacaaaataaattagcagttttgcatcacgatgtcttgtgacatacatgcattagtgaaagtaaataagcatgaagacagactgattaagctcactcatataattggtttttgagaacggttccaatatattgggagaaaaataagcatcaacttggaaatcaaattgacttttttcttaacactgaacaaaagaattgttagaggtttgaggtaaaagatcgtggcagaagccagtattgattcacattactggtcagccctcttaagattctatgcttctctgggtgttaaaagtccactggaaaataagagaaagaaaattgagtttcaaggacgtagaaaaatctgatttgaaatcaggtggaaagtgctctaatgccactagtattaggaggcggtaatttgcagataaaaagtaaaaatacaggtctggaagtggtatatttaaaattttacttctgagatatatgatgagtccaaaataagttttaaaataaaatgaagtataattttgaggaatatagtgccaatttgacagaagagacttctcagctctttggggaaaatattgaaatgcatggttttaagtgatgctggctagaataaaggtggaaggaggaaaataaattacctcattttaacaacctcattaataaggtaataagagactgtcttaccagtgatgttatttgcggactaaagtttctcaaaaggaagaaaagagtatagtcttgaataaaaggtgtacccaagtatgaataaaataagtataaatcattcatttttcaaaaacctgtgaagctcaaagaataggtattattccattttgtagatgagaaaattgaggttttgaggcaaatagtagggaacagagtctagatttgaacctaggtcactttagacttgtttaaatatgtaaatcactcaaaactcagaatttttgcatttgacttcagataaacagactggataaattcctacctaaacagaaactaactttattgtaattttctaattcctcaatgttaagttctcaatgattaaaggtgccttgagtattttattcaaaactttttggtacttaatcctataaaaataatgacatactcttataattaaatagacttatttcaaactgtttcccaatttcaatttattcatcctttttactagtgacatcattcattcatgataaaggaaacaaggaggctttttcaggtaatgtcttaggagtaaggagagagaaagcaaagttagtaccttgttaagatttccaagaacttttatattcaggaatttatattcaggaatttcactgatttttttttaaagttccttcaggggcaattgggctgctgggctgctgattctcaataaccacacttacacctgacaaacaaaaatgcattactctgtgacaaggcataattagtaatttcccactgaactggaatagtcattttagctgtcagaaatatttcttttcctagtaagaaaattcacttgcaaaaacaaaaattaagatctgaagagtacttaccaagttgagcaagcaaggggaaatggataagctaaaaggcagctatgtgcttctctcctactggcatgtatcatagactcagtattttctagagaattatctggatactctcatcaatatatcctaattcaccaatatcagtataacatgtaattttttccctagaatacagcaaataataactgaagattttaagggacaacttcagacaataatacctaaatacattaaaatgactaaaggagtgtaattggcttgtttgtaacacaaaggataaattcttcaggggatggagacccccattcgccatcatgtgattatttcacattgcatgcatgtatgaaaacatctcatgtaccccacaaatatgtatacctactatgtactcaaagttaaaaattttaaaaaaattttaaaagtaaagaatatcctgtcagtaataataatatctaaatacaggactaaattaattcataatacaatttgtgttggttaggaatgctctaggctgcagataacagaaagccctactattggtggctgggcatggtggctcacacctgtaatcccagcactttgggaggccgaggcaggcggatcacaaggtcaggagatagagaccaacctgaccaacatggtgaaaccctgtctctactaaaaatacaaaaattagccaagtatcatgtcacgtgtctgtaatcccagctactcaggaggctgaggcaggaatatcgcttgaacccgggaggcggaggttgcagtgagccaagatcatgccaccacactccagcctgtgtgacagagtgagactccatctcaaaaaaaaaacaaaaagaaagaaagaaagaaagaacaccctactattggtgacataaagaagtaaagttcctgtttctcacctagtaagtagtatagaaatgggcggctgctagcagggaagaggagggagatttcagtggatatcagattggttgtatctctgattctctgggattcttccacttgaccatcttgcagtagatctaggcaaaacaggaagggataaagggagggaaaagagcgtgccagccttatttatcttaccagtaaaagctaaggtcttcccccagacggctttaacacatttccacacatagctcattgtccagaattggctcattgccaatcctggcctcaaaggctaggaagtaagaacataccggattttctcgcctctcctccagaggcaaaaaaggaaaaaggtgtctggaaatgggggtgggatgaccaaccaacagagactgccatgccacaaaaaataatacattctgccactaaaaggaactttaccatttattacattactctgttaccatgagcttacctgaagtgtaccttaaataatcacttgaggagaatttctatatatccaaaaacaagcagagaagaaaaaaatcatactcttaaggatttcagaagctaggctttgttccaggtgtgctttctgcaaagtgttttaaattcaagccttagcaaaatatcagattgctaccaggcaaggaccttcagagtcacttgataatataggaaaccacagtgtcatgcatttgctacagtggatgatggtgggacacccccataatccccttatttgaaggattttattcactgataaaagtcactgctatgtgatcatgattgattgctcaacttttaattattgacatatattacaagtaaatatgccatacatatacacacacacagacaaatatacacaaacacactagaatttctgatctacatgagataactattactctaaattgacataatttcagcccaaagcagaaatatttgctcttttggaaagtatgtgagcttagtaagatgtagttgtgaatcttcattttgatacttagcaataacttttcagatcttcattattattgcctagtatttccttcaggggcccccaaatgtggattgggaatccaggttggaaaccactatcctcaactttccactgatgctcccatattgcttttaaaagaaaacatatcagacttaaaagttatttaaatcttaaattagctacatcttaacagcataattagccttttataccaagattagtgaaagatgctcggctgggtgcggtggctcctgcctataatcccggtactttgggaggccgaggcgggtggatcacttgaggtcaggaatttgagaccagcctggccaacatggggaaaccccgtctctactaaaaatacaaaaattagccaggcatggtagtgcacacctgtagtcccagcaactcaggaggctgaggcaggagaatcgtttgaacccgggaggcagagtttccagtgagctgagatcacaccactgcactccagcctgggcaacagagtgagactctgtctcaaaaaaaaaaaaaaagaagatgctttatttttgtcttgttttctgaatgggtgataacaagattgataccaataaaattttgcttaatttgatttttcaaggtaaatatggcaatatatattttaccactttgttatttattttcttagttctatttcagatcacctgtcccctcgtttctataattattttccccacaattatatttgtatctgatagaccgtatttgccataaataagaagcactaatagctggtgttaaaataggtaaactttagtatattttatataaggaccattgaatacttatgattacttgttttaacaattaggatgtgtttgactgcaaataacagataattgataacagtggcttaactaaaaaaagggtttcttcttgtctggcatcaaggacagaggaggcaggcaggctagggttggtacagttgttcaaataagtcatcaaataccagacttctggcctcctgcgtctccatccataccgtgtagcttccaacctcatgtttgtgggatggctgctgcccctccatgtgccaggcaggaagaaggaggacaggtgaaggacaaaagacataattctgtcccttttatttggaaaataatagctgtccaaaaacttaacctcagatgcttcatccgtgtcttattattcaaaaccattacatgaaaacaaaaaaccgcatgaatatctggagagatgaatatttttaactagtcaggttgctactccaaagtcaggattttgttaaaaagaagctgaaaaactatttggcataaacaataagtagttatacatgagacagataagttagccaaatcaaaatcatcctctttatatcagtttttcccctaaatttaacttaaaatacctgaagtaattggaaataaagtagttttccaatgtagacattgaaaattatctgtaaactagttcagtgttctctgaacagcaactaacacatacattgcagaaatttcatgaatattagattgtgttgattgcttcaatgtttgttcttaatctaaattttcactttaacagttgcagctaactattcatatatacaatcaactctcagttaccaaagggtgaatgccctgaattcccactattgttggaaaacctggctatccatttcttctttgcattgtcacccagtggaaagagttcgctcctttgttatacttactgtgaattccactccttcacctaacaaaacaatgccagagcagaagcacgtgtgagttttttctttatagtcagatcagctgctgtggagggcctttccctctaatgaccagctcttccttcagcaaaagtataaagcatgcaggcagctatctaaaggagcaactactttggagccagacttctcaatcttgaccatgaatccaggtgagaaatactgagtaaaaatacaaaatggatttgcgtaagagttcactaactcctcctagatcaggtcttcactttcttctttgagatgtcatgagtttacagtatggaagacactctatttgtttatttcatcagtcatgtgttcacttggccaacacctgttaaatgcctaccttgtgctgtgtatcatgctgactcacaatgtatacagtcgcaccgtattctgcggccaaatggattaatatttgtaaacatagttagaagttttacttttgtaagttatctatgatcttgaacttttgttacaagtccaccaggttgtacagctctgtggtgggggtgagggtcatttataaaggctgcatgtgaatcatatcagcagtcccccaggggttgcagagcacacaccaccatgagtgtgtgtaattactctggttacttcattgcacatttgaggattggctcctgttttgtgttatccatattattagctcagctcatctagatctggacaaatatagtttttttaaaaaaagtctattttattttccctcatatgtatatatatctttatcttagataaattactattgcctataattttcatatatattataacctctgaagagaatttagtacctatattctttctactctttatttctttgtgtgaataggcaacatgtttacctcccttcactatagcatattggtattaggatatactatatacttgaaacttagaaaatttgcaagaataatcagctgatttcattcctgatgtataaaggaaaatattccattccttaagtgcttttagtaacttatattgcagtgactttaatattactgaggaagaaacctgtagtaatcttattcacctcattggtaagttcttgcaatatttattattaaacattaattattaaatatgaatagtattaaatgtgtggtacattgctttttttaataacccctttcctgatatcccttaatttacatggtatacttttacattgatttttttataaatcatttctacttactttctatctgaatattatctatctgaatattaatatcaattatctacctgaatatttctatctgaatattaattcttcagttagcaccaaatgcagaatttattatgcaacttttaagccctctacagaaatcattatattattttataaagaatccataacattttctcttcttggcttttcagcaagttgtctatagtatgtatatcataatattaccttgtgttttaaaccactcagaaaactggtaaaaagcagaattgtcattttactaaatattctttcttcagccaattcccatgtttatcatttccttaatttttattgtcctgtgttgtaaagtggtctgtggcttcaaagggcttttatttgctttacttgcttctaggtttctaactgcttgtgtgccttttgaatacatgtttaaacataagagaaaaaatgtgagtaaggctcgcttctgatttcagactgcttgagagggaagtgactgaaggggtaatatataatcacaaatcaaacccaaggccactgttaggcttctttcggtgccctgttgaacgggaaaaattaaaaaaaaaaaaagtctctcgagtttcacagattagcaaaaacttccttgtatttaccatgcactgaaaatacaattaacagtttgtatgagaagacgaaagataatgaaaagagaaattagtctctgaaaagcacattcttatgaggtcatgaattacaagttcatgtgtcttatggcaaaatatttatctaagagattcggctataaaaatcaggagtcaccaccctctttagattacccaaaagagttgataatgacttcataatagcataaaaaatctggggtctttattgtttttaattctgatttctatattttatctattgaaaatcaagagctgtggataaaaagttcatttagggcagggtgtggtggctcacacctgtaatcccatttgagagatcaaggcaggtggatcagctgacgtcagaagttcgagaccagccttaccaacatggtgaaaccctgtctctactaacaatacaaaaaattagccgggcatggtggcaggcacctgtaatcccagctactcgggaggctgaggcaagagaatcgcttgaacctgggaggcggaggttgcagtgagccgagattgcaccattgcaccccagcctgagcaacaagagtgaaactttgtctcaaaaaaaaaaaaaaaaaaaaaaaaaggttcaattagatgtcctaatgagagaaaagaaatttagcagggatcttttcatatcaatatcaacagttgttcaaatgctaatacaggtttctcttaatggttatgagaatggtgtttgcattaatggaaagcagacacagtaatctcaggtgtgttcatattatcattatttagtctgagaaatctattaagagttagtcttaatacaagtaactgaagttgttgccttcattaaggatttctgttcctgaaatttgtaatgtacacagtgaattaaatatggcatacattagccgctgatacaggaagacatatttgaaagaaacaggggaagtagaaatgtggatgggaagagcatttagcagtctcatccctctgccattccttccttttgtagtgagccagcagggcgcctggtgctgacagccttggcaaacaacctagagagaaaatatgtcttctgaaaagatcacgaaatctcaaagacctccagttccttggtatttatacagcatttgtggtattttcctcctttcttttcttatttatccttaacagaagaaacaacaagtaaatctggtgaaaagcttcaccaagaaaatgctttctgaaagaatttaaaagaagacaaaggagttgcagggagaagcaggttggcaatgaggagctaggcggggccttcgggagcgggagcagcacccaccatctcacaaatggcccttctcggcaacgttgggggatatttattccggggaagtcagagaagctccaaagtggcttgcagcgctttatcagccgacatttacacagaaactcctgcctctgagcttcctgtgaaatctataggaggagaagcccaagggactctggctgttagaaaatttgtcatcctgctagagagacctatagattggtggttaaccacatggatattgctgtcagacctgggtttgagtcctggccccatagctggctctctgtgtgacccttagtcatgctgagcctcagcttatttagctttaaatgatgggtaataataatatccacctcacaggtggaagtggggtgagagaatttgtgtggaacacctagctccatttctggcacctaggacaacctccatacctgctagttgttatgtttgagtgatctgcatatttgtaacaacagggatacaattaaacaagagtccatgctcttcaggaattaaggagaggcaaccttctaggttacagtcaggaaggttccatttgccagacaacgaataatccttgagtattcactctgctggccgttgatagaaaagtgaccgtgacttcatcactgccttcaaaaagcttagcaaggaagacaggtatatacacaaacaatgtacagaatggggagtgtgcttgggttcaaatcccagttttgttgttcattagctgtgtgaccttgaacaagatatttaacctctctgttcccaggttttcctctatataaatgacagtaataatagcactcacatccaagagttgtggtgaggattaaacttgtgaatactgtacagtatagcacttagaataatgcttggtactcaataaatatatattagtcattattataatacattgtggtaatagaaatgagagatctggcagattttctctcctaatttcttttttgacatagaagtggttaggaaaggcttcctggtagaagtgatgtctaaaaaatggccagtaaggagaggagagaacagaatcttagaaagagagacggcagatgcagagacccaatggaggagggagggaactgatgtctttgaagtatggcaatttgttcaaaatggctggagtttggactgtggggggaagaacaaaggaaggagaagagaggtgaagtaagatgagtgagagaggccaggtcaagaaggcctttgtaaatcatcccgaggagtttggaccttctgaaagccaaagggagccctacaggagtaatttgaccagacaatcaaaaatcctggaaacagatgcccagagggagaaagtgtataaataaagacagtattgagctgagagttaagccttggagaaagcccacatttgggggaaggagaaagaaagggcactggtaccagagaccaagaaggaataaatatattgtgagaagaaccaggtagcaccatgcttggacgcggagggaggataggatttcaagtaggaagggttaagcaaaggtagcgagtgctgagaagagatcaaacaaaataaggactgaaagaagtttattggttctggcaattaggaggcaattggtgaccttggagctttagggaagccttggagctagaaaccatatggcagggggtacagagagcaaggagaaagtcgacttcctggatgacacctctgggttctccaacttggcaataaaagaaagaaaaggatagaagtgagagtacttgcagggtttttaggagagactcaagggatgatttcagtgaatagattttcaagatttcggggactagagagaactggacgactgataggcttgggggggagaggggtccctcatacataaggctaagaagacaggttagatgcagagaccattttgaggttgaggaaggagaaaattagggaatttttttcaaaggtctgataaagagaaatacagaaatgggaggcttctgttttggaaggttttgagttagctgatgtgggagaagctttagggacttagaaataaataaaacaattgctgagcactcgagagacttgtgtgcctcttccacgacaaattaatgaatttaatttttctacaagtcttccataatagaatgaaaaattgtgcctacttaactccttatgaaacttcaatttaattctaattcagaactttaagaagccactaaactttataataactgttgttcataggctgagcgctgtggctcacacgtgtaatcccagcactttgggaggccaaggcagctggatcacttgagatcaggagttcgagaccaggttgaccaacatggctaaaccctgtctctacaaaaaaatataaaaattagctgagtgtgatggcgggcgtctgtaatcccagctactcgggaggctgaggcgaaagaattgcttgaacccaggaggcggagcttgcagtgagccaagatcgtaccacttcaccccagcctggatgacagagcaagaatctgtctcaaaaaaaaaaaaaaaaaaaaaaaaaacagttgttcattgcccaatctctttaattattatactaaattttccccccaaatttaaccttaccttttaaaagaattgccgaaataagtggtcatgttgccaacacatcctctccttctacttccaatattagtagcatttcagaattctttacttcttgaaatgtttcctctggatttcccaaaacattgggacactatagcctctatcacctacacatgctggaactatacctcacacgtgtttgtgctgttctcactgcctctgaggctaactaacgccattggaggactcgtcctattcatggatttcatccatgattcattttcctcattatatttttacctattttcagctttttgccttgttaattatgtacatttgccataatttcacaatggcattattaaaacatcagattgtccaaaggggaagctaaatggatgtcataccatttagaacagagtttctccttcaatcactgcttttatttatgaagtttagaccttagaatcgcctctgtgcaatgtgagagtcctcccctaaaactctgcaaagcttcttctgagtcacgtcatggcatgcaggagtctccaagcgggaaaggttgcttttgatggttcagccagttccatttcagtgaagggacatcacttccctaaaatgaaccccctcttggtaaacgttctccattttctagcagagtcaaaccaaaccagagagaggcacgttctgggaagtaagttctccagtgtttctaaccataaagctgggtttctgaaatccaagattactcccagcagggagcctaaatacagcctgaagctacaaaaaataagtatccctattttacctgtgatgtctataaattgtgaccacttattttcattccagagtcatactttgtgctgaaccatgaaaagcaaagctacatttaaaattttaaaccataagctattagagaagggtaaaagagtctctttgtgttaggatttcttctgtctaaaggtaggaatagcagttgccattctctgacataaatagctctcatataatacctttcagggaaaaaaattgctttaggacaaaataacagtcactactcctttttcccgtgcatgaactttggaacagaaaaataacattaacaggttattaaactgtttgtcaccaaagaaaagtagatggtatttttgtgccttggataatgttaagtgaagaaaaaaatcatcaaagggatcatctgtacttgccctgctttcaaaattactttttctcttttcaatggaattcacgactgttcttggttttcagacttgtgactttgttcattagagcaaatggtttaatttttattccaaactctagattaagtttcagagttcagcctgggagaaaggaactattgaaaaccttttctgtttccttctcttttttcttaagggagggctttggttctcagagaatatcaaattccgatgtcagttttgtaaataagtatctgttgtctccccagatcaagctgtgtttgtcttatttgtacatttatagtaaagtaatctacaagtggttccttgataaagttaacacttagttaattacccagagccttgacatgtcctataattgccacttggctaacaaacatttgatacttgtcttgggtagaatttgttgaggcctaaagaagtaagctcttgatggatggggaacaaaccaaataaatacagtattttatgttcttttaattcagggccaagtggatttggatgaagtgtttatttagtttgctggctgtttcaagatgctgtggcgtattgattccttttattactagcagccgtttaacctgacctcttccagatccagtattttaaaagccataaattttaactttacttatgagcaaaggctgaaacactgtgaaagcctttttattagtcgagctctgccattttcgatgctctggtgtcacccatggcaacaatatttagggcttcttacattagagtggctgctgggctgctggggaggggcataggcagccataaaatgaagccgtaaacatttcaagggtataagattccatgactgtgatagcagacaggtgcaagaaagaaggggcaggtctaaagacaaaagggttggggatgatcatgttaaataaacatctactttagcatctcaggtactgaaaagaatttgaaaattagaaacagaataccaggtaatcatagagcaaggtggagccagggaccaactcgagtgacccatcttgtaggtcccacactgcctaagtcattttctggtcttcatattgcacacaaaagttctctgaaaacgaagttgaaagaaagagaccttgttccagtgaacagttagcaaactagggagatgcagtatttctgtcccaaagtcccaggcacacccttaatctctgcaattgtaacaaaccaggaaatccactttttttcctaagttgggaaaatacatgcctcacatcatagactgatttgtacaaaatatagtaaaaactttccagaatgtcagtactttacttttctaagacactatataacctgcactcggaaggcaggcaactgttttgtatcaatcagcaaatcaaagccatttcatcttcaaatagcccagtgatgaaactcctgggcaggttgtctacattaaaagtacctgtttttccataaaaaagaggaagaaaaagaaattttatacatgagtttacccctgaaatggatgagtagatgagaatgccttgtagttgaagaggaagacaaaaagaaactaattctacttgtgtgtcttcctggttttaacttacacacatcagtagcttttgttcactttgttgaaaatttcccattcgttttctaattatcaaaaatgtttttttaaacaaataatttttttcaacactagccctctttttatttgatcatgtggaaaaactcttaatacagcattagggaggttatataagcaaagaatgatcatttcaccataggagaaaaatccaagatataaaaggatattgaaagaatttaaacaaaaacatcaacagaagagagatactgaatgaagagatgttcccccctttcttcactttatatttctttgcaaagaaatttaatccaaaataatatgtgattggacttggattattatttcatcttcctggtctctttcttttcattcttgataacagtgtacttgagcatccttatactacctattgccagaaactgccctagccttttaagaagccaggtactcattaattcaagtgatgtttacaagttggctcttaatatttgtctcctcttcaggtattccagtggcttaaattaatatatatatatatatttgtatgtgtgtatatatatatttatgtgtatatatatatatgtacacacacacatatatatttaaatttcttgctgttaaattgtttccccaatcatgtttcttagattgctgaaatagaagaaactttcttaagaatttgagaaagtataaatcagggctgtaacatcaggattttatcttctttcagttttataaaaatggcccaatctcaattagatataggtcccacactgcctaagtcattgtctggtcttcatattgcacagaaaagttctctgaaaaggaagttggaggaaagagaccttgttccagtgaaaaattagcaaactggggagatgcagtattccagagaacaaaaagaaggtttgggtgttatagtaaaagttcccacccaggttcccaatcaggtctgtttatgcaaatgagagattcaaacttgcttagttctgactgatcaatacagctgagccctggttggttgatacagcaaaatcctgattggctgaggcaggtgagctatgattgattagttcaggcaaattctgaaagttccagagttaaaaaggtgtggggttttggggaacccagagtaagaaagtgtataaactctattcagcaaatggctgctccgctctatcttaaatataggcccaattagccactcagaattcatcttgaaggattggttctttcagattcacatttgttcacaatataaaaactaaacccttcagagtgtgagaatccttacactattcctatggctagagacttctgtcctagcaattcaagaagccaaactttttttgtttgtttgtttttgagacagtctcactgtgtctcccaggctggagtgcagtggtgcaaacatggctcaactgcagcctcaatctcctgggctcaagggttcctcctgcctcagcctcctgagtagctgggaccacaggcgtgcataaccatgcctggctaatttgtttttattattttgtatagacagagtctcactttattgcccaggctcaaacattcttatgaattcaagtccctaaatgcaattcaattcactaaacagcagcataatgtttagtcttttctttttctgtgaccttatttgaatcaaaatggacctgaacactttcattacccaaactatggtctgatcagtattctatatcacactcctcctattgaataacagtatgtagaatttgaaaattgttaaaaatacttatagcaaaatatacaaaaacaaaatttaacctcttaatcatttttaagtgtacagttcagtagtgttgaatacattcacattgttgtgcagccagcttttactgtaccagacatgctaataaactcccctcttccctgaagtaagccagcggcctttccacccagagcagctggtgaatttgatgatcttgggcagaatgctcccctctacccccacaggagggaaagcagctcttaccttggggaagttactcagatttctagaaaaactttctgtaaggttggctgtcatggtgtgaattaaaaggttatgtcagaggttaaactatgcaattaaatcaagaaagcagattattctagtagctgacattaacgtttgaaaagagacaggattagctgtacttagtcacatataaactgcacaaagcgaacaaaggggaaaaaaattatttcaccaagcttcccttgaaagaaaatcgttccatcttgcacctctaatttttcagcttaattctgttacttcatgaggttcattatccttttccagatttgcacacggtgactgatgctctgtgacgggttgtttttgtttttctgctttaaaaaatattccctccctccctaaataattatctgcaaattaaccttttctcttactggaatatttgttagaatagaatatagaaaatagaaatgtgtaagcaagactgtttagacaggagataaattctttgaggccacaagggtatcatttattaaatgactgctgcagtcctctaaatgggccccttttgacctgaaagagttaatgctctattgaaagtggctgggttgtccccagccttactcccttggaaggctctgacccattaatggcggtaataataataatagaaaacaatcctgctttgcttccattactctgaaactgttaatggtatcctaatgttttttattcttttagtgtaactgaaaactgacattctgctcagctaaaatttcaaatgtagtatttttttttcattaccatttttacatgccatgcaggatgctgagtgaggaataaggcagaggcttgtaattggtcttttaaatcatcataaacatttatttttccccccatggctatatctagtgccaataactcagtcatcaaatgatgggaaaaactgtttaatgatgcatcacaagctccttcctaaatttttacccagaacaaggcagggaatataaaaataagtcacattgctcaaaagttgattttaaaataagcacaaaacagtttttttttttttttgtgggagtattagcagtgaaccaagtgttcctttctttttttgatataaaccctttttagaaaagccttgtgtttttatatttttattgtaagtaataatgaaaagtaaaataggactctgcaatgtgtggggcagaactgtggcttctgttttgggaggctgacgtttgtaaaaggcaggtaatgatattacccctctgtgggactgtcaagacaaggcaaagcatttggcacagagactgtaccatgggaagttctaaataaagattagctatcattattattattattgttgttgttgttgttctgccagagcaaaacatccatcccagtttagggtactgaggcaatacccactcagagcaattgaatcctagctagggcatggtatagatataagtccctgccttgcctattgtccatgtgcattagagtgactatgtttggatccagggtcactgacttcagaggccccttattgccagtgggtgtcataaacctgtttatctggccactaaggtccttgttggtcttttcccattctctctgttcaacctcattcctatactcccaggccccatgagcactctgcagtggacacatggctgggcttgctgccccttggcaggccgatgttctccgctgtcgcccactctgtctccaggaccatctctgtttggtgctgctcatattccaaggatctatttcagcctagagtcatcattttctcctctgacttctgccactccctctgtatcttgccacatcccaccttgtttgggatgcttttgagttttgcattttgaccttcatgtagattgcttgttccttgagagcaggtgttcacaaagagatacccatattgtcttttgatgagctgagtccacatcctgcagatgtggaggaaaagatcctcctttttaattagtagcaacatattacgtgtatatagagtacactgcagctttgtgaattttttgtacatacataatttcatcttataataacaaatgatgggaaaaactatttaatgatgcatcacaagctccttcctaaatttttacccagaacaaggcagggaatataaaaatatatcacattgctcaaaagttgattttaaaataagaacaaaacagtttttttttcttttttgggggagtattagcagtgaaccaagtgaaacttatgagactggcatccctgttaacttagacaagttactttatctttgcctcaattttctcaactataaaatgaggataatattagtgtatacctcatataattacatgagttaatagatatatataagaatgtgcctggtacagagatagctgctgctatttttatcatcatcattatcatcatcaatatgatttttccattatcccacttttactgatgtagaaactgaagcccagatgagattaaataacttccttagattctaaacctttcaattccaagtccccactgaacatgcctcctatatcaaatcttgttgttaagcaccctagactgcttttagtccatcatttccttagagtcaatttacagaaaagtttctaattcacagtttgtctggaaatttctgtgaaagggaaacttaaaacaaacacagtgataaaacacaaacccttctccagaaatagataccctcttcctgggagacaggtctctctcctcctaaatgagaggcctctgttgagtagtcatgagaatacctatgggaatacctagctcttaaaagtgatatcagatttcctccaatctctctaaaatccagacaacatatttaattaatgtcattgtagataggttgtttgaacccctggtcaaccatagcaagaattgattttacctctcttttgaaagccattctatttttctaaattgtctaaccattggtagtatgtttctacttattactaatgatctgaagaatggtcctctcttcacaaaggagtcaggggtcaaggtgagcaaaccaatgtaataaaactcttcttgatgtagaagatttgtcacttgtaaaatccatgcagcaacagactggaacatgcctgtctataagctggtgtcagacacacttctcactggtgtggttagctctgtactcaccattccttcaccagcagtctgccctgttactcaagtgtccgacctgagcagaaacaactggtggtaacatggattgttatgtggatgagagattggagaatagaatatgaagtcaagactgtgagttacaatggaaagaaaacaatttcaaactagttttgcaaagataatttcttgactcctggcaactaaaatgttcagaggaacatccacaaagaaatgtagctgcacccagggtctccatgtcagcagtactctctcgtgcagttctggttcctctcttcagacttgattcttacagaaaagcaagatggctgccagaagctccaggcttagattctcccagtaaccccagtaacaaagactgctcactctaccaggcttagttctagttagccctgtgtgtgtcagtagctgtcccagagctcaccagggggaagaaatgcactgattagtcatgtctgggtcgtaggcacactgaatgagagttgaggaggcatagtacaccaaggaaagccaggatgctcattttagatagaataatgggtgccggctaggaaaaagaatggatgtcagcactcgggggagaaaagagagacagtttaggataagtggagagttgtgacactcttgctgtttctctgtgcgcttctctgaggtagagtaaagcaagtgtttccatgtaccctgacatctcagtacaacccagcaagaatttcagtacaagaaagactgatcatagagttccctgagggaaggttattaatggaagtatcaccttcttgtaaccttgtttcccgctggcaaagattcctcaggctgagttactgggaaactccagtatgctgtcagatttcacaacaacattaagtggtacttcctttccatatttgccacctcatttattttgtgtgtccccatgttattagttttactgcccattaatcattatatattaccaaatatagtaaagcgtgcttacgaggagatagcaaagggtccggccatgacagtcacaatgaagccatgccaggaggaagcctaggggtagcaggcagtgccccctgtcccgtccacccagacacataaccctgagcacctcctggctcccaagtgcattaagatatgttcctgcaccctatccctcctcgtcagagaaaaacctggggaaaatagttctgttcattttgaggacagatgactaaccatgctaaaaatgtatatgaagaaattagaagaaatttgaaattgtaaaaagaaaggaagagcaagagattttattagcaatgagttccattgctgcaaaatataccactctctttccctttaatttattctatgtgtgtcttccatattattttttctctgaataccaatatcatcaagcgtttactctggtaaaaaaacttcatggctttctattgtcccctaatttgggccttgccttcttagccagatttcaaagcccttcatgcctttactttatcctttctactcatgtttatttcccaccaatctctaccacattgttttttgttactagtcactccatcctcccggtgtccccaccccccaggagacgtgtttggacttttcctcatgccttttcctctaagtggtgtgcctgtccacctcctacttctcttacctatatatcatccatcttcaaggatatgacccacatcatgcataaagtcttactcagtgacttaaagtcacactgtgctttcttttctctgacttctgcaagcctaaaatactccagcccttaactgtgctctatgtcagcattcttggtacgtggtttgcagagatacctgctggccagtgatcccaaaagtccatgaccttgtctgatttgtaattttgttgatggtgtcatgggttagtctgatggagaagagtgaaagaaactaactagttctttacttgctgtccctggcatggttattctcaggaaattgttttagcatgttacttcttcatgaaaaatatctttgcaagaaataaacaagtttatttgggctactaatagaagtaaaggagatagaagatgatttgaaaagtgataagaaatcttagaccaaaaaaagtagaagttttcaataaagagtgaaaattcagagctagtaatgaccctgtcctacaatgtatgaatagggaagcagaaatcctcttgccattctgtgggttatagagaatcctcctaatgggtgtaaattttgttcaccaaaaaaaaaatatgatgctaagcggtgacatgtactgaatatttgctgttgccaggtatcatgttcaaagttctgtatcagataatcttccaactaccccataaatgaggttctatcattatctctgttttacagataaggaaactgaggcactgagaggtaagagcctcacctagagtaacacaaatagtatatgggtggagctggggcataaaactgctatggttgagtgtgtccccaacaagttcatgtgctggaaacacagctcccagtgcagcagcgtggagataggtgggacctttgggagatgactgagtcatgaggcctctgccaccattaacccattcataaattagtggattaaaccattcatggattgatggattaatgggttattgagggagtgagttagtaatcatgagaatggtgtattataaaagctagtttggccatctgtcatgagccccctcaacgtgtgatgccctgtgctgccttgggactctgcagagagtccccaccagcaagaaggcccttaccagatgtggcccctaaaccttggcctccccagtctctagaactaaaagaaatcaatttcttttctttatacattacccattctcaggtattcagttatagcaacaaaaaacggactaagagaacccaagatgtctaatgtcagattgtgcttgtaatagcaattgctttaaagagtaaattatgagtgaatgccagagatgcaattaattagctgagtaaacaggtaacatggctaccattggaaatatgaatccagataaatccaggtgtatgtacgaacaatttattttctaaaatttggggacttgtattcccctgagatgggtccttcttgagctttaaggatctcctatacattctctggtgttattagttcatgtgtgtttatctttgctctacacatagactagaatgtctttgactaagctaggtgtttaatcttttatttctgaggcagcaaagaaaatgggaggaatttcagctcaaggtttgtcagaccaggaaagcctcatatagcatctgagtagccttgccaagtcaataggatgacatttccttgtatgcactctcagggaacttaaaataagaattgaaagaaggttgagtgtttgttctgaaatttacatgagatgtaggactgaggcactgcctctcaggaatgtgaagggaaatcacaaaatacctttggaaatcccctcaattcaccatagagaatacaaaattattgtttcaaagagatagccatttcatcagtcaaacaccgatgaaatagttggcttgtgtttgaagatagtgacacattgctatagacaaaatgtttgtttcccccaaaaaatcatacattgaaatcctataccacaatatgatggtattagtagatagggcctttgagaaattattaggtcgtgatgctggaaccctcttgaataggtttagtgctcttctaaaagaggccccagaaagctcttccacttgagaatgtggcaagaagatggccatctgtgaaccaggaagtaggtcctcaacagacactgaatctgcctgtgccttgatcttgcacttcccagcctccagaacagtggagaaatacatttctgttgtttgtaagccagtttatgaaatttcattatagctgcccaaatggactaagacaaaaattggtaccaagaagtaaaatgacactataacaaatacctaaaaatatggaaacagctttgaaactgggtaatgggtggaggctgaaagagtttttaagtgcatgcttaaaaaagcccacattgtcatgactgaacttttaaaaggtgattctggcaagggctccaaagcaaaacaaaaacaaacaaaaaaagcaacagcaacgacaaaaaacaccaacaccaccaacaccaccatcacaagaggagagctgtaaagaaagcttcgatctctgagtcttcttagatgatacccacataatcttgaatagaacgttggtagaaatatggatggtaaaggccattcttatgaggtctcagatggaaatgaggaacatgttattcacggaaactggagaaaagaccatcctcgatataaagtagcaaagaactttgctgaagtgtgttgttctggtgtattatggaaggtagaacttgtaagtgatgaaattgggtatttagctgaagctatttgtaagcaaatttctctgatttctctaaaatccagatagcgtatttaattaatgtaattgtagatagtttgtttgaacccataggcacagcctggctttttctgactgcttatagtaaaattcaagatgagaaaaatgacctaaagatggaattgtccatcaaaaaggaagcagagcttaaagacttaggtaattctcagcctatccatattgaaaagtctgaaaaagcctgtttgggaaagaatactaaggatgtggtcaaacaactgtttgataaggagattagtatggatcagccatctcagcagaagccaggagctattctccaggacaatggaagaatgactctgaaggcaattcagtgatcatcaggacaatccttcctaccaacaggcccagagtgcaagggccctggagacagagtggtgtcaaaggaggggctgctggtgccctcaggacctcagtgcatgctgcatagggcagccaaacaccactgggttctattccttgtgctgtagtgtcaaattgcttggacaccccaggtagagctccagtgggacccagtgtagcatgggtcacagaggctatccctcccaagggcacaggcagcaactttggtggcatccacacaatgccatctctgctggtgcagagagctgtagtagagccctcatgaatgggattagtttccttataaaaaaaagactcacagagagttcccttgacccttccaccatgtgaggacacaatgagaacacaggcatccatggaccaggaagcaggccctcaccagacaccaaatctgtcagcaccttgatcttgaacttcccagcctccagaactgcgagaaaattccattgttgataagccacccagtctatggtatttttgttatagcagaccacattaactcaggcacacatgaaagctataaatcttgaaacacaggaatcatactcagggtggtgagatgctcagcatgagagaggcaagcaaagacccgcagagaacaactcatttctccaaactcctgttccctcccagacacacagtccctcaagggcacactgtcattgagatggaaggtaagtgaaattgctctcattaagttattttatcctgcccatcctcccacctttttttctagttttctctcatcatgaacatacagttgaatttgggtaagatcaattgtgtgtgattagacttcactttgtacaggaaaaaaatttagtgaactgtaaagccacagaaaatgttagttatagtcacatttatcttccattcctcttaggaccaagcacagttatgagccacaaaaaatacccagtaaataattgtcaacagctgacttgattttggcttgacattttaacattagattgaaaccttgcttaaagtgtatttataaagaaattgttattcatatgaacatgaaactgaaaaacctcactttctatcagttctgtaaataactcagttattgagaattgaaatgctcttttttttcaagtacaatcggatagatataaaaaggggaaaaatacaaaaaattataaaaatagcatttaaccttaaaaaatacaggtgcccaggctatacaatatgtaaagatacattcatatatgtaccctccaagaaatcaatcaaacattgaccttttatgttatgctaatggtttttgaggaaacattaaaattctttatattatgccttattttgagagtactgtcatatacaacccacataaacatacaaaccactcaacaatcaaaagcagaagaaacatttactgttttagcaagacatacaaagagttaatggcaaaaggaaagagagggaaaaaatcaccgcaatggtctgtgtttagaatataaagcctgttaccaaggtatacaaggaggagctggaaggcaaataaaggtgttcttggcagtaggtaaaattaagactatttaaagcacacatgaggtggaaatggcagaaaacattaatattacaaagataagttaagcaaaaggaacaactagtatgcaaagaaaggcaaaatacagagatgaatgaataattatgggtagggcagtaattattaaatcattgaaagtatgtaaaagaacctaagggttgtattaacaaagaagaggaagctgtatgtgggctttgaggaagtgaagcaattgtggactgtttctccatgtaaaactttgttcagtctcacagcactgaagaaaaggggcatcccagtgttgtaagtaccctttaccttcatgttccttttttcctacaacaaatatttgtgcagtagatctctgtactgaggatagaaaaatcaataagtctaggaaaggtaggtaacattttttgatgctgtatcacaggtaggaaaatttcccacactggtccatttatttgaccctcaaatgagtattctattacttatttaaataataaaggtagtgttttcctataagtacccacatgtctcttctggagaccaatgctgtgtacttaatttttcagttattttcttgaatgcagctttttatttgttttttgtttgttcattttgtttttttaatccagtagagtctttctaagggaggaaagaatgaaaacaaaagattaaaacaaaccagcatgctgggaatggtgttgtctgggatcctcagttgccctaccagaatctacccacagataaggttatatatgtatctttagaaatagtttaaccactaagttgaaccatggagtatattttcttatctgtaagatagaagaaaaaagaaaaacaaaaatgtcagaatatttttggggtaatgaattcactatttgttacattttggggacataatctgagttcaggaaagaaacctaaacaagacataaaattttgactatttgtttgtgaaagaaggaatttttagtaaagaaaattaaagtatatagcaatacttggcaaacatttgaacacacttgaagggccatgctcatactcataatcaaggaatttatttgttcacataatcttccgatattttctctggatagtttcactttaaaataaagtatttggagatagggtaggagagattatgcaaatgtatgaatcttaatgagaagttcattattgaacattttgatgtgaatttcaggaaacgataaaagaccctgggatttgtgagacttaaaagaaaaattccactcttggagaacttggaaattgccagtaaaagaactgagacccaaatgacagcagataatgtaaagccaaattgcattatgccctatggtaatgaataggaaacagggcactgtgataagcttggaatgatgatcaatatttggaacactgtgataggcaagaaggtaattaggcccattatgaacacagtgaacacagataacataacttgggaaattatacatttggatattatggagaattttttaaaggctaatggatttgcaatgatatcaagtaaagcatataagacattttgcctctaggaaatctacttaaaaaatcaaacagaaaattttcagtaaatgtaatctaaaatgaaaagacaaagtgaaatatgtgggagaataaagtggtattgtgactcctacttggaatttacaataattttgtattcaaagagttttacatttattaatttcacatcacaactccccatgcagcaggaaaggcgtttctattgtgtttgtccaagttgactgctcataataaggcaaggccaaattgataataaaagcaagctatcttgacaagttctcagccttcccaggtctcatgctgtgacccctggatggcattataataatcttgatccctaatttatgatgggaaacaatccctttattttagaaggaaggattgtaaattaattaattttcactaagtgccgtgagggccattgatgttattggaatgtacaaattaatacattatttattgttaatttatcataagtatttgttaattacaaagctctagctggaagaaaaacttgccatgtatctggaagtgaatatcttccctaagacaatttctcattttttaatatggatgtattggaagcaatttcatcaataatggaagatccaattactggtcttctggattaagacattcttttattgtgagatttttaatgctaaagtgggaagttcaaacattgccaattaaatctcagactaattaggtgattatagcctaaggagaagggcaactaagactccactattaatctatcttatcacaatggcctctatatgtgatgaacagatgaacatatatatacctgtgtcaaaagaagaaatgtaaggcattgtttgaaaaaacaatttcaggagtttaattgttttaaaaaaatttaaggagttgtttccctttttgaataaaaagggaaagcattttttatgaagtcctttttagctgtttgtagaacgcatgatcatatttaagaattcaatgatggattgaaccaaatctaagatttccctcattgaaatgtttagaggtggtacaaaagtgactgtgacagtaatgatcaccattgctttatgagcactcacgatgtgccaggcacccttctatgcttttcttatcctcaatatgatagctgagggaactgaggcacaaagaggttattaactcaagaagtaattagcagggcagggaatgtttggatattctacagcctccttttaatccttcagtattaaccactaccctctagacagttttattctcaattattcaaatcatctgcctgtggagaagcaacagcagtgctcagctgtaaggcaagggcaggaatccaagactgagtcagagaaactgaggtccacatccaaactatcctccaggaaggaccttctgtttcatagcatgttgaagtgaggctttctataatacctggaaggctggggcagcggtttctcagcatcttaagaatcagtttcatagtggcacctctccaactaggtggtagctctctcatgggcctcttgccaccctttttatgcctacaggacacatgggcattttgcctggcacagcttaactctttagtcttggagtgtgtttgtgtatgtgtgtgtgtgtgtgtgtgtgtgtgtgtgtgtgttcattcttttcataacgctgtatttttgggaatggagggtagtaggggatgtatcggaggattgatctgtgcagaagacatgaccctgaaatttccctctactctatataggaccatgtcaagctaatccttcatttggaaacagatggaatctttaaaagcgctataacatctttttaaaaaaaaaaaaatatgtggcatttttttaatgaggccacaattttaagagaaaatttggcacctgacattaagaatgtttttattataccaccttgagaataatttttatgtgagatccttcttttagcacccttgataattgtgtgtcatctgtttcatgaatcttgtgtatgttgagctcatgtttgtgaggggaggatccgttcttctcgatcttaaagaacatggacatagaagccacaaccaatatcgcatcagctatagatgaaaatatgaagagtcatcatattttaggataacttcaatgggatcaattggctgaggttttgattttgctaaattactcacttgaaagagacctcttcttgagacccctggttttagtgaaagcctagaaaaaaaaaatgtgatttttgtaaatggtgaggctagacatagacagtgaatcttctcattttaaaagctgtaaaattttctacgcaccatcaacctaaactgaaattggtgagagtaggagtagggaagagggattgaaagtggcaatttattgtactccacacaatctttacagggagggtattttattccaagtgttttgttggaatttaacactgatgcctttcaattgacattataatcccttacacagcaggtaaccttgaccttctgtaggagccctcaaacatatgaaagacatggggatccctggagaaggtgcttgtcagagcccccagttcagtcagttcactgtacctgtaaatccttataaggactttcctgattttggttctcttctctaacatgagtccctactctacagctacattctgtgcattctccaggaataaatagaattttttttccaatcctgaaaactccagagtccacatttacaacctaaggactcaaccaccctttttgcttttaatattaccatgtattacatccaatagagttaggttgtaatattgcccaacatcagttagtacttctactttgtgacttctatttatatagagtgaattaattgccaactctattaatcttgcaaaatccatgaatccttaatgttcagtttgcttagaatgaggaacagtgtatttgtttcttcttagctatgacttcttgctgagcttcacatgagctccttttagataacgtgccttctatcttggacgatttattcactttcatgttccctggaatttattgctaaacgttgacgtgaatgcttacagtttgggctctaatgtaatctcctgaatggcaattaataaataaaagatggttactattgctgacagagaatcagggctttctcagatagttttcatcttcatgttttcactaaacttcatgtcagacatccctaggggctgatattataaaatattttctgtaaactccaaagcttttactattgcttctatacacccaaacctctgtgatgccttttgttttcttgtcagaaatcatcttattcaatttctgtttcttcaacttatcttccttcctgggaatataaaaaatatgcctctttctggatttaatagtgacatatcctcagtatttatgacttgcaagtaacacctgaaatttgtccctgaaattttttgtatttttttttttgcttagtcttatctctgttgcatttattgaatatactctgttgaatttactgaatactgaattgcacttaccctacattaatagccagtagggtttataaaatctagtgtttattgtcatcctgtatattgttcaaagtgcaaagttgtctcctataagttaatgatgaaactataacgcaacatccaatttttgcagtttgcctacttgacgaggctccagggttaatctagcctaatattcttattttagaaatgaggacaatgtagggcagtttaagttgtttgaccataatcaaatagagggtgcagagcaaatacatctttagacagtaaagtacatggtacacagcagaaaagctggaactaggctgcctcggcccagctcctggtctggatgcttattaagtgtttaactttagacaagttatgtcaatgctgtgtgcctcaatttctgaatctgtaaaatggggctaaaagtagtaccagtagcacaactataaggattatagtaagttactgtgggtgaggcatttagaatagtgcttaacacagactaagcactccatgcattattagctattacgattattcattatgttgactatttttaacacgttcggatcataggtaaaggtgtgtattgctatttcacttcacataggtatatatatacatcagtgcttttttgtacttcttttgtattccttaatgctgtgtgcagctgctagtagtagtgttcatagtggcagtgataatagaagcaaaaatagtgatgatagtaataaaagatagtgccgtttattgagccttgctaggtgctagacattgaagtaggtactttacatacataattcttaataggtactcttgtctattgataaatgacacagtcgttttttcccagaaatgcaagtagacttcatgacagtagtctccttcgtaactggaaaggaacatgagctgtggccctggtggaaaagctttgactgtagagacaagagccctgatagaattccttctgtcttaaagataatcctgctaatattatatattatatatatatatataatatatatatataatgctgctaatatttatataacctaatcctgttattgataattgagagactagctgggggtgggaatggaggtcaaggaatggagtgggagggggcaggtagagggcaaggcaaaccgcacaaatgaaaaacattatataccagaaaagcaatgattcaaattcagttgtgctctatattttctgttttataattttatattgcattaaaaggttgcctcttttctagataccaaataggaatacattcagaactatagcatcgacacagaaaagttgttttctttcttgctttgcttgcttgattgattgattaaataaatggcagttaccatacattaatagccaatagggtaaggtaaagtgtttaattagaaaaatcacagtcacttcaatgttcttttatttccatgcccagtatgttccttactaatcatatgagcaaccatggcaatgataaaagctgtcaggtgtgggagtgctaggacgatactggaagagaagctctcgtcatgttaggtgcttggtatgtttgtgtgtgtgtctgtgagtatgcatgtgtgtatgtgggtattctcacatatgtgaaatcactctcattcacatacatagtctctataaatagctacagcctttcaaattcataggtgtgtgtgtatatgcctatagacacacatgcatatacacttctgcatagagagaaatgtacctatagtcatattaaattttatcacagctttagaaaaggaaacagaggctcagagaagtcaaaccacttgttcaaggttacaaaaggtggcaaagctggagtataaccccaactcccacccacttaacaccccttttttgggatgtccagacagaaatattcttagaacaatagcattacaccacactgccccattagaagaggggtgaccttttgccctttcttttccagaatctccaagcaaagattttggtccaactctgggtttgaaaaagtccagctccttggagagtctgcagactgcagtggccgaggtcaggaagaatgaccttccctttcacaggccccggccgcacatggttcgaggccgaggctgcaatgagagctttagagcagccattgacaaatcctacgatggacctgaagaaatagaagctggtaggatgatatgcttccttaaatggcttcttcatctcattattatctgcaaatcatgggcaagaatgtgtgctcaactacagaaaaaaatgatttaaggatcacaattatatttttgatattaaaagtaattcattttcctgatatgttttgccctttggcttaatgaacatggaattggagaacacaatatgcaatttattttacagtgcaaggctaaataaatgttctccttcacttttctacaaggaccaactgtcatttacccttagggtaggagcactaagtatgcatttcttgacattctcattcgagtcattagaggcagcatcaatccaaggactccgactgcattaattgggtagaagcagttgggatattttgtactcaaaactctcttctcaccctgtttgtttcccagcatgcaggctttctgagctgatcaaggttaacaaggcagctttcagagagattagtgcttgaacacatatcaagcctttcatactaccagctaagcaaccggttgtccccactcccagcatcaagtcttgctcgaagtaaccagatttaggcagtcagatcttcaaagggcgcacgtaaccacatagaagggtagaactacagagtgctgttattcattcttttgcattttacatgttagcgtttctctgtatactaactgagtgtgcccctgaccatgggtattgattattttttctctgtacagacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgaggtatgggcctgctttgaaggcaaagttggttctcattttgtctctcctggtaaaatcactcctttgtctgtactcagaaaaaagcgcacgcttttcctcgtcttcagccaaatgcatacggctctcaattctgtgctcgttctctttctgcagaggcagaggagctttttggggaaagttacagtgatgacaggacactgtcttaagtttgttgtcaaagaaaggtcaacactatgccaggcacggtggctcatgcctgtaatctcagtactttgggaggctgggaggattgcttgagcccaagagttcaagaccagcctgggcaaggtagggagaccctattctttttttcttttttcttttctttttttttttttttttttttttgagacagtcgcgctttgtcgcccaggctggagtgcagtggcgtgatctcggctcactgcaacctccgcctcctgggttcaagcgattcttctgccttagcctccctagtagctgagactataggcatgcaccacaacgcccagctcatttttgtatttttagtagagtggagtttcgccatgtgggccaggagtcttgaactcctgacctcaagtgatctgccttgtctgccttggcctcccaaagtgctggggtttcaggcaggagaccctatttctaagaaaaaaaaaattagccaggcacagtggtgcatacctgtaatcccaagtactcaggaggctgaggccagagcatggcttgatcccagtagttcaaggctgcagtgagctatgattacaccataaaagaaaggccaatacttagtagaggcatggacaatgcctgcagtcctttgtaccaaagtgttatgaaaataaatacttcctctgacaccacagggaaagtgggaagtggggaagccctatgtgttacctctggaatacctcttttgaagcaggggagtcagggtagatgaacctcatccctctgtgactctaggtgtgcagtggccgggcctctgggcacatcacttgtcacctccagaggcactgtggtacaggggagatgtcactgggtctgggctctgatgcccaagtctggatccatgactccccacacatgagcaatggggcttcacacacattgcttagcttccctgagccttactttccttacttttaaaatgaggccagcatacttgctctactgacccagcacagttgtgagatatgatttcatatgctatacattcattgactagacggggctcaacatggcacagtcagaaaacagctttgtttcttctctccccttcaagtataaactgttgaggctgcctcttccacaccctgacatctcagctttctggctgatagctttctggtcacttttgggtaaaaaaaaaagcaacttgtttgtcgggggctaaaatatgcaatccaatataaatgaaagctttcttcctttctgcctgttggacctgaaccacaaggagcatcctatggtatggtgggaggcaggattccaccttctcctatttctcagtctttggaaccaggagacaaagacaagattcaataggataggattttacttaactggcattatctggtataatctggccatcaaggaatctttgtggctacttttgtggattttttagagtgctccttactataccagtcactaatgtaggtgattttcccactgacctatttccctaagcctctgacctcagacatatacccctgagtctccttaccccggctggtagacttcttggacagtgccagtttgagacagctctagcttaacttacagccacagcatctacctggcttattagagttcctgatctcccaccctccaaatgatgcaagtacagcttgttcccactgtaccgctcctcctcaccccaccatagagatgttccaaccagccttgcatcttcagacttctccagcacatcccacaccagctctgggcctcctcactccagaagcacacatcagactctcccaagaatgctgtcatgcatggggaagggaggaggcagtcaatttttgcaagtcacaaaataaacaggtaggaagtggggtgacaatctcctattatacaattacctccaaattccctaaggggtttacttgtagccccctcacttattttgttgggtgttacaggcagaagtacccctttctattactgtctttactcctataatttcttctcaaatcaattgatcactatacttctgtgggctgaaggtgaatgatgggagatgatggtttaggggccagtttggccacctcttatgaaacccttaggagatacctcatttaagaatgctgcgtgtatttattaccaattgttctcattttgtgatcatcagctgaaatttctacatagaaaagaaagttccatcattccatatataagtgacatttagggaatacaaataatcctcttagcagtgagccttcccgttacatttccagtgctcatgaaatgctaagcaaggttcctcatgctcaaaatcttgggagcgatgttgcccctggatgtgttatgacaagacttgctgcggtcctgctatcacctggggtgaggttaccccagcaggcctgatgtcataatagctatctgaatattaaaaaacaaaattttggccaggcatagtggcccaagcctgtaatcccagcactttgggaggccaagacgggcggatcacctgaggtcaggagttcgagaccagcttgactaacatggagaaaccccttctctactaaaaatacaaaattagccgggcgtggtggtgcatgcctataatcccagctactcgggaggctgagacaggagaatcgcttgaacctgggaggcagaggttgtggtgagccaagattgcaccattgtactcccgcctgggcaacaagagcaaaactccatctcaaaaaaaaaaaaaaattcagctaggcatagtggctcaggcatgtaatcccagcactttgagaggctgagatgggcaaatcacttgagcccaggagttataagacaagcctgaacaacatggcaaaaacccatttccataaaaaaaggaaaaaaacacaaattagctgggcatggtggcatgtgcctatagtcccagctactcaggaggctgaagtgggaggattgacttagcctgggaggtagaggatacagtgagccatgatcccttcactggactccagcctgggcaacagagtaagaccctatctcaaaaaattaaaattaaaaagaacaaaatttcagcaaattgagttctaacaattgaattggattttattagtgattcataaattggtccacatcccatctacagaatagaagggcatttgagtgagatgagcagaaggtgtgagcttcataggcagaaaaagactgaagaaagcagaaacaaggaacaaaaaaaggattgctcatttccaaattgcattccttatagggttaaagtagagggactttatcattccagctcatgtcactggtcctcctttgattagttgctgggaatctcctatattttgggaaactgacccatttctaagttcagtttgattatgtggcatgtagcatgagtgactccattctggtttggtctggtctgttgtggcctagtgcaggagctcaaataatggcctcccatacattttattgaatatgatctatagtatagtaaatgccagattgggacagatgtcccaatagacattcgtcctgatggcctctgtagactctgtccttccagttgccattttgaattttaaacttgcccatattctagataattattaggattgccagaatttatgaactgtgagttaaccatcttgatgataatgacaacatgtaattgcaatatatttagataagaattttgtctttgaagggatggagttgagaggtgaaaattacaggctctgcctacagactttctgagttcaatcctggcttctctaattttcacttctgtaacactgagcaagttctttaacttctgttgtctcagtgtcttcatctgaaacatgagaagcataatagaattatcatttttatgagaatcatattttattagatgtaacatggttagacctgtgcctggcaagcaataaacattcaataaatgttaattattatagtaaacataataatgacccctgaaggtgtctgcatcccaacccccagtacttgtgtaaatattttgttacatgacaaaggaaaattaaggttgcgggtggaattaaggttgttgatcagctgacctgaacataaggtgattatcctgcattttccccaatatacccaatgtaatcacaaggagccttaaagtaaaagaagacaaggtgactgtggaaatgaggtacagagaaatgtagtgctgctggctttcaagatggagggaggggaccatgagccaaggaatgtaggcagcctctagaaactagaaagggcaaggaaatggattctctctggggagcactagaaaggaatgcagcctaacaactccttgaacaccttggttttagccctgttgtgttctttgaaccactgtttgttgtaatttcttacagcatcaaatcaaaaactaatatagttatcatcataattacttttactacttttatgatatcatagtaatgtataaggaagagttttttctttaaggtgttaacgaaaaacactattaaaatatttaactaaaatagtctgtaaatataaaaactgttagagcttcacatatcccattttctagaatattactaaattaaaccttaactttatattttatttcagatgatttgatttggcatgttcatacttcattgcccataatacagtgctggttcttcccttttattgtcccatatattctgtattttcatgtagtagaaatcacaggtcctggatcctttagacatttagcacctcgggctttgtttctttccacgattttagcaaagttaagatctgaaaggtggtgtttgattttatcttctgtgtaaaaatagcaactgttttccatagccttttgcatctgagtttgtgagcatattggagttactgctacatgcacattttcaacaacaaagaacacaaagctgttaccattagccaacagattttgctttaattctcatctgttgctcagatgctattgacttagtttctttcttatttaaaaaaagattgattgctttaaggttctcttggagttagatgtgtgttttaagtatgtattattttttccgttatctgcgtttctcagatgctctcctgaagatagggtattgggatgggtcatgcagttataccatgtagaatggcacctggccaagggggtgaatgaagatttaaatcctgcctccctttcctcaccaaggctggcatcatgaaaatgtgaatgccttagtggtgttcttgttcttgtttgtgaaaagctaagtgtttgcacttttctgatattagctggtccatttgtgtcaataatatgtagtagcacagtttaacttcttaatttaacctactcttgatccttttgaaaaaattacagaggatgtctttaattaatatctttatacatgttgtctaattccaatatgcttatactttgttgatttcagaattatctccttgcatgattcaagtgtgattcttatatagaccatgaattattattattattgtggaaaaatatgcagctcaagagcctaccaattttgtagtttctctgtatgctctgtgcttaaattttttcattatatgtttgagttccatacatattgtgctctttatggcactaacctgcagaaagactgttcatgcccctttcagccaaagggtgaagctccagctcctttaaaagacaagcccattgctgtcagtcctaggccaccttcctggggcctagcagatttttctaggagccaaagagaaatatcctttgacaaagaaaattttaccttgtctaaagtggaaaacccagagattagtttctgatttcttacttaataaccttgtcaatccttatgttacttaaactaaattctgtcatagatttatgttcaaatccattttttttatataatagctgctgttgtctctttttgatattataggccactcacttcaaaaacctttgaactgtcaacttattttggacactgaatggaaaggtttgatatggttcagattcccttatctacaacttttataaaatttgatcctaagaggaattatgccttgcaaactcctttttactagactaatgaagaaccaagtacaaacgctgccaataggaacttcatctttgcttttaaaatgtgtttgcccatatcatttgattagtaacatttattgaaagccttgtctttgccaagcacattcataattatttttatgctatatctattaatttattgtaatcaataattaaacttatcagttaatttattaaagccctattttgtatcaggcactgttctaggcacttgacacacagcaaccaagtcctgctttaacagcacttttcctgtcttaataaaggaaggaaggataaaaacttttgagttcattgtggtgagattaaaacaaaaacaagcagccaggcatggtggctctcgcctgtaatcccagcactttgggaggccgaggcaggcagatcacgaggtcaggagattgagaccatcctggctaacatggtgaaaccccgtctctactaaaaaatacaaaaaattagccatgcgtggtggcgggcgcctgtagtcccagctactcaggaggctgaggcaggagaatggcgtgaacctgggaggtggagcttgcagtgagccgagatagcaccactgcactctagcctgggtgagagcgagactccgtctcaaaaaaaaaaaaaaaccaaacaacaaaacaaaaccccaagacaagcaaaatattacataaacatgtaaactatttgtaacagtggattacccagggagtgaaggggatattcactagatatttcagggacaatccagtaccccatcagctcgagggaatcaatggtcaatttacatggtgtcaagcaagacatccaggccatggctctcacggaatttacattccagtgaagggaagagaataaacaactaatccaaaataattgatacgattccaaattgtagtaggtgctatgaaaaaggtaaagcagaaagaatggtgtcatcccacccttggtgacggtctaacagcagaatagagtgcacactgcacacagcccaagctacactgaattttcagcagatacgttatcagaatttagcacactatggtactaaagccaaatcactttatgcctgcttttgttttcttttttgcaacttataaatatgggaaggttatttttaaaccaactccacatagagctataacaaaaaactaacccaaactgtgtctgttttagtacacaaaaccctaggatacctgcagtacacattctaagacaggtgggcattaatgtaaatggtgaacttggtttacaggtgattggatcaactctgttcctcctacctcatcagctggatattctttattgtttcttctcaactcagataatgcaagcatacctcaaagatagactagttcggttacatagtggagcatcagacaaagctaaatcatgaacccttgaggcaaaggtatttttaacaatctagaggcatcaactttttgttcctaagccttacagattttaaggcatatatgtttacttcattttattctaaaatatactatctattttatttaaactaggggaattctatataaagacatcctgctgtgaattattttaaaaagaacactcctacacacacatcacacctaccactaccaccacaaacaacacaccaccaaattagccaaattaacactgaacctagttaaaaatctgtcccttagaagctctgtggccttcactaccaccaaattaatgctgaacctaattaaaaatctatcccttacaagctctgcggccttcacgagtccctttgagtttcagtcacctcctcatcagcaaactaagtataataacacatcctgtccaggttgttgtaaaatttaagttaaacggtttaggtaagcaaagctgtcagtgtagtgcctaacttgatagacattacttcttatccatctatctatctatctatctatctatctatctatcatctatttttcattggaaagtaaaaactgtctatatatggtatgcaacatgatgttttaatatatatacacaatgtggaagggctaaaacaagctaacatatacattacctcacatacttatttctttcatggtgagaacacttaaaatctactctttttttttttttttttttgagacagagtctcactgtgtcactcaggctggagtgcagtggcgcgatcttggctcattgcaagctccgcctcctgggttcacgccattctcctacctcagcctcccaagtagctgggactacaggggcccaccaccacgcccagctaattttttgtattttttttaatagagacggggtttcaccatgttagccaggatggtctcgatctcctgacctcatgatcgcctgcctcagcctcccaaagtgctgggaaatctactcttttagcaagtttcaagtacaagacatattgtttttaactgtagtcaccatggtgaataatagattgcttaaatttattcctcctgtctagctgaaagtttgcatcctttgaccaacatttcttcaacccctccatagcctagcctctggtgaccatcattctattctctctttccatgagttcgacttttatacacctcacatataagtgaggtcatatggtatttgtctttctgtgtctggcttatttcacttacataatgtcccccaggttcatccatgctgctgcaaatgacaagattttctactttttaatggctgaaatagtatttcttcctttctttctttctttcttttttttttttttttttttttgagacagagtctcactctgtcatccaggctggagtgcagtggtgtgatcacagctcactgcaatctccgcctcccgggttcaagtgattctcctgcctcagcctcctgagtagctggggttacaggtgcctgccaccacacccggctaatttttgtatttttagtagagacggagtttcaccatgtttgtcaggctggtttcaaattcctgacctcgtgatctgcccgccttggcctcccaaagtgctgggattacaagcttgagccaccatgcccagctggctgaatagtatttcgttgtgtgtttataccacatttctttatccattcatctgctgatgggcacttaagttgattccatgtcttggctgttgtgaatagcgctgcaattaacatgagagtgcggatatcttctcgacataccaatttcatttcctttaaatacctaatggtgatattgctggagtatatggtagttctttttaaatttttgagtaacggccacactgttttccatgatggctgtaataatttacattcccaacagtgtagaagggctcccttttcttcacatccttgccgacacttatctttcatgtttttgttaataaccattttaacaagtttgcagtgatgtctcattgtggttttaatttgcatttccctgatgattcgtgatatcactgagcagtttttcatgtatttcttggctattggtatgtcttcttttaaggaatgatagacattacctcttgtcttccccctctggctccacttcagacagccaagaccgtcaaatattacctttgtctcaagcaagatacgtttggaacccactaactttttctttcagattttagattacctctaactgctgttttgtaatgtagttgggcatgatgcctattctctagcctagcataataaactacataaagaaaagaaatgacatagctaaaatcattcaatcatttatattttataagctttgggtcacccctttctcaatgtaaccatgaactgttttcaaaggttatttaatcacttggtgaaaagcaaaaccttctattgcagaatacaaatagaaagggtctcaaaaggataaaacagttttttgttttgttttgcttttctttctttctttatgtatttcagcccagagtgtgtaggtgggtttggacttggtattcttaatgcgtggctcatagttatttcatcaggctgctctgaggttgtcctgtaatacattacccataaagatacattttgacttggtttttaaattaggttagatagagactgaatacttaagtcaccagggaacatgacatctgtcatacatttctcctctttaccttgatcccataacagctgttacaggtctcatgtacaataaatgtaatgtggccgcagcctgtcattacctctttccagatagtgattgtaaaatgcctgggtatcccttcaactttatgggtatgaagggtaactgagccaatgtagccaggccaatgaaattttaacactcatttccccaaaggcaaaaggccaacaacaggctagagttaaggtgctttgcttcatgaagtagaggccggtttgaaacatgaaatttcagatgaaaaatgaaagccaaagtgggtcagagttcttaattcaacttcaagctaggtggagaaatacattgacaacagagagccttacagatcagggtaagacggctgcatacactgagactgagacaaatatatgaccatggcaaaaaatagaaatttgcatgtcgaaggccaccacccatgcagccatccattgttctccatggttatctacaattacagaggaaaagaaatcgatgctaaaccatgttggaattgagttaggctcaatttttatctctttggtaactctgaattttctctcttcagcccatcttaaattatttactttctctttcacaatgtgagccatgaatattttgtttcttcattttgttaatttgccaattttcctttgagctaaatgccctagcaattttaatttttcattcgggttggaaagagcaatgacccttttttttccattattactatcacaggcctgggcccagaatactactttttatgaccagcagtgttgagcctataatggaattgcaaagtagagagtataatatactgatattgacttgtgttaaacccagtggtgtgatcactgataatatttatatgtttatgtgtatacatccttgcttttgttggcttgcaactaagcaccagagagaagaactagaaccataatatggatagattgtgaacatgagaatgtaaaaaaatgagagagagtgctatgtgaatagggcaagtgatataaaatgatggcgatagatgcaagtatgataactaaaaagttaagtatagattaaatttagatcaagcacatttaggattgtttggttggcatttatttcttagctaaaagaggacccagagacagatgggctactcatctgatgggctgagtacaaagacagatgagctgccgtggcacccagcacacagagttcgcttaatatctgagtttaataatattttccagctgtcaagcatatctgcaaatgtttgtttatccttctgttttttgagcacatgttcatggaggggcaagggcatggatggggttaattggtatgaaaatgtacaggaaccttgttttcaaaatcatttaaaaatctgattgctgctgccatgccttcccctcctaccctatgtaatcttgattgctgtgcaactctgtttacggctgtccaaagcggtaaaatgattttgtcatacttatcacaataaaaaatgaccacatagagtgtcaaccaaaaggcttatttatttgattcaaactctcttctcctaatatgcgtgcacagctcccattaacgttaatgtgaattacaaagaacactgaagaaggatagacccctttatctcattacttttcttggataatgaggtttagatttgttaacagatcagaacagaagtccagtggataaaatattggcttaacttttaaagaaatggatatgctaaaaggaactttcataggcactaaggtagaagatacactttaataaataaacttcattagcatttgaggttaaatatgcttatttaagatgctggattaataaaatgcaaaatatttcctaatggacctatttgcatactcatattaaataactaataaaatatattaatgatagttttattcatatacatgtaaacattcctgagttcctggtgggactgtatttgcctaatttacattgttccgtgtccaggtcaatgtcatgtccttgtgggatgtttacttaatactattagataatgacatgtatagatttaataatttgcttggggggcaaatggaatccgttctttgtttagtaccttttatctgagaacttcaatgtaatttactaacatccatcttcaagatgcatgagagatgaatgtggcaaatagctttgctttgcgtataataaagaatgagacactgagaagtgaagcagcctcccgagagcctgtgaactgatagtgatacaaaaaccccttttgacttttgttcctatggtgtcagcatctaaaaatgcatggacaccaaccacgcttcagtgtatactttcttacactctgtagcacccatacttatttttgccatccgttggattttcctgacaaggcaacatcaaaccagcaatttagtaacatgagatggttcctaatgaagcaaggagacctgaatctttgaaataataactgtaactgttttcctcacagaatagaaaagaggtttcccagaacaattaaaagcagataagagatacatacattgaaaaatagataggagatatacaaatatttcattgcacattgaggactattatctcaatcctgctaaataatatccaccaggattttggagacagtccaattttgcttctccagctaactgctgatcatttctgcacagtggccctgccacaacctcagcttcaacatgtctaaaatctaattcagaatctacccatctaagtcaccagctcatcctgactctcccaattctgtttgaggcactgccaggaatcccgtgatgtccgggatgcctcccccttcccatctccacccttccgtcagtcaacaatcttgatattcacaaaatactgtctcttatatctggcccttcttttccacttccactgccaccactctaattcaatttgtcattgataactggattgttgcaataacttactaactgatttgcctgctttattcatttcttcattcctgttcattctaggcatagctaccaatcattcgtttgttcagttattagatatttaatgaatgctttccacacaaaaatgcaatgtaacgtagtagcaaagagagcagctctggaactattctacttaggctcaaatccagctctacttccttctagctgttagtctttcatcttacccactctgtgcctcagtttcctctcttgtgaaattgaaataatagcatctacctaatagagtggccccgagactaaacgagataatagatgataaatgtctggcacatagcaagttcttaaaacataatccattcatagtattctgccttgggagccgagatgtttcccagttacctagtggttctcaaagtctgtctgtaccctaggatcatctacagagcttgttatagattcctgggtttcattatcagagactctaattcattaggtttgatatgaggcctgggaatcgctgatgattgtaatgcagccagtcccagggacctctagaaaaatcatactatttagtttggcattcaatgccctctatattctcgtcccagtttgtttgtttgtttgtttgtttgttttagcgtttctctctccaactttccactctaaccagattattcactcttactctcttcactgttacccaaaacaagctttgtgaagccttaagataataccatcacttagaatgaccgtcttcccctgaggcctgccaggcttctgaaagccacctcaagccccatctcctttatgaattctttgatttgcatttctctccttcccatcaaattttttcttacagtctgagtttttccattgagtacttcctgtaggcctgcttggtttttagttttgagtttacacatctgtctcgtgcccttaatgaaattgtaaattcctctaagcagagggacttcctctgcaatgtttttctctgttttggcccctaataatcttttgctgaatgactgactggtttatatggtgtgctaattggagtagatttatttggatattaatgtgttgtgcccctttagtcattcttggtaatagtattgaaaataatgaaaacagtggaagtggttcaaaaataagaaagagggtgagctgcattgggagttaattatttttttttaatttctgcttgaagaaaaggttgaaggatgagttaactggcaatagtaactagctgttctccatttccactgaggacagtgctagagaaaatgggccaaaatcactaacgggaagaaatgaggttagatataaaaaagaagacagttcttaagcactggaatgaggtttctgaacaggttgtagaattgacctccctgaagtactttaaaaataggaaggataaatatccatctaaaatgatatgaaaaagatttgccaatcagctcattatttgaatatctattaagcactactctctgggaaaacccagaaaaaaatgtacaacatgatccttttacttaaactccgtatctaattaagatgacccataaatatgaaatcattagcagtgaaaataggatttaaaagtaagagctaaactgttaggttatcaccataattggagtttaaattcggatatgtgcccttctctacctctctactcctgaaaaacctactccaggcctttttttcaatgagtgaattttcagtgtcctctttccaacagcatttctaggtaaaatggagaaatctctgatcttttctgaaataagttattcaatactattgagcaaacaactgctaagtacacagcaagcatgttgtgataaatatgaaactaatcttttatttttttctaacatcgtcttttattcatccaacaaatattgattacctaataagtatagtcttagtacttggttgggagataccacagtgaacaagacagatgtcttttcattatactcaaaatctagtgcccacaacctttcctcaaagtgtggtagggcatataagttgtaatattaaaatgccataaaattgactaaacccctttagataaccagagcatccttgaattacataaatgatggttaaaccacttgcagtgtactcagtaaagatactgaatagtaagatgtctggatttccaaccttaattctgtaactgccttcttgaatgaaagtttttcttcatctggaagatgcatacttcttacctacctgcaatatgtgtataaattatcatcatggtcatcatgtatttggtcactgattgaaactgattacagggtagatatgtctatgggctaaaatagaatgggattggttagctggaaagtcagtttcacaaagtgaaatggcactgaattcaggaaaatagaccaagactattaacttgtcaaaatggaaaatatagcctttaaatatagtcatacacatggtgccctttggtttgaattagggtaaccaactcatcccactttgaacactgaaaatctcttccccaggaaactcctcagtttaaggaaagtgggccagtcgatcaccctattctgcatacccaattttatctgatccttcctctctcttcttccttccctcaccattctttgtttacatgccagtgtatatagtcataaaaattctctgaaaaataaaatgaaagttaaaagtaaatatttttaatgctacaaatttaaaaaccatatacaacaaatttaaaatgtatatgaaagagtggacagtataaaaggaagcttgagtgaacttttctgttatctgagtttttttgtgctttctttaacttgagctgctgtctgttctcctaaggctttcttggtattagaaaaagccacatagctctggaaattaaagtagaaatgtctcagcagagaataactaaaagcagcatcccacttgccaacaaaagaattcttaaaaatattatataattcaaaactcaaaaaagaaagagctggagggaacatcgaccagaaataatggttgcaactttgattgcagacaaacccaccagcgaacagtaaaaaccctaattctagggcttttggtatgaggttcctcccattgataggtttcttctcccccagggactgtaattttccactttaaatttgaactctagtcaatgtatagtaaaaaatcaatatcatagatttgttctgctttctttatgcctcctggaattttcaaagtatgggaatgaacagcttttatgaaaaagatggactataaaatgaaagatggaggactttgaccaatttcctagacctttgacccagaaacactataccagaccaggatgtcattgtcccctccctagctctgtcatgtctttgttattcccatactatgagggcattaaatgtcgagtgatatgacgactatcgcacttttggaaaggatctttgacaggttaactagaacttgctaccagaatatttgtcctgtgtatcctaccttttcattttaattttactttgctattttcaatacagcttctttccctatattgtgatggggagagggagaaactcacagaaaactaaagggtaatccctttagcatttaacatttatacaaacaatagttcttgcattgttaaaaacgagcaaaggtgccaaagaattattccaacaaatgcagacatggggacatggtaagtaattctcatcccctgggctgatcaaactccctttcctgagagttgcaatcctttgatcagccttctaactccacctcacccagcatcttagtgtcaacaacaagctcaggccacactttatggagaagtcatggccaggcctgattcctctagactggcattagagctagtctggatcatcttggtattttccaccatttttgtcatcacttgaaagacaagaaccacatcttaccatttttgtgttctcctcagtacctccgcctttgccacattttcccttcctctcatatcctctcacatatatggcctcattttcaggttcctcctggtcctctgtgaactaaacacagagacagattgattttcaatagcctctcccgtgaccttggccagcttggtataaatgctttctacatctggcatctggtcacccagctacagaattcaataaaccagtagagcactgagcaaccatgcctcttaaacaaagcactacctccctagcatgtcggcttctactctggaatccgctcccgtagcattgcctagaatcctcagtcctgcatgagccccactctgaagtccatgttcttagactagagcactggcatagtagagcttgcttatttctgatgggccatctctagaacacttgattctgtctttcaaccctatacatccacagttgtaggacctttttctttgaaccttgtgtatcttatctgactttaaagtatttatctgtcatttgccttccttactgctatggtctgtgtagctggcagagtatacctggatggactgcttctagactacctggctgacctctctaagtcagcctctgtgcttttgtgtgattttcctcgccatttttcatcctggttagtgggactctatctaattcccttccccagtgattctacaatgttgggcaccaaatttgctgctgttcttgccttgctcatagtgtacattcaacaatggattgctgagctaattcttgattgtgagaaatccattctggaaatagtaactaacaatcagtttttacttacagctgcttccataggctcatgtgacattcaaatgacaattaatgttttttctcctgtagttttttttcttttttgcccaaaatatttattttgaaaaactcggccgggtgtggtggctcacgcctgtaatcccagcactttgagaggccaaggcgggcagatcatttgaggtcaggagttcaagaccagcctggccaatatggtgaaactaaaaatataaaaattacccaaatgtggtggcatgcctgtaatcccagctacttgggaggctgaggcaggagaattgcttgaacccgggagatagaggttaccatgagctgagatcacgccgctgcactccagcctgggcgacagagtgagactccatcagaaagaaagaaagagagagagagagagaggaagggaagggagggaagggtgggggggaggaaggaaggaaggaaggaatgaaggaaggaaggaaggaaagaaggaaggaagggagactcaaatattaattctaaaagagaggaacaagtccttgaacactaccttgatcactggaatctctgctggaaggaaccctcttaattttggaaataatatgtgttagaatgtactagtgagctctgctcttcagttttgcattttaagtgttaaactctaaatctaactgtctatcatgttttattccataagagacgtatcagcacatagggaaatagtggtaggttataggatgtaatagaaattctaatagactgtttaacaataatatggcaggcagatgccattttaatcagcattgtcattaacaactatcaatagagaggataagatgttcttctctttgtgaattatgatttatggctggcacagcagtcacgctgaagtatatttattttacaatatagagacattgattaaatgcacatggcatctcaaatccagttgacattttaagtcaaaattattacagacacacagccattcatttaagctgttgctttaaaaatgtgtctcaactgattgttaatggaagaaagtctagctgggccaatatttcaataacttgttcctttattttgctgatatacatacactgggggaaagctgcctcttttggccataccatttctggtgtataggcactaaagagaagaatactctcttaaatacatacactcagggtttctagaccactcagaaagcattctcttactagtgtaaaattattttttgttccctttccatagttctccctaccttctctgaaaatcttgctttctagcctaacaatctgcttaggaagtaggtcttaaataattgatgataactgtagctaaaacattaatatagtttagagatgatagtttttgtaatatatgttgccaatagaccagccacattaaacaataaaagtgtttgagtattgattgttgatttacaagattgaaggaaatagtaattgtgtctgagagtatattctttgattcattttcttatttatgtctttttaacctcaaaacttagatttttttaaagtttgtattatgaaataattttagacttacagtaaaagctacaaaaaatagcacaaagaatttccttataccttccgcccagattcctcagatagtaacattttttctgaattagctgtagcattctctctctctttctctctcttcctctctctctttccctctctctctctctccccccgcccatatgaatgtatatgcacaaatgcaggcatgcatgcatttttctcttaataacttaacagtggttgcaaacttgatgtctttttatccttaagtgtactttgaagctaggactatcactgtatcattttattatacttttgagataagtcaagagttggcctcaagtaaacctcaaaatagcaaaatcagaaattacaaacaaggaaggtggtaatttcaaatatgattacaagtcaagaaaaccatttttgtggggtttatcactatctaatctaaaaacataaattaagtcagtgttgactcctggtaaatgagtacagatttccaagagcgaggtgtacttctttgacaattaatgaaacttcagaagtaaacctctgtaaataggtgcaaatatccttgtgataaagcgtcggtaaccattaaatttggtgcagagtgcttgaatgaaatggtgaacaggaaaatatcctgcttgttattgttaaaattgtgctgcagaaggatccttagaaattgaataccatctctttctcagacttgttatattttccattttactgcaaatgatttattgataagactggagggaaggctggagaagccataccagtctttgatcaccttaggactttttcttttcaacacctattcatttgaaaacatattttgaaaacataaatgcacaaagataaatgtattatgaaagttatagtggattcatccaagaaatttatactttgcctagtcaggaagagtggtctggagaaacagagcatactctgccagtctttttatttacatctgttaggtagttggggtgtattatgttggagtgaccactccaggtcaaagtcttgtgtcttgggaaagaagatgaagcacagtaatacaggttaggtgtagctggtggagggtgttgggatgcatatctgttgaggaccagcactttattaagtccccaattccctgaacattcacgccagctcttacaaaaaacaaagcagtagtatccatgtgtgttcctcatcgctggcctgtcccaaaattttatcaatgtgatgataacaacactcgtgcacatgaccacatattgctgaatttgtccatatagctaactggagatagtttgattctgggtgaaacaaacaaacaaaaatatgaaggagtagtaacgttctacagaatccttttcttccttctctgtgatgagatttaattagatagagctgctgaaatctgttctgtgcttgtgagttaaatatgtctttgaatgtctgtgccccaaatatctcccatgtaaaatataatacaactttatgaagcactttgaaactttcagccaaaagaaggaacgtgtgttgttatatcattattaacacctcttttttttttttttttttttttttttttttttttttttttttgatggagtcttgctctgttgccaggctggagtgcagaggcatgatctcagctcactgcagtttccgcctcctgggttcaagtgattcccctgcctcagcctcccaagtagctgggactacaggcgcccaccaccaagcccggctaattttttgtgttttagtagagggaggggttcatcttgttggccaggatggtctcaatctcctgacctcatgatctgcccgcctcagcctcccaaagtgctgggattacaggcgtgagccaccgtgcctggcctaacacccccttttaacattgttaaaattaaacaggtagatagcactgtaagtgttttaagaatgtggatatgtcatcacttttacagcttaactgtatgctatcagggttaatggtaaagacaatgtctagaaaacaaaccttatgtttccatgttcttggagaatccacgtgcagttacacagtattcatgaagcacatgtagagctcaacttctaaggtacagtcctgagattacctaaaaattatgtacagaattttaattatgagtatgtgtatttttgtggagaaagaatccataatgtttttctaatacgcaaaggggactatgaaaagaagctaaggaccattagataatgtaatctagcctctgtagactattgatgttccctacctgacaagtggctgatgttcttattcagccctctgattctttccactaatgtagtcaacatttagccctgaaggatacaaatctctgtcatgggagtaaaaatgtaaccctctgtggaaggaataatgagacataagagtgtctatctcaacacctttcatgtctcagggacatcttcgggataaatcctggtttggagataagtgcagtgttatgtctactgcagaagggtgtttattaaagattgtcttctttctagtactctctagctagatcccatcaagtgtaaaccaaatatagccctccccaacataagaattatgtttgtttttggtgaagacttttaatgtttgtatttacccatgcttttccaggatatcgtcaatgctgaggtcttctctctgctgtcacaactcagaccaaggaaattttaagtatgtttagatactttcttgagtttcataccccaagactgtattacacaccttcttttgtcaggggctttacagtgtctaacatagctaggctgtaatatcatacctggccattaggtgttgctacgtcacacactatgctgcaaactgaaaaatgatttagtttagaatttaagaatctgtaaaataaattcttctattacttttttaaatttatacatttaacatctttaatataagtgtacttgaagtaagaagtgggtatgctaaaataaataaaatatatagataaaggttacccatataatttcagtgtgattgacaatttatgcttagcctagtagaacaacactcatttttattaaaataaaagattaatacttctttaaaaacaaggatgtcctatttgatgcaaattactgttcaagaaagtaactgaaatttcctttcttgaaagggcaggccattagagatataaatagagttgcaggttaatatatcaactttctctttaaaattagtaatgtttaaaaataaattgtttcatttccacctagatcacttcctccttcttgacactattccagctgtcatattctgtgatattgttctctcagggcattcctgttagctttctggcagctactcctagctattcatcttattaaaagttgtcattccctatacctctatacccagtcctcctctcttctaaccctcctctctctttctctgggagagaaagagagtctgtaaaccagactccacccagactctggactcataatacatgatgcttactaaacggttttcccagatggtccgtaggtaccccaaaatcaacctgtatattatagaattaactttgcttgtttatccttaccaaggctatccaataaatcaagaggatgctgtgtccttttctctcacctgtgaagaccaatccatcaattcgttaccaagttccacaaattctactctctaagaatctaaattctctctccatcttcactgcacttccttagttcaaattctcctaatttctccccaaattaaagcaatgaccttctgaatagtcttgatattctctcccagcccacttactacagtactgcccatctgatcttcacaaacatatatttgatcttctaccaaaatttttgctgtggtttcacagtttcttgaagagcttagatttctgaggtgttatacaatgttcaacctttatacttttatgctgccatagataagtacataaaattatcataatgtgccatgacagcattaaggtagtcaatgccttgggcttttcatattccctgtgactacaatgccctttccccatccttcaatccacactaaccccgtggtcaactcttagtgatgcttaaatgctgggttcaagggttctttggaagccttgctgacaacaattctctccacactcagtactgataaagatagtttactaatatcatctcattgtttattagtagtagtagtagtagtagtctcagagtcttcctctattgcccaggctggagtgcagtggcgtgatcataactcactgtagcctcagaccccagggctaagtgatcctcccacctcagcctcccaaatagctgggattgcaagtatgagccaccgtacccagcttcatcctattattttgagtaattagacatcctatctagtaataagataagtaattttactggtgtcactttggaggtaactggcttcagataaggttattgaatttcatagtccattatttcaatttacctacaattatcagggcaaatatatagaaggaacaaaattgaaaaacaaataaaaataaataaaacaattgtgagagcaaataaacacaaaaacatcctatcatcgtagacttcattgcctgtgtatcttaatgtgaatatcatgtactgttttatcaagctttaaatctgaggaaatggaatctgtgaaaactgcctaatttgttaatttgcatgtgaagtatactgttaccagggaagggtgaaaaacggatttggcgcatgtagtttactaactctgagaggataactggtgttagtttctgctgctgtaacaaaattgatttggcctttattatacctcctattagaaaattactgtgaaaaaccgcatactgaaaatgtgagagcgctttgtaatgaagaatacattttatgtagcaaagcaggaagcagtgacaccaagtcttaatgacactttatattctgccagtgtacttagacacaactttctcaactgcataatctaaagtaaacaaaaatcttattccattagggacacaatttgacaattgaattttttggtgaacttttggcatccattgaaagaattggctgcaaccccagagatggggttaatctttttagggcatcattgcctggaaagtggaggagatgaccaagtcaggctctaggagtaaaagcattatctctatgagctagaacgaaggagttattcaacagttatcatctctatgaccactttttattcaattgcaagagcacagaaaggatattattttactcaagaaaattggggaaaaaatttacaatcttagtatgctgaggcttgatataattaaatgattaaaaggtaattaaataattacctttgtattttaataattccctatagtcttaggtcaaatctatgtggaagaatatcacatatcctaatgctgacagtatttgctgtcacatccacccagtttggaaaagggctcttcattaggggaaataagtagtacattcttgtacagtagtaaatacttatcatgtagcaagacagaataaaaatcaatattaatcagactagacaaatgcttctagtataactgaaattctcaagccctaagccctaagtgttctcttcggtgctatttattactaaaatatttgctacttctgacaccaaatagttctgtaatgtagggtctttaacttttgatatcttagtctgatcatcagaatacccagctctatcactgtatgtgttcttagggagaatatgaaaattttatttaaagatcttcagcatatacatgactgctattttcttaccttggcatcccacaatgaagctaatggaaaggtttagcaattctatgctgttgctcatttctccctgaaactttgactattcagcccacaatatgtctacctgtatgctccactgccccacctttatgaagatatggctgtatatttcagcttttcatttttatcgctaacggggacacacctgttcctaatgctacctaagattgtgctggtctttggtacattatagaggtaggaatagtatctaactcccttatattattagtgtttactactttataggtattgaaactgttctgagttctgtacatttgttaattcatttaatcttcacaataatcctatgaagtagccactgttattatacacatttgacagatttagaagctgaaacataaaaagattgcttgcccatgggcagatagattctaaacggacagaactggtaggatttcaccccagcagtctggcgccatactcctccctttttttactctttggctcttagctagctgggcaaacttgggtaactttaagctactcaactgctcattttccttttcaaacaaagagaaagagaggaataagctccacctcatagaattgtggtgagaattaaataatacagtgaatgtaaaatacctcactgactggtacatagtaaagtattcatgttattctttttcttattactatcaagcaatcaataaaagtcagatgaaggaattaactcatggagaggcataactcagaatcactaagttgatccttccagggtccatttttattttttctgttgaaaagctcatttataaagaatggattcagtggtctagcttggcctctttcctgaaagcattacgtatagggatcaagcactcttatgctttcttcattaggctaaagaaaaagctattataacaaaaagagattgcatttctattaaagcaattttaccaccaaattagacattttaaagaatatatagaatgatacatggaatgctatcagttgtcaaaacccccaatatttccaaagcatatatgaaaataaaagtcagagagaaactcattttatcatcttttaatcctaatgccctggttttccatttattgcattatgagattgacattatatcattatctcttattgtcaccttagccttgtaagctttagatgttgctaatgttatggtaataactgctacaatttgcaattttcagttgtattagaccttgattcacttttttaactacctcatataaccatcactgatttttcttgcagataataacccccttaatggtttttataagtaaatatcagtacaaaattatcagagcaagaaaatcaatattagaaaacttcttatattaaaaataacagaaatagagtaatattaaagtaattctaaatattcaaaaatcaaatgcatgagttattttgaaactagtgttagaaatttcatgatttggaacttgctagttcactgttctttttcgattttactacactttaaaaacactgtaacctatttttaaaaaattaaaaataataatacatatgggatcaccacagagctagtgttttttagaatgttttcctgtatttcacacaaaccatctctttccttataattaaaagttgtataatattgttcttgaaggaaccatatcatatgtcttctaaaaggccagtatgttgtgtttttatttcttttggttaaatgggccctaaagatttatcagatattaggaatatgaagtggcacagcagacggtgaaatagtatatcttttctcaaactttttcctcaatgcatttctactaccaatcaaaatcctgcagtccaacctcctgtaggaaattaaatctttgctaaataaccctattggcgaagctcttctatttctcattccccctgctccttctctggcatgccattcattcatctgataaatatttgttgagcaccaagtatgcacaggcacggggtacagtgatgaatgagatgcacttctacccacagagaacttaaaatatagtaacttgtcactgactaccttatatcactagttatttttcatgtgcttatgtcttacagagagcaaagactacaatttaaaattattttactttctgtatacctttcatctagcaagtgctcgaggcatatttagttaaatgggtgaagtagctcctattcaagagagaacagttttggggcaatattcacccactcctaagctagaattatcacatatggtaagacattagcacatgccattcgactagcttcttagctcagacagtggatgactttcaaataagataaaatattagatcacacaccatgaagaactcttgcaaggtaactgcagcctcagtgcatctttgtccatctgggttatgactctgtgaaagtaagtgtaatgacagagttgaacagacattcagatgttaagaagcaacatgcggtaggctagagttttgagaaggaattaagggccctcctcattggagtttgcatcctcagaagattgaggaaatatgtataagaaataatcatggccgggcacagtgtctcatatctgtaatcctagcattgtgggaggcagaggcaggtggatcacctgaggtcaggagttcgagaccagcctgaccaatgtggcaaaaccccatctctactaaaaataacacaaaaattagccgggcgtgttggcacatgcctgtaatcccagctactcgggaggctgaggcaagagaatcacttgaactagtggggcggaggttgcagtgagccaagatcgccccattgcactctagcctggacaacagagcaaaacgccgtctcaaaataaataaataaataaataaataaataaataaataaataaaataaaataaatcattaacgtaggctgggcacggtggctcacgactgtaatcccagcactttgggaggctgaggcgggtggatcacctgtggtcaggagttcgagaccagcctgaccaacatggagaaaccctgtctctactaaaaatacagaaattagccgggcatggtggcatgtgcctgtaatcccagctactcaggaggctgagggaggagaatcgcttgaacctagaaggcggaggttgcagtgagcgaagatcacgccatggcactccagcctgggagacagagccagactccaccccaaaaaaaaaattattaaaatataaaaattttatgaaaatactagaattaatgggtgttggactcttgctagccttggcttgcaacaacagccagccctcagggctgtttgatccagtctccttgcttgggttaacccagaagacagcagggcataggctgaggcaactatagacctgactctgtagctccagggaagcccatcctgtgtgttttcattggtttattttcatttgtttgctcagaggaaagtttcagaaggcatttcttttggggctacattacagcccttttagttgtcatttaaaagagtatgatttcaatttatgacagacaatcaatcaagatttttgttttaaaatgagcctatgtgacctacagaggaagtggtgttagaggtgggacagttcttaaaactggaatttataaacatttcagctttactcccaagacagtgcggagcaagaagggttagagaaaggagaggaaggaggtagggaagagttgggtgttaatttctaaactataatgtggttccttagtcgtttctcctaaagcagacatagttttattgagggccattcatgggcaaacctagaccaaagccagtgacttctctcaaatggatgtttatttctttctctcttcctcgacggaaaagaaaaagcagaaagaacaatggggaggaataggcatgcaatgtctgatattgctttagtgttggcgaaaaaggcagcctccctccacgcccaccacaagtacatacacataaacatatacatgtgacgacatatgcacaaagacagggcaaacacaagtttacatacatgcaggaaaatgggcacacacatacaaacacacacacagacatgtgcatacaaacgttcacagatttacgtgcatataagcacacatgcacatatattccacacacacacacacacacacacacgtacacatacacacacactccatagatgacagatcaggtatcaatgatcctagtctcttaaacccctgagcaggcagtaggagtttcccttttcctagaaacctaagccagaagttctcctcacagcctcatctgggctagggtggaggtgtgatgttctcacaggccctttccacccatcttttctgttcttagaaaagcctgtgttgggccgggcgtggtggttcacacctgtaagcccagcactttgagaggccgaggcgggtggatcacctgaggtcaggagttcgagaccaggctggccaacatgacaaaaccccatctctactaaaaatacaaaaaattagctggacgtagtggtgggtgcctgtaatcccaggtactcaggaggctgaggcaggagaattgcttgaacccaggcagcggaggttgcggtgagccaagaatgagccattccactccagcctgggcgacagagtgagactccgtctcaaaaaaaaaaaaaaaaaaaaaaagaagtagagcatttatatttggccaggcacagtggctcatgcctgtaatcccagcactttcagaagctgaggcgggcagatcacaaggtcaggagttcaaaaccagttcggccaactgtgaaaccccatctcaactaaaaatacaaaaaattagcctggtgtggtggtgtgagcctgtaatcccagctactcgggaaaccgaggcaggagaatcgcgtgaacccgggaggtggaagttacagtgagccgaaatcgtgccattgtactctagccagggtgacagtgccagactcggtctcaaaaaaaagaaaaacaagaaaagcctgtgttgatatcattgtaatataaaagatagtattttctgtgggccctctgtcagtctccaactttgcttgcctttttagctaacacccttttctcacatcatctttgctactgtatagagaggtgtatatgttgtgagtgtctttctcatttataacaatccatactcgtaaactgtattcctccatatttcctgaaatggacttgaagtttaaggagaggtgttagagatggacagttccaactagttgaagatctccccaagccccttttatgggagaaaaagagaaggaaggaagggagaaaagaaaggaggtggaagaggagaagaaagaggggagggagaaagcgctctggagagaggaaagagaaacagagagaaatgaggagaaataaggagaaaccaaagaaaatatttgtggtcttctactttttgccattccctacacttttctgttcatcgccacctatcctgagtagtggcttgaggagcttttgaggggtttgagagggaggttgggaagctaagagcattcaagacggcttcccctcttctctccttcatctggattaaatgcatccagtatgaggaggagggtgcagagagctctcccttccctacctacactaaatagtagtgtccacttttcactgaaaacccacagtgtgcaaagtacctagttagggaattgatactatgtttgtctctaatcctccccacagccatatacaaggagggtattattatccacattttatatatgaggaaactgaggcttgaattagtgaggttagtgattcattccttagctgttatatagcagagcagtttttctattttatttttatttaaaagatttaatttaatgagtagtaaacagattaatagaaatgaataatagttaactcatgaatgtggtttaagtttgtaaagtaaaacaaaacagaacagttttacttagtagaggggttttatgaaagtacatactaccccagacaaagaaaaaaggagagggactgaatctgttgggtaggtgagaggggaatgagaaaagctctgggggaaatactctatacgtacattgtctaatagggtagccactaaccacatgtggcttttgagctcttgaatgtgacaggtctgaattgaggggagctaaaagagtaaaagacacattttagtataaaaaaagaatgtaaaatatctaaacaaattttctattgcttatatattgaaattataatatattagatatattgccttaaaatattaaaattaattttacttgtttccttttacctttttaatgtgcctaatagaaaattaaaagttacatgtgtgactcacattatagaacataaatgtttatacttgattcctaaccaccctgggcttcttcctagtgtggcactcagagaggaggatatagggacacagccaattccatcagagaaattcctcttttgtttgtttatcaaatcaggtttctgatataaacttctttgagggaaagaatctacagccaaaatgcttgacaattctagtcttagaatattttccatgtaccctgaagacgtggaatgagaagaagaaacccagatacctttcttttcctcttatcactgtatcccatgcattaactagaagggccactagatctctctatgattccctctaagatggtggtgggcctgtttttttttccttgttattctggtatgtcaggagttcatcaaaggtatatttgttactgaaattttaccccttttctgtaggttgcagaaatatatttgtgaaagggaatgtcttttaagtattcctaattgatagcatggagagaaccaagttacagatggtctttattagaaattccttctcttttggaaaatgtagacctctttttcctaccccgttagcaacagtgattggagaatgattgagtggtctcttgtggaaatatgtatttacctatgtaaagatcagtttcaactcagcacattcttctttaactggtggactaacctgtaacctctaaagggtgttgacatctcttcagtttataactgtgtgtatgtgtgcatgtgctcgtgcatgtgtgcaagagtgtgctctcatgctcatatttatgtttttaacaataaatccagctgctaacttagagaaaagcttttgaagctactttgtagattttaattttcttaagaataaataataatcctggccatttgaacaacccatccccccaaaatgttagcacgtggtcacatacctgaatgtgcaagatgaattcaattcaagggtgacagaactgatcagaggaaaggtaagaacaaatgcatgctatgaaaaagccattgatttccctgacactaattgtaaccaaaaataacattgtaacctcaaagggtatttgtatgtgtttgttgtcagagggcagatataggaacccaagatagagcccagacagtttcttagttagaatatcacctctgctttttgaagtcttacaatgtttctttctctatggccttttcatttggtcctccaaaaatgagggtctgttgagtttcctctgatgagttttagttgtcctgtggaaaggaggcattctgatgtaagaaagttttgcttatcattagttgaatgcactttccatcctgcaaaatgttaatcctcagatcacaccaaagtgaaggacaaagcataagtgagaacaaactacatcaagtaattctttcctcatgtgtcttttacctaaggcagatgtgcatacttggtgatacaattgacacattcctccctcaaatgtgggtttcatacgtttctccatgatcaaaaaggaaatcattttatcttgaagttgtaagagaagcatttattttaccatccttttaaaggcaagagtatctgaaatttgagataaggaacaagcctatagtttatgcccctcccttccgttcatcctttccaaagcaccaacagttctagaggccatggggatttatatataaataagtccctctcatggaatttataatctgtgttgctttgatccaatccaaatataagcattagtagccatgccactaaataagtcaattccaaacagttatgcctgccccatctttggaacatggtgggaagtctcaggaacagacagcaaatgtctacaatgtccactggctcttgtatatctctaaggcttaccatcatgctttctgaaagtccctgctctcaggaactcactatgctcgttgtagaattgtctagcatgttgacagtctcttttctgtgtgtgtctaagtcctacatgccatgtgtatcatggtacctgtgtgttgcactgaagtgccatgagctgtagtaggaagagctttggcaccaagaggcaagagatatatgttttaaacgtggctgttccaacatgttggatcatcttgcagagccacataacactgaggtttatagagtccattttcatgctgctgataaagacatacacaagactggggaaaaaaaaaaagaggttcgatggacttacagttctacgtggctggggaggcctcacaatcatggcagaaggcaaggaggagcaagtcacatcttacatggatgacaggaggcaaaaagagagagcttgtgcagggaaactcctgtttttaaaaccatcagatcttgtgagactcattcactatcatgagaacagcacaggtaagacccgcacaggtaagaaccatcagatcttgtgagactcattcactatcacgagaacagcacgggtaagaacagcacaagtaagactataattcaatcacctcccgccagttcctcccatgacacataggaattgtgatagttacaattcaagatgacatttgggtggggacacagccaaactatatcagtagagacaaggtttcaccatgttggccaggctggtctcaaactcctgtcctcaagcgatctacgcacctcggcctcccaaagtgctgggattacaggtgtgagccaccgcatccagccaacccttctctttaattaagaatacttctctaagaaccagcctgagtaattttgggtaacttcatatgagtgagaatatatgtgatatcaggattgtgattatcataccatttgaccatgagttcccttttcatctgcaagtcaaaggatagttatttctagggcctttttcccttaaagactggaaagtctgtacttaaaatgagcaactccattcctgatttttacattggacttagaatctctgatcttatttccccaggggcaacatttatgcgacttggcttgaatttcttcctctttccttctcttcatttcttcactatgtctgcctttaaataccacttaaggtaataacttgttgcacagttaccattctttatttcttctgcaagagatggtcagatcttctttctggcttccacagtctggtgaatttgggacacattcatttgttcatggcccaaacatttgctaagtgcctattatttcctgagaaatgttagttaatgagccctattccttgctcttaaggagtttattttctaatggaaaaggtaaacaaaagcaggtaattatgttacagtgcacagtaaccattaagaagagatgaacatgtgtgcaaggaccctaaatgccttagctgggtgaagaaaaatggccacttttaagaaccaagttgcaaatgtaggcctaggtgcaggattaagaccatgttcactttgcttattagccatattgtcagtatcttaaggaatacttgtggggttggctctttccttagtggaacatctttatttcttgtctactttttatttcttgtaaaaaaaaaaaaaaaggtaatctaacctaaccttttctaatgtaacctaacaagtgttattttttaaaagtatttttaggttctttgtgactacatttttgtctttccctagacagtggcttcctaattagataacctgtatagacaattccaaatttagcagaaattcaaccaaatacatgcttcacagtgcaaacaccagcaacacctttcagcaacacagtttggtgaagacatgcctagttgaaagatattttgtgacttgaggtttatttaagctaataagtaataataatttttggagcctgaacagatccccagttttagcatacttacatcttctttatgtctctatgtattttaagtttctaagtaactgttcatagatgtattttgaacatggtttcctagatattgtctcaattccaattcaatatttatatctgttggaaagcacatgcactggaaaaatgttttggcaactgttttcattgactgtaaatcatttattagatagagtgttgttaaagttgaaatgccaaagttgatctaccctatgctctttgactttttggttgttacagataaaaagagattactctgctgagagtactaattttacttaaaggtccttttggtttgcatattaaatatgtcattcagtctctcccaagttaaatagagtgtgccctactgttactttgaagttaaatgaagttattttctgttttggtgcataagtaaatataatcataacttactttctttttgtaaatgaggttaataagtgcttgtgtcaaaaaatagccagtttatgacattttagttcatttattttagatataattaccaaatcagtgttctacttttttcttcaaataacaaaatgctggccgggcatggtggctcatgcctgtaagcccagcagtttgggaggccaaggcgggtggatcaccaggtcaagagttcaagactagcctggtcaaggtggtgaaaccccgtctctacttttagttttaatacaaaaattagccgggcatggtggcagacacctgtaatcccagctactcgggaggctgaggcagagaattgcttcaactcaggaggcgaaggttgcagtgagctgagattgcaacagtgctctccagcctgggcaacagagtgagactccatctcaaaaaaaaaaaaaaaaaaaaaaaaaaggcttcatgaggtgtttttgtcatctgtgatggggaaagattgtagcatccaaccaaagagctataaagaagacagtgttgtacagtttatgtcttggtcttaattctaaacttcccttccaatatgtgcttatggatgttttaactcatttttcgtttgtttgtttccactttgtcatctgttcccattctttaatattactttcatttccagctaaattgttaaactccagttacatggagaatattaccatgggaaaacatcatttaatttatattctatctagttctggcaatagcagtaatacataatgtaacttctcagtgattctcatgtcataatttaactagctttgacttttactgggagtaagcaccctactctggaaaatccatttcataattttgtgtctcaatgctatcatgtagctaatcagttaattgtaattacttctgcttaattcacaagaattctgaaaggatgtataataataaaatattttatcatggaatttgtctctgataaggaagtaaccatgagaaaacctattcaagtgggaatataattctataaacctaacttccaagtaaccagtctttgttgaattatagtgaatttccagatagctttgtgtctcagaggacatgggttggagttctatagctgaaccagcattattttaggtattacatgaggaagcaaccataacaaattgaacaggtggtcctgggaaaataagtctggaaaaagtccagagattggtgggggaagggggataaaatttaactaatggtccaatgaaatgtatactaccctggataggcatatatctctggtagcctctattaacatgtaaaatttgtaaaattcgcttgaagtttactgaatatcattttgtttcaagttgtttcactgaaataatcaaacttgaagcatctcttgatgtaatgataactcaagtttatatagtatttttttgttttgaatatcagttcatcatctaagaaatatcttaagtcaaatattagtctattttaccacaaaggaaaataaaattttaatgatagtaaagttatcaacacaaaataagaagaaatagatcaaatgcagtgttattgtatcaagatttaaaaatataaaactgtgaattaattttaaaaaggagaagtttagtagctcaaatagatttacaaaaataattgacacaactcaggtagtgattgaggtggtttggccttcagtggtttacttctatgctactaaaagtgtggtctgtggactagcacctgagaattggtagaaattatctgagaacccacctcaagcttactgaattagaatttgacaattggttttaactagtttttcaaatggtccacatgtaatttaaagtgttggaggtattggcttggttaaatgtaatgttaattttagtcagtagtgcagcaacatgtctgctaagaaaaataaagtaagcatagatggagttcataatcacatggcatccagagagagataattggacttcctatcctgctgactttgttcagttacgggcgctataagttgtgctttaagaacatgcaacaaggacaccgaccgggatggtgaccaattttatatagagaataactgaagaaacaaaacatttgacctggagaagagaaaacaggagagctataattgctgtgttcaaagattccaaggcctgtcccttggaagacaggggagaaggaggcagaagtaaagcaattaatatagacaataaacaggaaaatgtatctttttaaaatctaagatgaactttgaaacaattatgtgtgtcctaaaagagatcttccttattctaagtagagagttatattgctgaatatttttaagtagagactgaaaaaccactacctagaatgaatccccctgttaaatgctctctaagctccttgtcacaaggtaacaataggagttgcattgaatctatagattgctttgggtagtatggtcattttaacattattaattctgaagatcttatacagtattattctgtataaaggtataaatgaaatagaaaaattcctaaaatctacgtagaaccacaaaagaccctgaatagtcaaagcaatcccaagcaaaaagaaaaagctggaggcatcacactgcaacttcaaaatagactacaaagctaccataaccaaagcagcatgatattagtataaaaacatacacatagaccaatggaacacaatagagaacccagaaatgagttcatatatttacagccaactgattttcaacaacggcatcaatatacattcaggaagggacaccctctttaataaatggtgtgggaaaacttgatatctgtgtgcagaaaaatgaaaccaggcccaaatctctcaccatatacaaaaattaactcaaaatgaattaaagacttaaaggtaagatcccaaactatgcaactacttgaggaaaccaggggaaacagttcagaatattggtctagtcaaagattttatggctaagatatcaaaagcacaggcagcaaaaacaaaaatagacaaatgggattatagtttactgaaaagtttctggacagtaaaggaaacaatcaacagagtgaagaggccactccactctgggtgaaaatatttacaaactgttcatccaacaagaaactaatatccggaacacctaaggaggtcaaataactcaacagccgaaaaacaaatatccaattaaaatgtgcacaaataagctaaacagacatttctcaaaagaaggcctacaaatggccaacaattacattaaaaaatgcttgacattactaatcatcagggaaatacaaaccaaaaccacagtgagatttcatcttatccgagtttgaatggctatgatcaaaaaaataaaaaataaaaaaataaaaaatgctaaagaaaagggaactcttagacactgttggtggggatgtaaattagtagaaccattatgggaaacagtatagtggtttaaaatctatattaaaattaggactgccatgcaatccaacaatcccactactgggtatttttaaaggaaaggagtcagtatatcaaagggatacctgcacccgcatgtttaatgcatcactgttcacaatagctaagatatggaatcaaccaaaatgtccattaacagatgagtaattaaagaaaatgtggtatatatacacaatggaatactattcagccatataaagagtgaaattctgtcatttgcagcaacatggatgagcctggaggacattatgttaaacaaaataagtcaggcacagaaagataaatactgcatgttcttatgtatatgtagaagctaaaaaaaatgtttaagctcatgaaagtagagaccagaattgtggctattagaggctgggaagcatgggggaaggagagggtagggagaggttggttaacagactcaaaatcatagcttccgacagcactgttggttaaatgtggttaactacaatttattgtatatttttcaaaaacctagaggagaggattttgaatgttcccaacacgaagaaatgatgcatgtttgaaatgatggatatgctaattaccctgattttgtcattatacattatatgtgcatattaaaatatcactctgtattactcctaaatatgtacaattattacacatcaactaaaaataaaaggaaaaataggtaaataatatataaaagatacagtaaaaatacaatattataatcttatgggaccactgtcatatatgtatgtggtccctagttaatcaaaacagcattgcatatgactgtatttctccagttttaaaaattactcattgttccatctgggcatggaactgtgtctgttttatccactgtctgttgtatcctcagcctctagcacagtgtctgacagaaaatgtttctgtatgactaaagggaggaaggaatagatgggagggaagattgaattcattagtatattcaattaatatttactgattgtctttgatatgcaggcactctgataggcattaggaagatgtaagtgaacaaaacagattaatatcccgtctctacaatttaatttttctgtggattagtttcaataacctataagtagtttatacagaaggagaatgaagaacaagaatcagatgtctactagagcaacacatctttaaagaagtaaacagcttccaaatatctcagagcaaccagaccaacatgaagtatgttgaagttgacataaaatagagatttcatttctttgttttaaaattaccttgaatatgaagttaaaactcttcatgtgttataggctgatgaaaagcttagacaaattactaaaactttggagactgcaagactccaaataggagcaacatgaggtagagcagcatatgcagctgtatgaccagagaatttctgagaatttactctgatttcattgtcagtgttttatgttgtgatttctttgattacatcatggtattattagtgatgttttagtatttaatattagaactactttgacctgaaaaacgtgtcctaaaataccttattttacctgagttactgtgttctttgaaccttattccatccaggtgtcaacatttttttctcatcaccatgcatctttgattttataatgtaagtcagtgagaaaacaagattaatttaacggaaaattgctttccacaatcttttctggaatctcttttgtctgttacccaggcaatatctatattattactttgtcctcaaaagcttttaccaatttggcaacacagaatgactaaatctcttttcctttatctggcttttcattaggaaggaaactcccaaaattcatttctatcagcattatcctcaatgctaaatcttgtatgtctcaagtctgtttataataaatatcctcattatgactaaggtcgtcttacttctctgcattacttcagtttctaatgaaagcaatgcccaagtgactaagtggatgaagcccccgactgtaggaaagtgttcccatcaaatatctcctaattgccctcaatgaatcagcttcaggctcagccttatctctggcaccttccccagctttgtgttgatagccaataacatgtgctccgagcatgaaggagataaaaatggtgtgactcttagaaagccagccatagagtggagttagggagctgtttagattcttgacttcatggtcctgatgtgattgattttcaccaatttgccttcagacatgctttgctatcattgcttcaaacacgtaacttcagatcctacagggaaacttgtgctccttcaattgtttctgctgccttacacataggtcctgtgttaagacatcttgtattcatcagcctccaatggtaactttaggcaagtaacataagcactttctctgaccatctgtaaaattaagtagtaactacaaagcatctgacacatttcttataaaagcacagtccagtcaccctggcctggctcacagctgtggagaacagcgtgcttgtgtctgagcctcctgacgtatgttttcttttcagtccctctgccccctgccttccttaccaccaccccccacccacaatatcttctctttctctctttaactagttctcctccaccctcaccccctatgcctgaccctactcctcacacctgctttggccccatataatacaggatgttttaatatactatgtacatggaagaaaacggaaattgaagttgccagccatgaactttcttttcttttcttctcttttaagtgggggaagagtatcgtcaacagcaaggaggctattttcttagtgacagcagaaaagtggtagggggttagggaaagaacacttaagaaattagagcttccagcggatacatggtgtttgatcttttaatggtgttgctgctgggcctggtatatattttatcatgggagatggttagaaatctgagctttgaaggtgggaaatgtgtcagttggtttgtgtgtgtgtgtgtgtgtgtgtgtgtgtgtgttgtaacacagagtacgccacagagaccaaaagccgtggaactgttaaaagacagagacatacaggcatgtggatatggagtggatgaggcacacagacacatattaaatgagaacctactagtgacaccctgaagagagaaatgaggtaaacaggcatgatactggagggagagggatgatagatcagtgaaatgacttctatgcttcagccttccagtatcacacaggctgtgagcaactcacagactatcaacttatgacatcaactccttggcatgactttggacacagaattcatgcagtctccacctgtcccaggtagtccttgattttgtgtgtctgacttcaacccttttctatgggcattccctagaaatgcggaacatactcttcaatacctcagctaacaaatgagcatttctggttctcacccaggggtacatactgggagccaccggttttatttctgtactgtcagccttatggtctttccagtagagtttatgtatttatttgaagcttttagggcattttgccctcacttaagctaattggactatatgtgaaattgcgtgggtatagcgggggtagaatgccaaagaacaggcataaagaaaatgttctgaattctggaaatatattctaaaagctcacgtctgaaagttgggtaacgaggaattttatcttttaactcttcctcccccttcatagcatttaacttttgtttgattttcacattcaaaaagaacaattttaatgtatttttcagaactaccaacagggccagcataaccatggagctgaaaacagatggtttggttttgcaaaggagaaaaagtgatatcttttcctcacccatttgcaaggttcatggttgagatccctaaagcaaaagacagattaacaagagaaaagcatacatttagtatacattttatgtgacacaggagccttcagaagtgaagacccaaaaaaaacaaggaaccttatgtacttttatgctaagtatgacgaagtggacagccttggggaaatatgattggacaaagagggtatgatctaatggtaataaacttgggggtacttagcaagacctctttgctcagattcttctctttgtccctgtgtcttcagaaaaatggatgtctctttcttctgggtataggagatatctctcgaatgagaattttatgaccttcttcaaagaaaggtcagaaaaaacatttatgtcctgcttaaggagggtgggaggaggtcagagagaccttcctgcttctgctgtttactcaaggtgccatattttgaggtagcatgtcctgaactccatcagttgaatgtttatatttgaagttagaacctcccccagtccatgctgctaagttcaccccctttccctatctcctcatgaccctagagaatttgaacaaaaaagggtccagtttcaaagacactgagcataagagaaagtgaagctggactgaaaccagggaatcaaataaaaatctactcccagtatattctcttcagaaaattattctctggagaaactgaatagttacaagggcacagtggcaattatgatgctttacaaaaataccatatatgttttgtacttttaggaaaatgaaaactgcacatttgaaataaaaaaagaagatgcagctgggtgtggtggctcacgcctgtaatcccagcactttgggaggccaaggcaggtggatcacctgaggtcaggagttcaagaccagcctggccaacatagtgaaaccctgtctctactaaaatacaaaaaattagccgggcgtggtggcgcacgcctgtagtcccagctactcgggaggctgaggcaggggaaatctcttgaactcgggaggcgaaggttgcagtgagccgagatcccgccactgcactccagcctgaacgacacagtgagactccgtctcaaaataaataaataaataaataaataaataaataaataaataaataaatttcatataaatgcagattcctggcttctcctagaaaaattaggctgcctggcccccctggagccatattccatctgacaatatggcttgcccatttagctgaagcacctgacctccagcttgtcatagtctctaccttgcctccttgcctccccacagctgaggctcaggtgttatttagtattgtgattattcagttatcttacttgtttcagggttgaggaaaaaaggaaataattttatgcctacatcaaaattgggacaatcaaagaggttccaagagggcttcatgcttcccctggcttactgtgctaaggtaccttccaggcttctatgggatttaagttttctacctaaaattcctgatgatatagtacaagctttcgttagctctgttatgagcacaaagaccatccttcatatggtcacctttttataagaagcttataaactttgtcaccctgcagctattccttctccagattactgtctccaaagacttcatttttcatttatgtgatcacacccatgtactcttgatctttgccacatttttcctgtctccacacagtcagggcctgatcaataaggaatgactatgtgttgatgacttcacagctctcacccattatccttcagttcatgcatatgggtgtcttgtctcctttttaaatagcgccattatcctaatggctaatgctcggtgggtggccttctgtaactcttgtatatttttctaccatggctgaacacagtgagtacatttccatcttgtgtttatgcacttgggttttcttttgtaagcacattgccttccacttatttccattaaatttcatattccttattcaaaaacacttctccaaattggtcaaagtaggttttaattttcccactgctgccaaaggtgctggttacctctcttcaaattgttgtagttatcacactttataatgatactgttttatcattcaaatcattggttcagaaatgaaattatatagagtctatggccgacctctgtagaacactggtaaggggtccaactcaagatgatcagtgatccattgaaaatggtggttgtcttctttaaaaaataaaaataaaaataaaaactttgagtaaaataaccccttaaaattaagtagttatttgcctgaattaagtataacctgtaacttattgttaagtaaacatggttaagctaacctttatatgaatacccaggctgtaaaaatttatgctatttggtagtcttggaaatacaaattccaaatagcctgaaataagaagctacaatataatgggaggccagtagttaaaaaatactgccacagtagaaggggtgaagtggatcaggaagaatcctaggatactttacttagaaccctttgtacaaacagcatgaaagtaatgagattaatgaaagatttttttgtcaaatttagaagaatctgagaaacaaactgcaagttttccatttcatttgatgtcttggcaaacctactgatatgtgtgttatttgtctctgtcttcttaatatttgctaccttgccggttgcctggtgatttaggaagacgtggggagtatttgtaaacaaaggaagcttttcagaagtgggtaacagtagccagagtttgctggttggatcttccaggaagcaggagctgagaaataggagtgcaaaagttttgttgaggggcatacctggggaagataaaaaagggaggaagcaggattaggcagagagccctcaatcacagggcaaatctgctgagtcttggccagctcaacaggagctcccgaccaaagatcccctgttctaggagctcaacactgggcagaaaacagccaggtcctattgcacccactgtgctcaatcatgaccgagagctgcctcagaagagtgtggactcaagtcagaagctgaggaggatcctaaaggcagtaagtaagtaatagctacaggctgtgagctctatttgcattcctcacagctgaatgccaagttctttcttgaaggaaaagtacaagcaatatatcttcatcacttgtgcttagaacattttccttattactgaacaacaattagagatgatcttgacattctcctctccgtattctcaatgtttcagcaacatgtgcaaaatccattcttctataccaaagtcacacactcacggaagagatgaagctctcaatacctgaagtaattcccaagtgttggtgaaggagtaagacaaaaacatgcaggattagaatgggcaggagagagagcagatgggttaggaaagagaatcactgaacattgaccctaactaaatatgaaaaggaaatggcaggtaggtgatcaaagaatcaggtgggcaagagttacctaaaatatcggtttcccattcactgcacaaaatgatggcatttgcccctttggaaatggttagctcttagaactctggaaataatagagtaggttgggaattttattcctccagaataatgtctggttttgaaaaacatgcatgctctttaattctcataatactgaatcttgcctttgaattctgtcatttaagtgataaactaaagcagttagataagggagatttttattgtacactggaatagatacaaaatagtggaaagtaaaggataataataataataaaagtcttagatggtgctacaaggtgacttgaattttgagaaatcaaatcaactcaaagaggaaaattcaggtaagataaaaaatatgtatggtgatagagtgtaatcttagcattgatattgtatatgtactggctcattacccactgcatcaaagatcataatgtgtttattatatcatttaccaaatgatagccatttcctgaacaactggcctctcctgcacatccttgtgtgatgtcctttattaataaatgatgcctgtactttggggcagaaagatagaaaaagatatctgaaaagggtctacaggaaataagagagaaattggtaatctccttagcttttctcttttgcactgttacattggctgattgtctggggcatgcaaaatgtatcataggtactacaactaaatcttcaaggtaaaacccagaaaaagtgagaaagagacccaaaccaccattttatatgtaatctcacttggtgtttgtttatcctgcctctccaagctctcctggcatgagataggtctgccatggtcagatagtaagtagcatccaatttgttgtttcttacttcatcaataatttttttcaaaataaactgtggaaagaaatccacttcctagcatgatgcaaacatcactacaacacagggtttcttaaactaaatttaaaaaataaaaaaggaagtagtggttattaattatttatttgcatttaagaacttcttccataagcattttccagagataaaaatcaaagatataattaaacttcagaatgaaagctgaggtttaattaatgagtaggtaacactcagttacctaacatcttcctagtaataaaatataatattaggaaggaaatatgttagccaaaaaaggaaggaaatgtatctttttctttttctcttttttttttttttttttttaaaaaaagaggaagcaaaaggaggagagtgatattgtgtttcagggcatttaatttgaatatatcacttgatagagtgcagacttccctgagttctataacctgtagtgtaaacacacaataaacaggcaccaaaacgcacccaagccaacaccaagcagccagtgggttttggctgacataaggcctctggtttgtggggttcatctggctccccttcagctctatcccaacatatgaatgtttctttagttagatcagtagtctttatatgcctctgttatatcagaaagacctgggtttctggagcagcttataaagattggggtttaggttaaaagcacatcacaggcaaacatgtgttgaacattattctgtgtgtggagactttgaagagcctctcaggtatatgtaggatttggtattatgaggagatgaattggattcaaggtactcaatcttattgccaatctttttcaataagaaaccatctccttggtttgcacatctgtgtttgataatgtgggagaatgtctttgattagactttcagagtaatcattcaaaggcaactttctcctctgctttgccgcatctcataaagttagattttgtacattagtgaggcactgattgcatgaaaataatattggctttatgagagagtataatcttgttcaaattataactctccccgccattctcaaagtactatttttgtgtcagattctcctccactgctgcttttatgagcactttccaaaatagtattttcttttttgtttcttctcctttattgtctttttataacttttaatcatatttttatggtaccttaatagccgaggcaaagtcacaggtggccttcactaaatcatttctacttttctataatcctaatggcagtgaaagaaaagaggtctctgggttgtcccccaaaatacttgtttatatcttccgatgctatttttaatatttctaaggatcaagatctctaccttgtgttaaagtatacatactacccattttgtttggtttcctagcatttgaaaaagtatattcttgacttttctcgtttttaattattattaatacttaatagttaattacttagttcaagttatgctaaaaactaattattttataactttttggcaattagtactcttactaaattttactaattgcatatcaaaacaatgataagagcaacttctaaaaaaatctgtcttcttggttcagtcttgctggttttctcttcaaattaagtgaaattctcttgatattttttcaaaaggtgaatattttctggaataaaatacagagttgaagtgaaatcatggaaactgctgtttgaacaatggtcattaaatgttattctctctgtcaccttgctgtctccccaccacatttatgatgtgaaactaaataaatacgggtacatctttgaaaccggtgtttttgataagaccactcctttgtggagttgtatcagggaatagtctcttaatcccagttggttgcatttttttcctttttatcagtctagatagattgagcctaggtcatctcttttgggcaaggatggtgagttttcagaaaactgaaaggttgccctcaagctaggtgctggagggattttgccaactgcacctggtgctgagtgagtggtagcataagcaatttgggctggagtgagaggcgaggaagaaagccacagccaagacttgggagatttcaggaaataagaatccagctgaccaaataagaaggcccatgggcagggagcagctgggcaccaggagatccaacacaggagccactgccttggaaattggaggcagttatttcatttccggtgatgttttctgattctctatatgattttaactctagaattgctaaaggtagctctgtgagtaaggtgggttgctagcctatcaccagattattaaagtaagtgtaatgtagggcagaaacaagaaaaaaaaaaaacgttggcttccagagaccagagactttgcttaaagaggtacgtgacagcttctgagggatctgtttgtatacataacatcccagtgtctttctgtcaagctacctgcctcccaggtacacgcgtattgctgaggaaacacaaccaacacccactgtttcaaagaaaaccattctttttggagtagtaagctcttttataaggctgaaatagatgtggagtattttaagatgaatagtcttacatccactaaattctacccagtttactctcattacaccacaagagccttggattttctatgtgtataaagacggtatttgtcattgagcttagtgctttttgtagggtcggcatattataggtttccctcataatgataacagaatcttacatcaagtgaacatggaggactgaatatttaaaccatgtgtgaaggagggaaaaaaaacatagtagagcttttcttttcactgtacagttatggattatctttgctggctggatatttatttcagatttttgtggtttctcatgtcgtggattacagggactcttgtaaatgggtttcatatggtaactagtgaccttgaaggactcaatttttaagataattaacttcacagttctaagtcagatctatgccagtcacagaatgaaataatttctgtttagttatctgggatttcattcggttgattaatacctataggagaagagactatttgctttgatttacatctatatcaccttcaatttaatatttcacgagaaatagaaggcacgaaataaccattttggagcagatacacaggcatcaaatgaagctcttttgatgtgaggtgttggagataaacaggtagtatcaggcgtccatagccttgcgttttactcacccctcatgctttgcacctaaagtgtgctcataactttgcagccatgagccatccccttgtcattttcagcccctgacttgttcctggggctgctgattcatctgttttcattgctgtcatgaaaaccagtctgcatttcatcataaaattcagaagtgccctattatattaggaaagaataaccccccaccagtggccacatcatatggagaaagaaccaatgtttcatctttctgtttttcagaagtctcccccaaaatgttttgagacaaaaatcagaatagaatctgcttaccctcaaagcaataggttttctctaaacaatctaataaggatttgtctagactaacatcctttgggaatttatctacagatgtctttaactcgttactgtgtccagcctgtgccaccacttgggagtaatgtgttccacaaattaactataaaggaaagaaatgaagaggaccagaaggaacaaatgcacaggaaacagtgcaaatatgctcctagacaagagcaacatttgttactgtttattactacttatccagaaagcctttcttaaacatatccccagacctgcactgggcaggctaccccttttctcccccttgatagtgcattagtaccgctccatggaacaaattgtcacagaatatcaaaatatgctatctacttagctaatccctatgttgcactcctgagcttagagactaggccttactcatcatagttccatcaacatgaagcacaatttctgaaatatactggtatactcagtaaattccttaaaaaatgacctctttgtatctcaaaaactctaggttattccttggtacatagaaggaacccaatacatgctttgtcaaagaagtaaagaaaataaaattattttagaattgttgagaatcttggtgatatgactgaaaccttttgtttcatggatgacaagactggggcctggagaagtgaggtcatttgcccaccatcctgcagctagaattaaaaccaaatgcagtggtttaaagctcagtattcttttcactccaaattggtagctgcctgtaatttgctggcattgtagaaacaaaaacatagtgaaaatcaccaaaattatattttacatttataaagtgctttacagtttccaaagcattttaataaacactatctgacctccctgtggtgttatctcaagaaggttaataggggagatagtattcctctttagtatatgaggaaacagggattcagagaagctaagtgacttgcccagagtttagaattcaaatccttctttcttttttcttttcttttccttttttttttttttttttttttttgagacagggtcttgctctgttgcccaggctggagtgcagtggcagtgacatgaacgtggctcactgcagcctcgacctcctgggctcaagtgattctcccacctcagcctcctgagtagctgggaccacaggcacatgccaccatgctcagctaatttttaaaaaatcttttaaaagttcccctggtggtctagtggttaggattcggcactctcaccgccactgcccccgttcagttaccggtcagggaaccaagaaatggagcaggacgagctgcagacaaaacccctcagacagcagattaaagaaggaagaggttttttgggtgcagcacaccaacatggcacatgtatacatatgtaacaagccggcacgttgtgcgcatataccctaaaacttaaagtataataaaaaaaatgaaaaaaagtaaaaaattaaaaaaaatctttttagagctggggtctcactacgttgcccagacttttctgaactcctggactcaagtgaccctcccacctcagcctcccaaaatgttgggattataaacatgtgccaccatgagcagccaaatcctcatttcttgatgaagattccttctctgataactatcttctgatgctgtgagagtgaactgatatttccaagaaaggtgtatcccagagattacaaacagtgaccatccaaaaaatattagaactgcgcagggatctttccagagcattctaaaaatgaagcttacaatagatttgattggctgtgaagttgaaatggggagggaggtaaaccttatgcaggttgttataggatgttaatctcctgggacagaatgggaataggtaaggtgacaactttaaaacaaatcagagaattaagaacatggttaagaaatgatagatttttgtgatcggggttaaaaagagaggagccatctttgatataaaataggactttgtttaacattcttgggaagatacttctcagaatggtgcatctcacccttcccattggccaagagcgtctcttgaatatggctgacttcctggacatgcaacctgtgtagttagaagggcccatagaagtgctcaccattggattaatactttgctgttgctgtcgtgaaaggctttatcatttttgaacagtcccaatgttttcatttttcaccggacctcatgcatgacgtaccagttctggtgaagcaaatgaggctttgccaaattttttctaattaagtgggactttttcctcctttgcaagtgattattccttcaggataaaaaagttttgaaccatgatgcatttgttttataaaatgaaaaccagagaagactgcaaaggtagtaacagaaatgaaaaaataagcaaaaatgataaggccaaaattattatttttcatatctttatgatcaaatatcttttctttatgataaataatcatgttttgagaattaggatttttgaaaggatcaattaaatggccttttctgactctcgcatgttgcttcaactgtgtaaggtgagtgattgatcttttcatattgatagaatggttgtgactgaacaatcatgagagcctgctgtgggtgaagatattggttttcttccaaataatttgcatattatattagtcaattttcatactgctataaaaaaactgcccaagactgggtaatttataaaggaaagaggtttaattggctcacagttcagcatggctggggaggcctcaggagacttacaatgatggcagaaagcgaagggcaagcaaggcatcttcttcacaaggtggcaggaaggagaagtgccaagggaagggggaagagccccttataaaaaccatcagatcccatgagaactcactcactgtcacaagaaaagcatggggaaactgcccccatgatccaattacctccacctggtctctcccttgattcatggggattacggggactataattccagatgagatttgggtggggacacaaaacctaaccatatcacatatttacccagaaatttcagagtcattgtgaggttggtaagtcagtgtgacactgagcaagccactggtgccccttcttgcctaatgtctaaaaattccttttcctactgttcttcttgctgtacatcgataaaggtttatcaaactttgtgttactcctcagttctatctagggatggtgtagccaagaagttgaagaaaattgaaaagctgtttgtatattcagtatttgcattttatatattttatagcatatagtaggataatagagaaaatgttaagattatttttatttttatttatttgtttacttatttgagacagagtcttgctctgtcacccaggctggagtgcagaggaatgatcataggtcacagttatctcaaactcttgagctcaggcaatcctccacctcagcctcccctgtaaaccctaaaagtgttgggattttaggtgtgagccactgcacctggctgagattattttttaaattgatttagatagtatccttcattgagaagctctgctgagcgtacatataaaagaatatcattctggccagccgtgatggctaacgcctataaacccagcactttgggaggccgagatgggcagattacttgaggccaggagttcaacaccagcctggccaatatggtgaaaccccgtctctactaaaaatacaaaaattagtcgggtgtggtagcaggcacctgtaatcccagctacttgggaggctaaggcaggagaaccgcttaaacccaggaagcaggggttgcagtgagctgagattgcgccattatactccagcctgggcatcacagcaagactctgtctcaaaaaaaaaaaaaaaatagaagacaaaaagaacatcattccagtaacaacaaacacaaggaaacttttggggaaaaagtttttcttcccctagattcaaactattatctattgtttctcatttgcataataattgtatgactgctttccacctctgctccactgtggtgttttctgttctagcttcttataatactgaatttggaccagcatatgtttatctgttcactcattcattaataaaacaaagtattgactacctgctattaataaatattaagcacagtgtgttgtgggaggagagaaggacattttttcctacttaatcataattagccttaaatagttccctaggagtttcgggtgtgtatgttcacactcctttggtgatgctgaagcattttgaggacatgactaggtcttacacacttcggattgggtgttgcacacagaataaagtccatgaaacttcctgagttgaattatatttggaagacaaaaataatttctgtctggcttagaaacattaagaacccaaagtctatgcgttagggaagagaaacagtcgacatgggtgcagaagtgtttgtaattaagtgggtgaacttgcttagatgaatgaaaccagattatttgagcagggccaatgatgccagagaaaaagaaaaataccaatggagagtaaaataagtacacaaaatgaaagattctgaagttttggaacgaaagttttagctcaggaaatggaagaatacttgagagtttcatgagaaaaaaaataagtgatagtgatagattgtaattatgcagacttctctgaagtcaaacagagaagggagagtatgagatctgtagtggttattagaagaatgattaagagaaagactatggcttaatgtttctcttttgccaaagatgttagaaagtactcaataacattaaagcagaagaaacagcaataaaataagaaggcatagatacagtgatgtcattgaaaaagcacacagtcattgaatctttggctttggagggatctccataaccatttgtcaacatccccacgcctggctgaaccacagaatcacctggtgaactgttgaaagagattctgacattcctcacctcatatggtgaatctttcaaagatgagaaggacgtaaatttcacataagctgttcttagccctttttggtcccttaaaattaccccattcttaatttttgtctcctgagtttccataaattatctatgtattcatccagcaacttgaaattcactattttgctgttttcagaactgtatacgtgctttcttgtccaatcaccgctactcttttaaaaattgagaccttagcctggatcttctgcatctcttatgtcttctaggattactcaaagatccccacagaagttctgcagtcacatctgtgagttccttcagtgaactctgataagattcatttgggcctagagacacaaactcataaagcggctagatgctcccttttagttttatcacctctctcaggcttcggttgcttcttaatctgttgttttgtggcttagtgtgaagatcattctcattgatagggaagatggcagcaaacagaatgcttgagtttttgttctctcttactgtcatctgctaatactataatatctgccccaaggggcgtgtgaatcattcttttccttcactctaaacatacgctaacaattccttttattgtcctctgcatttttctcaagcttgagcttattctcagatttaacccttcctgacactattcttacccagttctctcttgcattcgttttagacggtgtgctttcccacccccgtcttttgaataattcctgtttcatcagccacatgccattctttacattcctaccacctcggtggcattttaactcatctgtatagtttttagcatttatcattatcaaaattttattgttgaatgccttgcttcccccttaagacatctttcttgtcttagaccctggtcatggggccgtatcattctttcctctgaacttgtagaaatttgtgcccttccatttttgagaagtgttgtctgtggcgcagcttgctttaaattcgcaaacatttctggatcctccctagacctgtgaaatcagaatttttgaaggtagctcttgaaaatgtgataattagtaaatctataatgtttgggaattatgctgcccagcaatttcattccctgactcttacaaacaccaagcaattctctcaaggtttccatcgctttaactttgctttattggtccagagtaatagctcctctcattagtctcttcaactttcgaaagattaaattgtcagcaagttaataattcatctgttctgcttttaggacagtacaactttggaaaatcacttgaatttctctagatactactatatcttgtctccacaataataacatgaaatatataagggaaatcttatgcatgtactctggctggctaggttgccagtaatctgtttccattagagtcataccataagctttcctttttgtttcctcttttattttggactgagtgcaaagagttgggtgaacagtaatcctcagttcatggctctatcgtcatttgtctatacaaaactctttccctgtttgattttcccctttaatccttaatctatactccttttaccctctgcatgtagtgacttaagtgtttgggatatatccacaaataattagagttgttttgtgtagatatatgtaattcacagaaatggtattgtgctcaaaatatcattgttttcttttttccactcagcattgtttttaatatctctttcacacaattttgtatcctttaatcatattatatagtatgtatatggacatctgcttagcttctaagcaccctttaccgcacaatgacactaagaaacatcctcatacgtgccctgtaatggaactgaggaaatttctctggcttggaatcatgggagccatagaataaatgcattctgtccttactactgccagaaaagaataatagctaaaataggataaatgcattttttaaattttctttaatctttcccgcttgcatttcaaattcatagtattgatatctatttctatcaccaatgcacaagcattctcatttcccaaggtctccatcaatacttggtattgtctacatttctgatttttgtcatttgaatgcatatcaagttgtatttcattgtgtttttacatgaatttctctcattgctaatgagtttggacatcgttttatatggttgttaattcttatagcatctcattctgtaaattctttattgacatcatttgtcatttttgttggatttcttgttttttcttttgtttttttccttttcattatcaagttgcagtcttaatcagatttttcagtggtgtacctcataaagcagagatctttcattttatagtaatcaagtacatcatattattttcattagaggtggttatactttgggcttttaggatcttaagaaatctttttccgcctctatgtcacaaaaaatactttcctacatttccttctactgagctgatagacttacctttcacattttggtctttaatccactcacatcccactctggtttattgtgtaatagaagggtatagaaagccagctttattttttcttaatacagtgaggaaatttttccaacaccaatcacaaaacatattcattcccctgaggagtgcagtgccctggggttggggcataccgtgtcatggccaggtgcatgggctctggggctgaactgcccaggtctgaatcccaggtctgtgacacactagctttgtggcagctgctaactactgcttagcagtgctccaagtctcagtgggctgtttggaggaggaaatgagatgtcccagacacacggaaagcactgtttttgttatttatcaagttcttctgcatatatgaatctattgcagttcttcttttctccactcagtctcattggtgtctttatttttttttcttgtgtcagtatccatgatagttctccctttctaatatgtctaatatgccttcctcattcctttccctcccttcttcactgccccaacccaggatcacatgctccgttttgcagattgacaaagttgactttgtccatgtttgttgagttgaacgtaatttggaggaatggtataaggataagaaaaaaaaacttggaggagactaatgcgtaaagcaaatgggcgtgcaacttattaatttacagtgagacagataactgccaaacagactcaggtacttggtttttgtatctgcacattcatctctgcaggacagtatatttggaaagccatttattttagggtcaggagctcatggaatcggagaagatggtagatggaaaatctaatgtcattatgccatacctctggaatcaccccatagtagacataaatttaccttccaaacaaggcaaaagctgtactgtcacccagatctccctactcttctggacagtgctgagtacacactgacgaattcttcttgcctaatcctctctctaaccccacccttttatagctctgagcagaatacctcatttctaacacattctctattcagatttgtcaacaccattgcctaagcctaaaccatcttcctacattctagccacaccttgattcaatttctagacccagggttttatcctgccccttaaggtaacgtctttaggtaactaatctcattcagtgtcagtaggttttactcacttaactaagaggacaacaatttttccgagtttaggaagcaatttccattttgcttttctccgtgcataccacttggccacataggatcagttttacacttttatctggctacgttttactctcctctttaaagtcctctctggccaacaagctcctcccaaacacatttttttttctggttccttttatttgcctctaccccactcatcttctccacccccaggcgtggagccaatcttcttatatcttaaattagtccctatttttttggctccttcagtgtctcagagttggaaagacaaagaattgtaatctttagagtaatattttttttagattcaaacagctagacctttttctgaacctattcaaacccatttgctgtaggtaactgtctaacctatagccctgggcttgtttgcagcatcaaaattcattcccaaagattcttgctaaaagaagctggtgacaatgaaaagtagtcactgctgactcagatgttttatatcaattgtttttctgacttgacatacaaaattgagtcacagcattaaatataggtattattatacaattaatgtcagagcaaaataatagcctgctttattttgattttcatgtttccattgtacttacagctatttatttctgttgttcaatcatagcttactttgacttcatgttcaataggttctgcaacaaatttgtagttaaataacattatgtgtctcatctcaatcagtcacactgctgttagttcaggtaaacagacaataatgaagtaggcagggcaaagaatgtgtgttctgttccttggagagcatcttgagaggcataaatgaaaatgcccccagctcccttttgttatttttctataccaactgaatttggaaatgtgtaatctcctaggtagtctaacagacataacaagggcctataatcttaatcacatcagtaccttccacttatatacttgctttccacttgtcaaagcagtcaccttcattagcttgtactactagtttatgtgacataaattctgcgagattggtaagaatgaattattattgcattttggcaatgagaaaatgaagggcagaggcagattaatggcctgcctaaagttacagggtgctgaaattagaagccggcttgcctgacttctgctcttccactgtacctctacattatattcttggtgatggagctcttctctcagaaaatgctataattcccaaggaccacatttatgacagcgttagaaaggtctagaacaaccttccgtgtagatccatgtgggagaagtagtcttccaccaagtgctgcgactgggggagtcagggaggctctctgccccttgccaaagctgtgggacttcaggttcccacaggcccctctccccttgcagcagggcactggagggcggtattaaaatgctgtgttctcttcgaaatcaagcacaggaagccatcagcaacagctaaaacataactctcattatgctgtagccctgatggggccccagagactaagaaccagggaaaatcaaacagaagtcagagtatcacaaaacttccagaattgagaactgtccccagaagagcaaccacagtgggatgcctggataggaagccaaaggccataggagggtaagcagtggagaggagaggggccttacccgccaaatccataggttttccaagactgttccctttatgcactaggatctaccaaataaagagagtaagataaaggtcaacaaattgactaagacatacgaagcatttagtatagtgcccagcacagagtaaatcctcaataaatgtgagttataaatatctgcttgcaagtaagaaagcaaggcaaaggggtataattgaataagaccagacatagaaattagaactcacccttgggaaaacacacagagaaaaaccgaggagtaacacatgcctctttcttttctggagcctctgtttttgttttgttttgttttcttttctttttgagatggagtctcactctgttgcccaggctggaatgcagtggcacaatctcagctcactgcaacctccgcctcccgggttcaagcaattcttctgcctcagccttctaagtagctgggactacaggcatgcgccacaacgcctgactgacttttttttttttttttttttttttttttttcgccatgttggccaggctggtcttgaactcctgacctcaagtgatccacccgcctcggcctcccaaagtgctaagattacaggcatgaaccaccgcacccagtctctggagcctcttttcctcccatctcccatgtgtagtgaacacagcgaaggcaccctgagaagccaggtggtcagaggattgacccagcgactgcatctgtcagttctaaaatgaagttgaaataaggaattcctagagatccctaagtaatcaaccatgccagagtaacaggataaagaagcatattttgcatttgtctattgactttattccaagcgtaaaaacacttagacgtgttcaaagctaaataaacttggaacagagcttcaagactctgaagtcccatagcttagtgacttcctatatgcacttcctagagaaccactcattttcggattctcctcctcttttttgttagtcttgacgtagataagagaaatggcattccctagtgtactgtttcctttgtcccctattactcaagcctagaaattacatctgagtcctccttgttacaggtgacaaacagcatttgttttgcattttgatgcagccacattctcaggttccagcctgccaagcaaggttggcctgggctggtaatctcccaggctttaatcctctccatcttttatttgtgtggaagctcaaggcattagtcctcttaaaaatctctaagattcattttgttcacaactcttgaatatcgtattacaaggcagggtgtgatttttattgacaattggagtatgcttaaatgaagtgtgtggatgcctcaagaggggccacaaattcccacaacacttaacatgggttctggtaacaaagacacttaacagctaggtaagaatgtcaagtggctgtgactacaataatggaggcctacaattagtttaattacaatacctactcacatgtaataatttctcaagaagcatggaaggttgctcactccactggtagtttttaagtcttttttaccccaaggcctctcttagaaaatctgctgtacagccgggtgtggtggctcacgcctgtaatcccagcactttgagaggccaaggcgagtagatcacgaggtcaggagttcaagaccagcctgggcaagatggtgaaaccccgtctctactaaaaatacaaaaattagccaggcatggtggcaggcgcctgtaatcccagctacttgggaggctaaggcaggagaattgtttgaacctaagaggcggaggttgcagtgagctgagatagtgccattgtactccagcctgggagacaagagtaaaactccgtgtcaaaaaaaaaaaaaaaaattagctgggcatggtatggtggcaggcgcctgtaatcctagctacttgggaggatgaagcagagaattgcttgaacccaggaggcagacatttcagtgagccaagattgcccaagatcgcaccactgccctccagcctgggcaacagagcgagactccgtctcagaaaaaaaaaaagaaagaaaagaaaatctgctgtagcctggcaggtcatgatgttctttctgccacaaaacacacagcatcgaatccgtttacagacacaggcctgctgtcttccctttctctctgccctccaagtgtcacatcagggccatatccacccaaccttccttttttttttttttttctaatctacaggaaagggaaaacaccactgagattatttacaaagaaaaacccttatcttaataatagtttgcttccattaaatgtatcttctttggggacttaatctttgtgcccaggcatgttggagacaacagctggcatttatctttatggaaggaaaggcattccaagcatagcgtgttgggactcaagtcatttcttactttccttttattattcacactgatgaatttaagataggcttcagatgaataaattaataaactctgttgaagaaaaatgacaactgcctatatcgccacacatgtgaatcacagggtgccaattcagtagtgttggaaataggatctttccaattattttggagaagggtataggttacatgaccacataaagcagtcagctcttataccctgttgaagataatcagtgacaaaatcagccaaagcaaaagattatccatttatcctatctatctacccacccacccatctatccccccactcatccatccatccgtttatccatccattcatccatccatccattatccatatttatgttggctagagctctgtgggttactttaaaccaatttttttctttcctaattcaacttaggaaacattaaaattagctttacattccataagcacccatacactgatggaaagtggagacagcccatagcgctttgtttgaaggagttagaattttaaatttttcctgaataacctcaatagactaataatcaagtgttgactcagctctcaaatttgctgtgcagtgcttacatggacagaggtaaagaatttcctacttatattcgatgacaacctaatgttttgttctctcagtggttattacagcagcttatatttatgaagtgtctttttctgacgagtttaaaagattctgtaattcactgcattttacatgtggggacccagaggaatagaaatgtcacatcgtgactgagggacagagctaatgccagaacacagctctcttaacttgcagggtattgctttatcttatcatgctacctgtcagcatacagatgacactcaaatctgtctcctctcaagcctaaattcacacttttttttttctttaactgtgactgaacctcagtggacagagcagccaagatatcaggcactcaggcaccaagcatttgaattctgcaacctttgaagttgtatctctgcacctgggggcattttaggtggcctccaggccatgtgccttcccactaataactggtgatgctgtaccgccacaggtgtcagcagcaataactgggcctagcttttagttgctgccacagatgtcctaagggagcggaagctgaatcatcacacttaggtctgggaagctgtaaaaacaaaacctgtgctgaacagcccccaatatctttgtctaccaaggagtctgaactcttttaaagtttcttcttggtaaaagcagtggcttctagaaagacgacctccactctaaaatttctactgataccttcaaatagtgccttgcatcttcaagaatgattggagctgtgttaaaacttgtaaaatttgaagacatttcaaaagaatgcagtgaggacgattaaatgatttgtaaattaatcatttaggacatacaatctccaaaattgaagatgccagccttatttcgtccagagaagagaaagctaagaagaaatacaataatccattgttagtgttgtttatatgaagagtcatgctatgaagggtggtgatcagatggtctccatcctcctcttaagtgagggaaagggagtggaaggaaataggtttaaactaaagcatgcaggatttaagttagataaaagaaagaatttcctgacagtaagattcttaaactccggaatggttatcaaaagaagttttggaatctgcttatctagagaccttaaaaaacactagggactcccatctgtctaaaatggtttagaacagacagccctaaaaggttctcagaggatcggattatcttttaagattctttctagccatatgataaacaagaagattgggagtattagtaaatggccaatcagtaaacatctcagaggccaaaaccaccttggcctccagataactaatctcataatcaccagtgtaagtgggcttgttccaagatttgccaagaagattcttaagaaacccagagtttctcccagtttgttgtcctgctatttatttttgtgggatgccttttctgtgtttgagtttatgtggttaagtttctgtgtttgagtttatgtggttaagtctactgatcctttccccttttactccttttattcttttaatacccaaaccttaacaattccattgttttagttttatgtgatgatttgtaagtaaataaggatggtcactcactgtggtatttatttacgttagcaaaaatggggaagcaacctaaatgttcaacactctgggatttgccacagtaagggtgatacgtctgtgtgatgaaatgcagcagagctattaaaattcaaaagtttgaagaacatttaattacctgaagaaatactttaaatgggggacaaaatagcatacaatactatatccatggcatgattccagtggtggatctttaagaaaataaaggatataccaatactggtgggaaatatggtgttagaatgacaaaggattttgtatttccacttgaaacttttttgagtctcagttgtttgtagtatatatgaatatctgatattatcagatttaaaaagttgtaaaataggccgggtttggtggctcacacctctcatcccagcactttgggaggccgaggcaggtggatcacttgaggccaggagtttaagaccagcctggccaagatggtgaaacctcatctctactaaaaatacaaaattagccgtgcgtgatggtgcacacctgtaatcccagctacttgggaggctgaggcatgagaattgcttgaacccaggaggcagcgtttgcagtgagctgagatcgggccactgcactccagcctgggcaacagagcaagattccgtctcaaaaataaaagttgtaaaataaaaaattcaaataaaagaatagacaatcccctattggcaggtacaaaactaacgttatcattgtgatcttacttttaattacctctctaatatttctaaagtatttgtggaacatgagactggtaggcatgtcgtgtcctcaggcactgtgtctaccttgtaacacaaattatctacctgttctcaattcaggggagcttgggaaaacaaaaaaaaaaaaaacaccccataacgttgaagagctctcgtaactcttctctatgacttgtcttcctcctgactcagggaatgaatcaaaagttagtgtgcttcataacctgtacttcagttctttttcctggcaaaacactctaaaatgtaagttcctgtgttgttaagtttgatgggaccctgttgcatatttcaagtatagatacagctttacctactgaacacttgccctcttttctgtggctgcaagagaaattgggtgccttaaaggcagtattaaaagaatgtgcaactatctactctcaagattgtgtgaaatacattagtaatagtgtgcacagcctatgttgaaatttatcatggacaaattgtgagtgaggattttactcaacactcagttttaccattaccaaacctgctctccagcgtctagtcaccacccttattctcctaattcagacatttattttctctccctagtgtcatgggctcctaactggtctacctccacccagcatctttctcccgtgtcccattttccagtgagagccagcatgatctgtctcacaggctggcacacagctcacctccacacgtagaatgagatggaaattctttaaacagcctacgggcgccttcgtgttctgattcctgtctacatgacccaccacatcttcaacttgttctccacttgtaaattctgcttcttcagtctggaactatcctgtaaaaatagagttaaagaaaaatttcttcccatttttcaagacccaggtcaagtcctctaactctatcctgtggaggcttcttcagcttaccacctcaatgctttaacctccctacattacagataatcacagtgtaattacttgtttgtatgactttttccaagtgggacaaggagctgtttaagggcttaacttttacattcttacttcctgtacaaagcatgcagtgcatcagctgagaagtagaatgtttttgttgactagatatgttaacttattaataaaatagagattatatgcttttaaaataaacaagcaataattgagctctagtcattagctagcagcaagtcagaccatggacctaacttctcttggctcatggctcctcctagagactttgtccccagagcccctccctgctggactgctcccaagaacatcttttcctcacttccccaaggacgtgccttcagagtgacctagagacccttgcaaacaagttaggggtccagagggagaaaaaggcaggagtcacttagtcattttccactttgctttctagttgtcttaatgatgtagtgaaaatagtaatatgttgttttccagaagaacaactcccaaactagtcaatttttttaagtggaggtcatgataaggcaaccaagttttttatttcaccaagtaaaaacataaatgaaacccctcatctactagaaccattgtttcataaacaaaagcatatttaagtattaacagaataggaaggttgtaattgcagaaagtaggagaatcatttcaattaaacaaatgcagtgagatttttatgaagtgaagttgtacctgtttttcccacagcatggcacccatatcctggaccagttcaggataatatgcaatgtgtacctctcgaggaaggcagggatggcctgccaacagcaggcccgggaaagggcaggagtatctcccggctgctcataactgaccttatggatctaccaattgccaggaggaagacacagttcattctgtcctcttcctgatgtttctactgctaagaattgctcttggatgcagtagaggggaacctatatcttgaaagctgaatccgagctgttatttaagaatttctgaaagtatcgacagatgacagtagcacttttaacttggagaagaagagcactttaagtgcattctgtcatcttggttacttactgaaatctgttcatggtagagtgggtggtagggtgatgtttgccttggcttgacagctgtcaactgtctgtgtgtggtttgtcatttgttgcttttggcttgtgggtggtctgcagtccatatttcttgtgtatgtcatttcattcacaagtaactccaggggggcagctgtgggcaccttgctattgctgaagtgcgagcctccaccttctgtgacattgcttggcttctgttggtaccatctcccaccaatatcaaatgcttgacatccttagtcatggaccaatgtttgggtgatttttattttcataattgaaaatcatcttggaaaagtggggatctttcccatcactctattagctaagttttgttgtttcgagagagaaatgaatattcacttttaatgtctctaacatggagtcatttaaaaaataccagtgaagttacagattgctcagccttcagcctgacattgagaatcttaacacatctgtataggaaagttgtataaataaccacacacaatgaaacttgttctgtatggggcctactttctctggtggtggaattattaaatgtggcaggtagacacattcttctaagttttgaactatggtctgtagaacaaagcagcttgtgactgtgatattgtcctgaatgtttgtgtttattgactggccactgtgctgacatggaactaggaagtgggcatcagaggctgtagagttttctgatttgtgtacctatctatatattccaggattatcctccagagaaaataacctatagttagagcatcagtatttggagtttcttccttagaagatcctggagatgatatcatcatctcaaaagcttaaacttcactgtaacccagtcatttgatttggggaagagagggtttttattaagatataattcacatgccataaaattcaaccgtttgaagtgtagaatccagtggtttttaatatattcacagagttgtacaatcattataatcaacttcaggatattttatcaccctaaacaaccactaatctactttctgtcgctctacatttgtctattctatatatttaatataaatagaattatgtaccatggggtctttgcgactggcttctttcacttagcatagtgttgtcaaggttcatccatgttgtaacatgtatcagtacgtgtatccctttttattgcctaataatattctattgtgtgcataaataccacattttatttatccattcatcagttgatggacatttgggtggtttccaccttttgtctattgtaaataataatgctatgaatattcgtgtacaaattttgcatgaatatatgctttcattttcatagatatatatttaagagtggaatttctgggtatatggtgactctatgtttaactttctgaagaactgcaagaccatttgccaaagtgactgcatgtttttaccatcccaccagcagggtatgaaggctctaatttatctacatcctcacaaacatgtgttcttatctatccttgttattatagcaatcttagtagttttgaagtggttttgagtggtgtctcattgtggctttgatttgcatttctctggtgactgtgactaatgactttgaattttttctcttgtgctcattgaaaatttgtatatttcctttgaagaaatgtctatcagtttccagtcatttaactttaggacctgttttcaaatatgaataaatctaaaaggtaaataattggaaatgagaaatgtagagaaaaatgaggaaaaaatttggtttatataaagtttccttccttttctaatattcttatctactaaatgactctgaatatttatttcttatccacactgcataaaattaaaaacatttttaaaaggccaggtttggtggctcacacttgtaatattagcacttttggaggccaaggcagaaaattacttgactccagtagttcgagagcagcctgggaaacatagtgagacttcatttctacaaaaggtccaaaaatcagccagcatagtgccatgagcctgtaagcccagctactcgggaggctgaggtgggaggatcacttgaatctaggaggtcaaggttgcagtgagctttcattgcaccactgcactccagcctgggctacagagcaagaccctgtctaactaaatgaatgatgaattatttttttaaatcattatttcctctgcttcaaaaactaaacttttagtattaaaaatgtagaggcttgcttttatttcattctgaatgaaatcctttgtcagagggacccagttgccatgtgctattcagggaaagatggtcagttctagtgctgagatatagtctaagatgcaggacctggatgtttttctcagattctttgattctccagggggaatcagaagatgaaaatcaaaccttagccctgtacatttcagaagcaaggaaaggactagtgagaacaccagctctctccactgctctgatcctaggtgtagtcactccatacctgttaactgagtaacagaaggatgcctcctaaaactgcgaaccattttatagagaagatatgtctattagaatttttcaccacagcaatggattatgggtttttttctgtgtttctattcatgcctcttccatgcattagatgagaagcaaaggcagaactattagacttcaaataaatttggcataatggttcaaaccattccaagtgaaaaggaaaaaatcaagatgaatcaaccaattaaagccatagttgaagtttattagtaaaatgtaaaggtatatcaaaaatgaatagagaggaaaatcttaattcaatgacaatatttcttatcctcagttatgcttgatactttcatgctacaagaaaagttaatatctagtccttaaatacgttgttgatttttcttgatccgcaactgtgatcttgtttaaacccacttagtatccagtaaaggttgccttcattccatgtgaccacagggatggcttaccccttgctctgtttatgtagaattatgtaatgagattatcatttctgcatgctagaaagatgtagtgtttaaccatttcagatcctcctagcattaaattcatcactgatgtctattttcggtaatctcttttcttattctgtcttctataaactttccatatttacttagcttgcccagtggagagcacacaataactgtcagtagcgatcatgagagtcttgaggattggggaaaagtgcaatgagaaagccaggaggctgaaatagaggtttgaaagcaaaagagaaagagggaaatgtctaagcttttctttttcctatttaaaattaaccacattacaggaaattgaggaaaaatgaaaaaaaaaaaaagatgctctcttcttcataatcccatacaaaacaaccactttattattattattatttttttgagatggaatctttctcggtagcccaggctggaatacagtggagcaatctcagctcactgcaacctctgtctcttgggtcccggttcaagcaattctcctgcctcctgagtagctgggattacaggcacaggccaccatgcccagctaatctttgtatttttagtagaaacggtttcgccatgttggccaggctggtcttgaacccctgacctcatgatccgcctgcctcagcctcccaaagtgctgggattacaggcatgagccactgcgtccggcccaaccactttaatttttatatatttctttcagtcttttattctatatattttgcctggctttatataaatcttgtttcctggttttatttaatatgatattatagctaattttttaccccgttacagtcttccacaaatccataatttttcactgctgcataatactccatcaggtggagacaacaaaatttaattagtagtctttagtatgacagagtttgaaagaactctgcttggaaataaaaaagatagattaagagtgtaaccataaaatgaaacaagccaagaaaattaagagagaaaaatttttgagcagaattccttccagtttttcaaaggttagacatgccaccatgcatgagcacaaagcacaatgaagactgagcatatatgattaagaggttagtttcataatcaaataatttaaattattatgatacatttaatgatatgtaaaattttaatagcactttatggtaattagacataaataataaattttaacataggtaaccccataatgtaattagggatgattttacataccaaacaggattctcaaagttcctctttgttctccagtactgttcttataatcgttgtcaatgtcaagtattaccctgacacttgtctcatccaatgatactggaagatatccccccaaaatgaaactttttgtatttatggataaaaattatttaacgtgcataaagtactgtgaaatacaatgtaaagaacactgagataatttggatatattcctgatttcaggtagccatagagatgaatacttcatttattcattcgctcattcattccttaagagaataataggaactaaggctaaagaagtgagtgaggggaagggtcaggaagagccctctgggtcagtgtaaatgatctgaacttgatttcagaggcaatagggagccgacagagacctttcagcaaggtttaaacacacacacatttatacatttttttagaaatgaacatgggagaagtgtggaaaagggactagagtaggagagatttgtggcaagacattgagtcagtaggagacttttggaaaatcccagagaacacaagggcctgctcaaaggcactggcagcaggatggaattgagagagagagagaacgcacatgtttgtaatttaagagattgtctctctactggaacaagctagaagggaggaggaagaggcttaaagaaaaaggtaagttatgcttttacttgaatttgagaagcctctggacagactagaggagaggtcttatttttaggtagtagactgaaacagagaaggggagaaacaagcccttttaaatgttaagaaggaagaggcagaaatgaaagcacacttgtcctgccagcagtacatttcaagaagtatagaatgctagacagtgctcagctacaacaaattgacaagaataggatccaaaaatggacacaggggtcatctgtgaccttagcaagaaaagtttaagaaagttcattgagttaaaacccagacattaataacaagtgtttactgactgttttctatgggcgggcactgttccaaggactttaccgtagattatcccatttaactttccataatcctgtgatatgttttctatcattatctccacctcacagatgaaaaaacaggtttggaggactgagaaacacgaggccaccagatagataataagaaacagctggggatcaaagcaggcagagtccacaagccaagcagggcctcaccacactaagtaatgggtcggaggatacttaggagttgaggaaacagtgaaaacaagtgtcgacatcccttctaagattccatgggttggacgacagaggctgggagagcagctggcccattacccacccctaggaagaatggcagatccttgagcagcgatgatgtctgaggatgggagaagcccaagcaaacaaacagtaaagtgatctaatgacgtgaggtattgggagaagttggggagggatgaagctttagtctgctggtttctgtcaagaaatctaggggtaatggtggggactttaagcaaaatcatggctgatgtgttcaagtactgcatgcaactgagagtggggtgctgtaggacatgcagtttgatagcagcataaaatccggaatcactgccatgggagatgtaaacgaaagctgtggaggaataagtaaaatcattactgagcagtcctgaggcaagagaaaataaattggaggttgtatgtaggtggctacagcattatgggtgaggtggagggtctgggggaacagctgtaaattgatgggtgtcctgaaggaaagaaagtacatgggtagatggcttcagtgagaatggagaggagtttgttgccgtgttttgttttttaaaaagactggaaaaacacgttctttaagtagtaaaatggaggcaggaaatgctgttacggcctccaagcccagagatgatataatagctaatgttaactgagcaccaaagtatgtattggaactgttctacacactttataacaagtctgtgaaatcagaaccttattagagttagctgggagaatgcacagctcctgtgtgtaaggaccaccagcaaagccaagtttcagttaccataaaaagttggaggaaaggatttagtgaaaggaaatgcaaccttagttagaaggaagagagtgggtagatgttttccctctaacaggaaaacatcagtgtttctcgtcttcacctgaacaaggtttcacctggagttcatggtaaaatacagattctgactcagagttctgattctggaaattctgattcaaagtttgagtgggccttgaactcatttttgaaataagctcctcatgatcatagaagtttgggaaacaccagtaaggggtttaaccaccagtgttagaaactgggtcagcagaagagaatgccagaaatgagggatgagagggagggaagagggaaagaaccagcacccagatgagcctaaaaggatgggagggagatccccagccctatactcaaagataagaggctccaagtctctgatctggtagaagcccacaagggactggagaccagtcctcacaccctaccaactccagtagccaagtggagtctcctggctcacatctttaacaaatgacatgagagcacacagaacatcaggtccctctaatcagttttgatatcgagaccaagtatcacatggtgtaatccaattttttttttttttttttttttttgagacagggtttcgctcttgttccccaggctggagtgcaatggtgaggtcttggctcactgcaacctccgtcttctgggttcaagtgattctcctgcctcagcctcccaagtagctgggactgcagccacgtgccaccacgcccagcttatgtttgtatttttagtagagacgtggtttcaccatgttagccaggctagtcttgaactcctgacctcaggtgatccatctgccttggcctcccaaagtgctgggattacaggcgtgagtcaccatgcccagctggtgtaatccacttttagggttaaaatatgtccttttctgaatcaccacctcaccccacaaaagcaacttatgcctgctaccagacacctaaaatcctttgcagggggaccaagggtccaccaccctctcacagttataacagacttaaaatgcaaaagccaggaagagaggatgcattgaaattccttcacagtacagtgaatccatcaatcaaccagtgtaaactactgatctcagtgccctgaacaggcaggttgaacaaagggattcgaggccattggaggcctgggtactggatacctgttgtcagccacctccctaagggaaacagaggtggaagggaaaaaagaagaaagtttcaagtaagtgtcatttttctttgttttacctcagaaggcccaaggctggcctgtttacattcagaatagaaaagccaacatgagagctgcgtactgaggtattcttactctgccagagcttacccaggcacagcttctcaggagtgcagcttcaccatgctcccagggctggaagttagcagaaaagagacatgatttttttttctttttttttttttttgagacagagtttcactcagtcgtcaggctggagtgcaatggcacgatctcagctcactgcaacctccgcctcccaggttcaagtgattctcctgcctcagcctcctgagtatttgggactacaggcgtgcaccaccacacccagctaatttttgtatttttagtagagacggggtttcactatgttggccaggatggtctcaatctcttgaccttgtgatctgcccgcctcggcctcgcaaagtgctgggattacaggtgtgagccaccatgcctggccttttttttttctttcttttttaaggagaaaagaaccgtctgtggctacttctaaagcagctgctgataggctctgattaagagttatcagtaggttccttcaaagtcttgaatcaggaagccacgaaaaaaactctgagaaaaaatatagaggggagtttgagagggctaaatactgattctcacagactttgattgaaaaattgtactgaatttgaaacacatgagcaatggttgttctcaaaggctccataattcagctacttcactacaaattcactgaactgcctctggttttgcttcaaatccctgccaccaccaaaaatgttagaggcaatcaaataccgggttataattcatggagattaatattgacaggcagacaggtccctcctctctgagtttcatgggattggcctccagtgaacctggacacttgacaactgttaggtgaaatctacatgtgcatgctgaatctttagggacgaatccagaatgtacccatgttccatgattatgatgaagtctaatattattatatttggggttttttttaaaaaaaaagcaaacatagactctgattttgaccagtatattggcaaagagaagatatgagctattattttacattgttattttaaaatataatttcataaatgacttctgtattacccacactctttagcaaaattcactaattagcaaaattggctaattctctgcttactatgtaccatcctagtaattggcaaacaaaaaaagtggcagcatcttatatctctgcattaatacaaattagcaggtattacagtgagagctcttattacttgaatacttgttcttaaaaatatatgtgtggggccaggtgcagtggctcacacttataatcccagcactttgtgaggccaaagcgggtggatcacaagttcaggagactgagaccatcttggctaatatggtgaaaccccgtgtctactaaaaatataaaaattatccaggcacagtggcacgcacctgtagtcccagctactcaggaggcagaggcaagagaattgcttgaacccagaagatggaggttgcagtgagccgagatcatgccactgcactccagcctgggcgacagaatgagactctgcctcaaaaaaaaaaaaaaatatgtatatatatgttaaaaatatatattatacataatatattatatatattatataaagaatatatattatataaagaatatatattatataatatgtaaagaatatatattatataatatgtaaagaatatatattatatattatgtaaagaatatatattatatataatatataaagaatatatattatataatatataaagaatatatattatatattatataaagaatatatattatatataatatataaagaatatataatatataatatataaagaatatatattatatataatatataaagaatatatattatatataatatataaagaatatatattatatattatataaagaatacatatatataatatataaagaatatatattatatataatatataaagaatatatattatatataatatataaagaatatatattatatataatatataaagaatatatattatatataatatataaagaatatatattatatataatatataaagaatatatattatatatattatataaagaatattatatattatataaagaatatatattatatataatatataaagaataaacatatatactatatataaagaatatacattatatatactatatataaagaatatacattatatatactatatataaagaatatatataatatataaagaatatacattatatataatatataaagaatatattatatattatataaagaatacattataatataaagaatacattatatataatataaagaatacattataatatataaagaatatatataatatataaagaatatatataatatataaagaatatatataatatataatgtatataatatctaaagaatatattatatataatatctaaagaatatatataatataaagaatatatatgatatattatatataaagaatatatattatatataaagaatatatattatatatattatatataaagaatatataatatataaagaatatatattatatatattatatataaagaatatataatatatataatatatataaagaatatataatatatataaagaatatatattatatataatatataaagaatatatattatatataatatatataaaaagaatatatgttatatatataatatatatgtggacatttatttgcccatggtatatagtacacacaaaattcacaattttttgtcacaatgacaactgctgctcatatttgcatttcttcaatgcttgctaatcaaaatcaagtgttccataatagatctgctaattacatatgtcgttaagtagtaacttcctcaaaaggctgtgttcaaagtagataatgccaagctttggaaggtcggaaggtactgtatatttatggtttgcatatctactaatttgtctcctctagttttacccatttctgctcgtcatctttaccacttgtttgtactgttttagagtaatccttccagctagcgttaatgccagtcttcccatctccattgcttatgctctagcttcatgtccgtttcctttgaatctagtgatttcccaaccaataaaagcgaacggagagtggtatgtattggtagacaattaaattaataaacctatatctgaaaagctcagaaacatgtagacaatgtatatatttctgtttgggggaggactgcagttaatgagtaggaaaggggaattagtacaaggtctaacaagaaactagagggatgcatcaagcagaacagaaataactatgcatttccttctttaacctttcctaatcatttctctccttttccttcttgttgtttaaaactttttcagttttagactaccagaaatttgcaaagaagtagcacagttttcatatactttttacccaataattacccccaatgttaaaatagtgcgtaacgatggtacagaggaccaaaactaagaaattaacatggttacaaaactattaactaacctacaaaacttatttgaatttcaccagtttttccattaatgtcctttttctgtttcagtatctaatccaggatacaacattgcattatttgttgtaactccttggtcccctgtgctagctatgtgacagttcttccctttttccttatctttcatgaccttgttactttggaatgtagtagtgagttattttgtaaaatgtcactcaatttgggtttttcttaccatgattagattgaggttatgcatttttggcttgaatactgctgaagtgatatactcttcttaggaagtacatgatgttgatgtatcttataactagtgatgttcatcttgatcatttcattaagccatgtccgctgggtttcttcactatgaagttacgatttttccctttgtaattaatacatatcttggggaagatattttgaaactatgcaaatatcctgtttcttttcatgttttcacccacaacttttaccatccattagtggttcttgtcagtagcaatagttaccatggtgtttcaatggtgatttcctgttgcactaattccttctacattcattaattggaattcttatctaaggaagaactatactttctcccaccactaatgtctctattcgcttagttatgtcattatgagattcatggatatttattttattctaagggttataatctaggcctatcatttattttgttgctcagattattcagtattggccactgggagcattttcaggatagctcatgttccattttaacttgtccataccttttgaagaagtttcttattttttggcaccgtgaaatgctgtaagtttacctcataggttccccgccacagcccaggaatgaaccacttctccgaggaagtctggctcctttattgtagaaaccaagatctgagctctaggaatactcattgcttgagtatcattgtttctagactctctcaggaaacagaacctggaaagtttacatagatagatagatagatagatagatagatagatagatagatagatagatagatagatcgatctaaactatgtctacacatatctatatttacttccaaatctatctgtatgcacattaaaaaaccatgagtttatactgatacctccaattctaatccaataccacagtaatcattctagcctcttcctctttcattatttgtaacttctttctcatgcagtaagaaagctgtctctgactatctgcaatataattatttgttcaaccctcatatattcataaattttttttcagaattgctaatccataccctagtactaagcagagtgcagtacttgtgtacatttctttttgcctttagctttgtggtattttctcaaaatacggttttctaatgatacttagttattttctttctcaagcccttcagtgtggttatgttagttatttgtaataacattagcttcacttgttatagtttgtatatctgtttgggttccctccataccttggttgattgttttaatgtacatacggtgaaattcactctgttgtatacagttctatgggttttacaagtgcaaagagtcatgcatccacagtcatgatacagaatagttccataaccccagatttccccctcacccctcaaatcactgatctggtttccatctctgtggtttcatcttcctggtatgtaatgaatggaaccagacaatatgtagccttttggatctggcttctttcattagcaaaatgtacttggtgttcataggttgccgtgtgagtagtatactgttgcatgggtgtttacttccttcttctaacctaatttgtgattcttgcccatgcatctaatgtttatatttataaaattgcccactggcttgatgcttattggattgctcctttgggactctgaaactgacttgaaactatgttttttatctccccttagcacagtttacctcacttcatcttatttactgtggttacttgccacaaccatcagtcattttaacattccaaggagggttacagccaacccttaattatttttggtaagtttgacagagagagaatggataattgaaatcttcacataatctgcaagccttataatagctacttcttcttccctcaactacttaaaggtagcaaaattgactcactttaagttttatatcctttcccttcctttacttatcctctggtaggagcactaatgagtcctcaggtgaccataaaaatggaaagacagagaaaaaggggaagcacaggctgtgggtaatctacataggagataaaaagcctctgagtcactgagaattgatgacactctagtaaaatagatctgagtagggattttgtgtctttgactatttttgattcctatataatgcttggtacttgttgattcaatgatggacttatggtcagtcctaaaagtccacctaaaataatatactcctactcagaaactgccaacctcctagctctattttccttcctagctgtgtctatgtgctctccacggcaaagcctgaggttaatttgtggtatggggagaatcttaattgcattaacgcaggcatttgtaacttaacatacatggataggtatacatagtcttttgggaatctgtgaactcttagaaattataaatagaaatgtatacacatttcctgggagagagaaccatagtttccatcacagttcaaaagtgtaaagcaaacaaaattaaggcctttgaccagcaagatcatctatagaactcctgtaatgctgacatactaaccctgagagccctcatactctgtttctgggagatcttcctttgaactctagaaacattcactagactataaattccttaagagaaaatattgaacctttttttttaatctccagcacctcacattagagcctgtataataggtatttgaaaaatacttcccgaattaatttgatatttttaggctgataggatttcttagtctactgatacaataagaaatctgattagcttatgttgtttgtgagatacataatttagtttgcaggaatccacaaagctttgtcatatatcagttaattagctaataaattaccaaattcaagtgagtttatgcagtactttttttcaagtacttcttatactcacaccacatgcctttctttcctaaatccctgtaaaacctagaaatatattgccccttctcttgctacctgatacagggagagtttgactgatttggaaaagaacaatatgcagtgtgaaatcttaacaaaaacgttttatgttagtgttttaaactttggtacacagtctaaattgcaaaaactgtgtcattatttagaatggacatgttccagcttcgttaatttataaattcctatagagggctttctggaaaaacactgataatccgtatgttcagtattctaaaaaatatacttagcctgagttttggaagcctagtgtgattctacttcatctaccaagtgctacccaatctcttttacatctcgccacgctaatctcttttacatcagataatggtaccattgaaaggtaggtagcacagccccatgctgtctgtgtcatttctgacccccctgactcaacattagttgaggcctaggctagtagctaccagtcagtgaaaagctcaatgagatatacttaaggtagctacattaattaaaatgcatatatacgtacatataaatatataggtatttcagtataccaatactttgcaaattgggatcccacagcctgaatttgacccatgtagaccttatttggaagccacagagtattaatttttaaaaaacatgagccaatatttaaaaatcaaggtatttcactaaacaaatttttaatttcaaaaatatttttaatagaaatcactggctcatgtttaaaactttctctataaatttaagtttcatgataggcttttatatattctacaaatttcttttagagctctagatctgcaattctgcgatattacaaagtctggaatcgtgttttgtctttcacctgtgaaaatgttactgttaatccacatatggtcaacaaaactggcattgagctgtttttccgggagaagtgatggattcatgctgctccatccacatattcttggcaagtgcccttttgaccactggcatgtatttttaagactctctggggttgggaggagagcctgtggtaatggaaaagatccaagttaactggcccacacaggggagccaacccatgaccttgaccccattaccacagtgttctaaccaattgagctaaataattgagtaattgtttcttagcaatctgatcaaatcagatggcttataataagactctgtctgtgaacaagcgtgaggatgtcagtgaacagagagcttaggataaggggaaagttatccagtctgcaggttggttggcattttatatttggccaagtagtcaataaattggactttgtcattatggctaattgcatttctgagcaatgagaacttaccaaaaaaaaatgaaactttaattaagtagagttttttttttttgttgttgaaggattcagatttttcagttcataattgacaacatatgtacaaacaactggggcaccgagcaggagggaaagaactttgtgctgagttgaggggttcaggtccctgtttgatcccagctacttagtgtgatagtgtgaccttaggtaggtcacttgactttctgagctttgggagggattagataaacatgatctcacagatccccctatccctaagaaactacctcttaatttttaaaccaataaaaatattttgcaacagatttcttcctaactaaaaatgaaaatggaatatttttcacagaggtagataattaaacaatatttcgaaagtatttattgaacaagcttatttttgaaatatgttggtgcttgcataaagtcagtcagtatataatatgcatatttcacacagaaatccaatacatttataaatacatagaccatagttctatatactatgtgattggttcttaatggcattttatatttcaaagcacttatgaatccccttgaaaatgttgccttcttaaataatcattgttttagatgcaagacattaatgaaattgctttggaattactattcatgaatcttctgatttgggtccattaatatggcctttgtagaactacctctcctccctctaacttgctaaatttagattaaataatttaagctcaggctttccttaccaaattgttcatttttctggttcttctttcttttctttcttactgatgcactcaaatattacttttatagaactgagataatgggtggatttattgttcttttatccaaagtgattcttccatcactggattgactggattagtgagcatgtggagctcagtaggatgggtcctggagagtgttagggttggtgtaaaatgaatgacaacagcttagtcacacttgaaaaaatatattggctcgagtttccaaataaccttccaaaatgaaaagcacaaatactgtgggtttctacagaatcaaatatgactgtaatgtttgtaaaaaggattagttattggaggtcacttcaatattaggtggggaagtttagaaatactaaaaatggggagaccagaagcattaaatccaaagccaaatacaggttgcagatgctctgggtaatggttgccagtccagccgtcatctgagtgacgctgctggtgttccctgcaccttccagagccgttcagaaacacaggctgccagtttttaatgcattatggcagattatgagacacctctgtcatctgaataaacacgtagctgggcagaagttttcaatatcagttctttatgtgataggatccaaaatttatctcatttttaaaaagagccccagagatgaggaaacactctctggtaaatttacttgattgagagtcacccacatttcttttaaaggtatgctcaccagagaccccatctggaatgttccactcagaggctcagacctctggttgatttaattatgtgcttcctaggattgtgcatttaattatatatacacaacaattcctagcaccggtttcttttgttattctgtgagaacactggcagccattttgaactgtggaagagtattctgcatctgcaggaattactcatctgtggtattgaagaaaggaaaaattagccattggtacaggaaagggaggaagaacaaaatacacttacatagcagaatagtagtttcacagtctagtagacaagcaaataggaggctgatgctgtggacagactataaatcaatttctgatttctttggtcaaattgtaaatcatcactatgcgctaagctaccatgcatttccaggtgagagtatacaatacttttgtgattgtgtgttgtttgtaatagctctttctgaattacaggtgattagaaaaccctgttagaaatcaagttgttgttgtttaattctggatatatttgctttagtgatattatgctgctggagaatggaattatatctacttttataaaactatattaaaatcccatgggaaatctatttctatgaaaaaaaaacttgtcttttgttcaggcccctctggataaaggggaaatgttgttgatcacaatggccccgaaatgactgtcccatcacactaggtcagctccttccagataaggtgctatgggtcctggagggtgcctagaatattcatgatgtggttcaatgaatggataacaactatacttaaaataatgaattactcctcattttgcagttggtaactctgtcttgctcatagatcccaaatttctaaactcaaaggagaagctaaggaaagagggggtggttctaaacttttaagaaacgaatggagatccttgtaggcaacattcgtttgacaaatttcatagaaacttgtgacttgttggccctagaagagtcaatgttgtcttatgtagaatttcatttgagacattcaggatataaatttttttttctaagtttattggtagttgagaatcagttccattttatggcctacttttaaggtacttacacaataaaaagagatattagttaactttaacatcaaaatattgaaatctgatcccttgccttacaaactaagttagggctcatattttccaattacctctttcttcaaaagaactcttctatgaaagagtacatacaaatggaggtattattattattttattattattactttttgagacggggtttcgttcttgtcacccaggctggagtgcaatgacgctatgtcggttcactgcaacctccgcctcccaggttcaagggattcttttgcctcagcctcccaagtagctgggattacaggcacatgccaccatgcccagctaatttttgtatttttagtagaaacagggtttcaccatgttggccaggctggtcttgaactcccgcctcggcctcccaaagtgctgggattacaggcatgagccactgcgcccggcctgttatttaaaattctcttaatggtaggatgcaatctaatgtcaaagatgtgtagcgtcaaaactttagagagcaaagcaacaacttgacacatatatttatttgatactttagattaaggaggccataatttctgaaactctggaatgaaaggtctaagtatgagatagacatcatgttttttatagaagacatcttgcagattaatcatctttaaagatggctttgggtttaaatttcattcgaggaataaatttgagttctgttgaattgagacatctcagaaattaacccccaacaatttcccttattcaaaattgcttttacatttatggaaaacaaaacaaactttttaaaaatcaaagttgagagctttcaccttttaataacagtttcaaacttaatatagcttattaagaattaatataataactctttttattgtttaagcctctcttaccagctctaccatgcattaattatttttcttcttttgtatttatacaataaatgcttgacaaaaaaaaaaagctacataatttaagatttttatgacacaatggaaaagtttcttacccccaggggaaaaaacaattctatgatgttctcattgtctttccaggcaaaattttatatattagaaagaagaagaatatgaaaaaaaaaaaagctctagttatactttctgtgatgtgcagcaggtttggaatacatggaacataaaagaatattacatgagctataaagggttaatgctgtgtgttcttaattttaaatttcagataaatatgatttcagctgtgatcctacatggactaattcttttgtcactcaactaattaattcggtatgctagagaaaagatgcgaatttgggcatcaaagaagtgataattttttttgtttaatcagttataaagataagttttactcccattagactgggtctggagcccaatcattttattcttgtttagtgcagatgaattccatagaaaatgtgccctgtttctcttaacatctgaagatggaacagtaggattcaggattcctgttaaaatggtcctttgcaaggtaattataaaaaaaaaaatcatttcttcatattgtccgtttgttctccatgcataacaaggcagacaccatcatctgttcgttccgatcatggaatatatacaaattgcccatgtgttactttatgctatggaaagtaagttgtatttgatgttttatttagagactgcagatgaggcctccagcttccacagaatttttagttagcccttgttggatttattttctttgacatgagtcagttttttcctttctgggcagtttgctgagatgaccccatttgcctgtcaatggtaacttcagagctgtttcctgtggggaccatttccttctgcaggatgaatctgtggccagtgtggagcaagctggggccaactgggcctgggaagggcaagtcaaacgggcaacctcccacagttgatagaaagttcagcagtgaagtatggtttggtctcaaaacactctttcctttcctagttttcgggtttccggggcaaaggaggtagagaaaagggaaggaaagaggaagaaggggatgttgtgggcgcacaaatgcgaaggcagtatctggctattgactgaagtctgaattccagccatgtgatctgtttaaggcagtgttagggctttatgcacatgccatcagttgtgtctatttactcaaccagccttcagaaaagcccgaagatccacttaaaaatcataatcatgaaaaggaagaagacatattttctactgctttgaaataagtaaacatttaacaaaaagaaaagcttttttaactattaagaaaacataaaaaatgcaaaaagatctatttccataatgttcctgttaaatatctgtcccagaaatcgtaagcatttcatctgagtcactaaggctcttgactaccatgttttgaagccagtgaaagtgtatgaaagcaattaatcaaagttcactgcgctcctgaagagtatttcttcttctggaaagcagaggggtagaataacttaaaactcaatgacagtgaataagctttttagagtccctgtttggatctgaaaatcataccttattagtatctttatctttcttgcccactcattcacgcttatttttatttaattttaatttctggcctttttttcataagtttccctttttttccccctaacagagtgctgctttaataatctcagagtacagtttttatttgctacagaaagctcagcaaaagcaatatccagtgtctaacaaatctcttaacttttcttacaaatcgtccattcagaggctctctcttttgtttgtttggtttaaaaaatattagttattggtgatctgtgctttactttactttctggaccctctagaattatttttaacgtatctggtatttctaaatccattgcatttcctagcccctcggtatggggaaagcaaattagctcagggattcccagcagctgaatttagctagagagctgcttaaggctctccccagcagatgttttatccacttagaagttgtagaacgttataggacctccctgctttttaatcctaaaaacaaacatcaacatatttgagatctgaagattccctgattcagaatgagaaattgccatgaccaccaatttcagggccacattctagaaatgagtgacaacccagagaaaagtagctgctacatcttggctggataaaaaaggttggccttaaagagggtagcagacacagataccagtgggattaaacaggtttgttgttttcatatagcttgtcatcatcttggaaacatataaacatacccaggataaatgtctaaataacatatcaaaatttaaaaatttaattagaaaacttaatttcagggtttaaactgcctgacccagttaggattaattaggaagatttttaatattgagtttgtcgttcgttattaaagcatcaactcactcagtttctacttgtgtacacatcctacaaggcaaatccctatctacttttgcatgccatggaacggatttagagtttaaaacacagccctactgttgtgaaaagcatcctgggttttgtagcattttgcctccctctttaaaagctacaggcatagccaaggcagtgtgggggaccagaaatagaattagaatatttttccttcttaatgaagattgatgtgcaacaaacacaaatctgtttattattctatcaataatattaacataaaagtgagtaatgtccttagggacccccaaaaaggggttgggatgggaactctaattggtcaattttcactgaatttttatcagtctcattaactctcaagtacaatggaaccatgtgagataaacaagaaaagaccttcgtgacacaaattttagaagcaaaagctgcggttcacaaaaccatatgagattacaatacatggaagttaatttcatcagcatatgcgtatgctaattcagaacccaatttagaatacatctgacaagagaaaccttttatagggtgaatttcagaatcaactatggaaataatagtaaagggcctatgaacttctctgcccctatattttgcttgaactatttcaaactgtgtaatttataaaatgtaaggagctatcatgcctagtttgtaagtcagctagttacagagtggacaaacaatcatccaggtccagaaaatactatgactgtgaagtttgtaggttttcacatgtgacattgttccacagatgtcagactttaatagtagcgatgactagatgttgcagttttttccaaatgcatcatagacacccaaagacgtttcctgataggagaaggagatatacagactttgtttcaaacttttcagctctctttggattcatagctaagcagctattttgaacaagagtgaatgaactttttccttgcctgactttttagttctcacaggacattgctcaggatcacttttgtatagtgtgtgcactaagaggatgtaggttggtggtaataactgcataaactgcccagtgtgatgtgggaggaaagttgtagatagacagaatgtagccaccttaagaagtgaactaaatgagagagtagacaggaaaaatgccagaggacaagctgtacatattgtaaatttgaatcattcatcagcgtatgtatgggagtctaggaggaatttgaatgtcatcattacttagaaaacccaaggaaagaaatagaaacagaagaaaatatttgctgagaaactaggagaaaactattaagaataatattaaaatctttattatatagaaaaaataggattctagggacttagtttaattgaggggttagatatttacctgacaatttatgttgttaatggttcaattctgtgtgcattggctattgtgatgtgtagtggctgctcagtaaggaatgaatggatgaatgaatgaacaaaccattatcaaattccacttttccagatggctgttcacaacccccctacctaggcaatataacaacattaaggaggtctgtgtggggggtttttctataaccctctctgaggttcttgtctaccttgggtaattcaatctttgatttcttaaattctactaagagatctcattttgtggatagaaaccatttttcttatacatgctgcatcacattaactgataaattaaatgccctggaattcctctactttctctttaccagctccataaacaagctattttcctctcctaggctgctgatctttctgagtctccttccatctaaggctaatctctccagagacactatctctatcctcctcccttatcaagaactttcatctcctatgccaatgttcatagcagccttatttacaatagccaaaagatggagacaaccccaaatgtccatcagtggatgagtggataaacaaaatatggttgtgtaactgcaatggaatattattcagccttaaaagggaatgaaattctgacacatgctgcaacaaagatgagtcctgaagaccttctactaggttaaataagccagacacaaacgaataaattttctgtgatcccacttatatgaatttcacatagaatagccaaattcatagagaaggaaagtcaaatagcagttaccaggcactggaggaaggagggagtggggagttactatatgtagagtgggtacacagtttccatttgagatcatgaaaaattctggacatgaatagtgtgatggtttctcagtgtgaatgtgcttaatgccactgaaatgtacactgaaaaatagctaaaatggtaaattttatgttacgtatattttaccttaataaagagggaaaagaaatttattcttctctgtcctccatctccgacctctcactctcttttcctttcagcaactgaaatattctatggtataagccaaattgaaaacctccatcttcagcactcgactgcacctgcagctacctccctcccagccaaccattacccagtctataatggttgtacagacacttatacttacccaccattcactcttcagatcatgcctacatggcttctgttcacactactccgctgacccttgccaaggctatgaatgactttatgttgccaaatctaatgaacgcttttcagtcctcacctcgttgggcatctcagcagcattcccatctgttgactttgtccatcttcttgcagcattctttaaactcttttgcaaccacattctcttgactttctttctagctctcttgctgttctttctctatctctgttgtccacctgcctctcccccaacccccactcgtgtctctgatctttaagtgttacagtttttcaggacttaggcatggactcatctactggaatttcccaaagatatattacaataataatcatgttttaaattgaatcttttgatacctcttcattgactcaccatttccaaatgactatcttctcttctcaatggccacttctctagttcaagccactgtcatctttcaccgattcctgcagggatccccagtcagttaaatcactggttttaattatgttactgcttttacttgctgctttttacttcagcatcaggatggtctttttaaaatattcatcacattgtatcacttctgctcaaaacacttggttcctctgccgtttctcctccactaactctgtctcctagtttcctcacctagcttctctgcgccttgaatgactgagaaatgacctcccatcactcttagattaaaccacaagcttctctcacacctgtccccattggcttttccatctgcatcctggcggagtttcctctctcatctcccagcctctggccttcttttactgttttgaatacatcaagccttccccacacatgtcctttgcatgtgctgtttccttcaccctcaagacttttctcccactcttcacttgtctggaacttctcactcttatattctcagcttaaatctatttttttcactgaggcatttcccaggcagtcacttccctgttattgtctcttctaacatcctttacagcacttatcacaactaacaattatggatatatacttgtttggtaactgtctcctctgttagaatgtaaatttcatgacgatattgtgtggttttgtatgccaacataatattaacctatatcaattgcttataatttctgacagctagtggatacctaataaatattttttgaaagagagcgagtaaggaaagaagaaagatttttccatgaatctgtttcatatgacctctatagaaatgaacagagaaatggacaggtgttttaagcaaacttataattcatgaacatctaaatttacataaagcgtatgttgaaaggtgatttttccactttacaaaaaagatccatcataagattctttaaacaggcttcccaggtacatgtaaaaaaagattttattgattaaagccatatgtttgcacagaattttttaggaaaatatcttttatataaagtaaggttgacctctaagcaatttccttaaggcacctagcccagaattgccaactctcaaatttctaaggtaacagataatgggaggcctggaatgcagtgcatatttgaaactctagaatataaagtagtaattttagccattcagggttcgtgacttttctcacaaaaatagctaatgggaagataaacctcctcaattcctctttctatatctcagtaaaagtaagagtggctgtgaaatgatccccacaaaggctgctacagaaaggaaaacaaaggcttggaaagtcaccaagttgaatctttccccctcactctctcccccggtccactactgccactactgataattaagttgtcttattgcaaaatgaaaaagaattcagtgtgttaataaataaaatgcaattaacttctctgggtctcaatttcctcatcttaacaatgcgggagtttttgtttttgtttttaagattattgttttataatgcttttcttgggcctacccaaactttacaaaataaggtaatttgtaatcattttctctggctaataaaataaatttcacatgtatttctgcccttcttattggaaacttgaatcgaggatcatgaactttaaatcaaagcatttataatatttgtagaattgcttgatttgactgttattggcagttcttgctaagaagaaaatactttgcagaatttactttcaactaacatgttttttttcttaccaaacatattccactgtgagggaaggataatgagctattgctgaactgcagtacaagtcaaacattttagctaccagaaacaaaaataatttattgggtgtggtaataaacatcaaggtaggctaggaaatggttagttttacccttcaaaaacaagactgcttttacctcagaaatcccaaaagctgcaaatataggagaaataatatgggacatggaaaaaaaagaaaagcctgatacctgtaaagcttttggcaaaatttttgccctcatcaacctcctaaagcattatttctaccctgactccccaccgtgttgaatattttgcccaaacattactatatttaatgacattttaagcaaaagttatgtatctcaagtgatgtactgagctattaacttctcacgtaaacatacttagagtaataatgttgacccctaagactcttctgcatgggtctggaatgctaaagaatgtattcatgaaaacattatttagctatctcctgctttgtaggttaaggagaagtcttgaatgtatcaggcaaatctgaattatatttgaaagttaatgttctggccgagcacagtggctcacacctgtaatcccaacactttgggaggccgaggcaggcagatcacctgaggtcaggagttcgagaccagcctggccaacatggtgaaaccctgtctctactaaaaatacaaaaaaattagccaggcttggtggtgggcacctgtaatctcagctacttgggaggctaaggcaggagaatcgcttgaacccgagaggtggaggttgcagtgagccgagatcgcatcattgcactccaacctcagtaacaagagtgaaacaacgtctcaacaaaaaaagaaagaaagttcttatatttttgtctgtatttttctcttttccgtacttctgtaaatgatacatggatatttcttcagtgaaaaaaaaggaataaattcagaaagggaatcaggaaagagagaaaaggacaaaaaactagactgggggatgatagcattagagctgacagttggttcgccagagtcccaagactagactggctacaaccaaaaaactacagtaggagtagagagagatggagagatggcaatggagggagaaaatttaggaaagaagacttgctaattgaaatagtaagttgagaaacatgcagaatactggaagaggcttctaggaaaggcaggaccatggcacaattatgaatataagcaatgccaccttccaggtgtgatactcagagctccgacttgactaacatcctctactatgggtcaaaacacagtctaggaagctgcaaatagatgcccattgctatgggattctgaagaagacagaaacatgtgcttgttttatgattcttctattattctgattgcttacagtacaggactttcttcaaaatttatatgtcaggtcctcatgtgaggagactctgattctctgtgtgtgtgctggggcagggttgggggtatgaagccggcccatacatgtataatttgaaaaagtctaagaatcgctgggcacggtggctcacgcctgtaatcccagcactttgggaggctaaggagggcagatcagctgagttcaggagttcaagaccagcctggccaacatggtgaaaccccgtctctactaaaaatacaaaaaattagctgggcatggtggtgcatgcctgtaatcccagctacttgggaggctgaggcaggagaatcacatgaacccaggaggcagaggttgcagtgagccgagatcatgccatggcactccagcctgggcaacaagagtgaaactccatctcaaaagaacaaaaacaaaaaatctaggaatctccccaagttttttttgttttgttttgttttgttttttgtgtgtgttttgttttgtttgtttgtttgtttttgagacagagtatcactatgtcacccaggctgggctgcagtggtgccatctcggctcactgcaacctctgcctcctgtgttcaagtgattctcctgcctcagccttctgagtaactgggactacaggcatgcaccacgacgcccggctaatttttgtatttttagtagagacagggtttcactatgttggccaggctggtcttgaactcctgacctcaggtgatccacctgccttggcctcccaaagtgctgggattacaggcgtgagccaccacacccagctgcatcttctttttttatttcaaatgtgcagttttcattttcctaaaagtacaaaacatatatggtatttttgtaaagcatcataactgccactgtgcccttgtaactatatacatcccaggcactcaggaatgctcagaacatactaacccagagaaacctccctttctggggaattgtattatattttcattgtgttccagagctgactcaggaagctggggctgcattagagagtgattgtgcataaaggaaagcgtacaggcagagatcgggttctaatctcagccctgccctgactctggtgggaggtcttggtcaaggttcgacacctctcagagcttttggttcttcactggtaaaatgagagcattgaacgaggtgttcaataaggcctctcgtggcactgtcatggtgtaattccaggagtttacctttaagtgccaatgacactggagctcgggaagcctgcttaggagattgataagcttttatttatatattaatgataattctttagtttctcactctctattgcattaataggtcatcataattagtcttgaatatttgtctatctaaataataaggaaaattttcaaattatgtatgcttaggctgccccttctcccctaccttctgtcgacacatacaaagggaatcagaatctcatcacaggaggacctgacgtacacattttaaagaaagtcctggcagtagcttacatctataatcctagcactttgggaagccaaggtgggcagatcacttggggccagaagttcaagaccagtctcgccaacgtggtgaaaccccgtctctactaaaaatacaaaaattagctgggcatggtggtgtgaacctgtaatcccagctactcaggaggctgaggcacgagaatcgcttgaaccccgggtagcagagatttcagtgaacgaagatcacaccactgcacctcagtctgggtgacagagtgagacgctgtctcaaaaaaaaaaaataaaaactaaagaaagtcctacctctaagcaacctgagtaatagaagaatcacaaaacaagctgatgtttctgtctttctcagacttccataaaagcacgtgatattgtgcatgatgcatgataaatatgagtgaaaagaaggaaggaaggaaggaaagaagagagaaaagggggaatttcataatggcattatttttctgctttcattatcttattttagttccattttatgcaaaatgatcttgacttacttagaataaagaagtatgacttaatgagctcatcccataaatatcttagctctaccgcaaaaacaatgtgattattgttaacagccttctccttcacgtttcactagatttggaaagaagaaagaggataagggtggaaaggctgagcagaaaggtactctgaaacatggtggcctgagagaagaagagctggagaaaatgaaagaagagcgtgaaaggtgagcagaagtgccgagaccttcattttctttgactctatggtctgggtttaatttagatattgcaacagtcaactggagaaatttcattttaagaagtataggggttgaccgatctgaaaggaaaggtgtctgatacaaaaagaacctccctttctggaaatttttattctattttgagaagaaatttgcttcatgtttttactatatcagtgcctataattccataacacactaccacctgttttgaccataaaaatgcatattttctccatgtctttttttttccaaagaaaggtcatttggatattgatgtttagaactatccagttcccatagtctgttcctaattttagtcaggctgttgtataccttcttaattttattctgcgcaatccgtttgggtcctgtaatttgagaagtgaatgtccttcattctttaaaaagacactgtcttttattaggctatcagcaagctgaagagtatgttgcccatctgttaaagggccggcttcatttgctggaataatgctggtttgcaagagctgaattctcctgcttgaggagcttaatgttccatttggacaagaggtccttcacgtatctttgatgttaactctggcacttatcgcaagtggatgtgtaaatgtctgattttcaaacatgtaattgaatgttcatatttctcctgaaaattctttgccttcacaactaaatggagcttggagaaagactgagattatgacaaaaccagcatataattctaagcgtttgattctgacttcatcgtgtatgtactcagatttacacaacttttcacttgcttattagttacattagttcttatagtttctaaagagaccattcttgtattgattttattactttagtatgtgtactaagaaaatcatatctattcattgtgttttctagcacagaggagtctaagagtatctactgttagcctttgacccctattttgtagtctgttcccgttgagaaggctgactttttcaatagcaaggaaaaaaagctatttagtcctttctcatttttgagaggttgataagctgagttctaaggtcactggagcagttaaaaggaaatcaagtgttttacattgttgttgactattcacctgacagagctatcctgaagacatgaaagatattctccgtcataacctaagattcagcaatcctgtaatgtaaaatgtaatccaggctgagattttaatgcatatattggcaaaggcatctatgtggggagcctacatcatagatctttgctgctcccttgacttctcttactgaggttacatcccatgcctcatcttcaggaaactgagctgttttctagaatgcagactttacatttttttgtagctcatacttacttgggacaggggaaaaaaactcttagtagctggggaactgtgtgccagctagaaaattgataacccataaaataaggtgagttgtctttaagcaagggttcatttcctttctggttttgcctttagtaggcaggtgcctgagggagccttgttcttaaaagctgagctgtaaattcacttcagctggctgtataggcttcggatccaattttcttaaaatatgtctggtcaaaatagtgaaagaactatactattagcctccacttaggccacttcccacacatgaacacataaaacacatctgataggggtttcctagagacaacattgtctcaatcatgtgctagaggaagaagttgaggagttgattttatggttgggtgctatagaattaatgaccaaaggcatttcaacagctcaggggctgagagccacggatggtggaggtggaggctgaacatctggcattgctcccaaccctggagtcctgatccttagctctccatcatctatgggaaaccaattcacaactcttaaagaactcagcgagtgtatcactcttcatgatatggcaatgaaaaaaaatagaatagagtaagaaatagtgataaaacctattatacttttctcctaatatgtttgaaatttgtttctttgacgtgattcaagccatcctgttgcttacttgtctcatcctgtcataggtatcataatagatttacattagcatatctcattttcaaaatatttaatgcacctaaataaaatatataccataaagtactggagccagcttgtaccagcttataggaaccaattgttaaactttcaagaattttgtaagctggctgataagccattggcagttcgacattggctatagtgagtatatttatagcacagtttctctgaagacctagtttaccagcacactgctacaggtctgtgacagctatctttagtgcatatccaggaggcaattatccaaagaggcaggaaaaaaaaaaccaaattcaaccacatgatttcttgtagctgagtttctcaaaatgtggtccagggaccaactacatcagaatgaatcattagaagaccttgttaaaaatgaagattcctgagccccataccagacttacagaatcagaaccttgggagttggagcccaggaatctgtgtttcatacacaagcccaaggtgattcgtcagcagtctctaaagtctgagaaccactgacttggaggagcagaatttggctataacataaaactattcttatttagtgaaaaatgatacacaggatttttttctcaaaaggactgagtggcccagtctacaaatattttccttgttcttcatgtaccttctccgaaatatcttttcttactggtacaatcttttgtaaacaaattagaaaccctagccagtgctcactcaattaagggaatatgggtcacttgcccccagcacccctcatgcacacaaaacttacaaaagcaatatcagttcattaagaaaattttggaaacataaaaagtataaaaactattaaaaccatacataactctaccataatcccataaccactactaatattttataatcttttttttatgcatatacagttggctccatatccacgtcttccacatctgtggattcaaccaaccgcagattgaaaatatttagaaaagaaatttcacaaagttcccaaaagtaaaatttaaatttgctgtgccaagtactacattgaagctatgcaaatgaagtgatgtgtaggcactgtaataggtattataagtaatctagagatgatttaaagtatatgagaggatatacataggttatatgcaaatattactccattttatatcagggagtcgatcattcacagattttgatatccacagagtgtcctagaactaatcccccatggataccaagtgacaactctctttgaacacttgatatccaaaacctgcatctataacatcttgcttttttcatagcattatatgttgaacatttttcccatgtcattaatgttttaaaatatgtcatgttgatcactgcctaatattctatgagatcaatatacgataaactatttaccttccattgtcaaacatttagtctgttcccatttttatcccttttttctttcctttaaaaaaaaaatggagacaaggtctcgcgctacgttgtacagactggtctctaattcctgagctcaagtgatcctcctgcctcagcctcccaagtgctgggtttacaggcaggagccaccatgcccagactgttgccatttttcactgtttcaaataatacttggatgaatatccaggtacaaatgtctttataagttacctcctaaatcatataatcctattgaagttttaatttccttgtaatcattttaccctaggattgatctaacctcaattctaaattttaggattttatattctctctccccattcatctaatttttttgtgctgattttcatatctcattttaagttatctacatatctaattcctgatccgaaaccattttgctgctatatatggatagtttatctatagctacatgtactgaaaaagtccaaaaagccataaaagatgagttgggttactagattagattagaggaatgcagagtctagaacagtggttctcaatgggagggggcagttttaccacaagggcatttggctatgtctggagatatttttgattgtcataactcgggaagaggggtgagcagttactgccttttactggatagaggctagaaatgtagctaaaaatcttacaatgcacaggacagctaccctcccccacaacatgaatcatccaacccaaaatgtcaatagtacagagtctgagaaacccttttataatctccaggcttcacaaagagcaaggtactctcctagacatcagaattgcattgtgtcatatttcctgtggataatgcagagaaatctagatcagatgatataaccctagaaggattattagctatttgagaatggtacccaaacattactgatgaatatcccatcaatctaagcttgcaagaataatttttttcgttaaaatttatttttaaccttggcctgctgagcatcggcgttagtgatggtgacccgttgatcagattgtggttgccacaaaacttcaggggttgacaatatgtccgatgacagaatcagcaggaacaatggactgaattaaacgtaaagaaagttaatggaaataaatgtaaagtcttgcatttaggtccaaaaatgaactacacatacacaggatgtggaaggtttgatttaataacaaatatatgaaacatttgcctgatggttttagttgagcataagtttagcatgagtcaacatgtggatatgcctgccaaaagcttaatctggtcctaagctacattactggaagttcatgtacaaaataaaggaagcaacaataattctaattttacactgcttagatcacacctggaatatcccgtgcctctctctcacacagagcatgcgggtactaaatccaagtcttattaaaaatgttgaaagacctgagaatacacagcttacagaatcaagactttgtggatttctcatgcttgaagaactgtcacatagagattagatcggttttgtagcatccattttattccgttctactttatcagtttatttgcttattcatccattcatttatttacttttttgaaaacaaattatttgctttaatatttattttcttatttatgtatttgtctcttgaagatactaatggagcattattttaagagaggtagtattcagcttaatggaagggaaaagtccttaaaattagggtgcagtatgaggcagtgagtttgttgacactgaaactgttgaataagaagctaatgaaatgattacatttagaaagcattagttcatcacataaatattggactagatcagagttgtataaatttcagtcactgatctatttcctttattgtcttaattatatttatacataatcaaataaataaaatattataaaaatcatagccatgtaagttagcttatctaattaagtacattaagccacatagcacctaaaatcttcttgtgtatctttttttttttttttttttttttttttttaaagacagagtctcactctgtcaccaggctagagtgcagtggcatgatctcggctcactgcaacctccacctcccaggttcaagcgattcttctgcctcaccctcccgagtagctgggactacaggcacgcgccaccatgcccagctaatttttgtatttttagtagagatggggtttcatcatgttggccaggatggcctcagtctcttgaaattgtgatccacctgccttggcctcccaaagtgctgggattacaggcataagccactgcacctggccttctagtgtaccttaaatgctactttgtccttagatgatctctggggttcttttcagatattccagtatgagaaatatctaaatatcttaagtatggaagcatttacttttacttttctagagcaataattattgaacttgtcatggcattggtttatggtagtgcatacaccattgttacctgagtgtataagcccaagtttcttgctcaagattgtgtggtaggattttcttaatctcaagtaagagatttctcagcttatgatgtgtcacctcctgttacaagtcaaacagtctattgcaatgaagccctgcattaaataaactcatcattttgttcatgcttcagtgagattagccataataaaagattagttccaaaggcccatattcattgctagagatatgaacccagtgttatattcaaagatgatttcttccaacatttttcaaactaaattaaattagcatttttcacacattcagattatgtaaattagcatcttgagctgaaagcaagagattgtcttaatatgtcagtaagtatatattgttgttattcaattctaagacctaagtttgtaaccttttacaaagtatgaaattaatcagaatcttggacctgtaaaataccaaactaaatacctgtattcttaataccatctcaaaaatccagtggagattggttaaaagaaaaatatgtccccctcctcatcattaatttagtattactatcctgagaaaaatatctccactgacaccaaagactgtcttccattgaagtcccatattactgaccctgaaataatacttcagtaaatgaagttttctcctaaaattgaaaaaaaaattttaataacatgagttatatactccaaaatcttccattactcttataccatatcagagtttattttgcaggaagctcatttgttgtattaattaaacattgctttcgtagatcttactagaatcttagcaggatacatgaggagatgggagaaaaaaaagatccaacctcttcagcttcagcattgaaaagtatgaaaacatatggctcttgttttcaacaactagcctgaacggaatgtctaagtgagagtgaagctaagatttaggaaagttaatcggtttcagtgtctgaattcaaggttcttagttttctttccttttgggaagccttccaagaactgcagacttctcccttgccttatcagctgagctgcttgtggcctgttccctttagtttaaatcaatacatgtgtttttgatatttggcaaaccaagatttaattatgcagctgcaagttccccacataaacgaaatgcatcttagagatataaaaacattcagaaaccatttatagtttgagaattcaagtgggtgaaaatctattcccaacctctcagcattttatttaattatggaggatttttatgttactggaaattgaaatgaaaaccagagtaaggctagagtttatccaacatttgttcatattgaaaaatgaagatgcttattagagtcgaagaaggaaaaggaaagtattacattctggaattaatattttggttgtaatctacacacatataacgctcctaaatatatacagcaacaagtgaattgatagtattttgtcattattgtacactcaaaaaaggatgtattaaagaaaccagaaggttgatttctttaatttgccaagcaattctcaataattaattatttactgaacttaataactttggcactatttaaactgttgaaaacacccatgttttggcatgattacatacacatgattaattcagcatggttttactcatcactgaatatccctatcttttgcagtagaattttctaggtcctgtggtttgggtaaaatgttggaatgattcccagttttaatagtcccaatttattattactagtgaaccctgatcagatcatgggctggattagatcccagtttttcaaaatgccccaatttatggctcccttaaaatgctggtaaaaatgtgtatttgaataaggctttggttggctaaaaaagatccagttaattacttttagatccttattagatcatcactgcatggaagttatgaaaaatcttacttggtggtgtttctcaggacaaggacatgttctctttttatgctgacagaaagaagctatcagatttctgtttttcatagtactaaccaactcagtgaatgaaaagagatctttctgtatccctgtgattactattgatgctcgtgtaaaggtaaaaatatccatctttcctagaatgagaattaaaaatatagagagagaaagaacataaacacaatggcatagtagccatacacccacactactctttatttgggggccatttttcaaaatttgcctctgatttagagaaattagggatttagacacagcccggggtgaaggtagctttaatatctttacatttatttgatctctgtaacacctatcttctcagaaatgcttgcggtcaccaacaaaacttggcacattactgtatttctatagaccagagatggaaacacctacatcctaatgccatgccagcattttttatgagccaaaatccttttatgggacttgaatcaatgttagaagtgctgtattagcaactgcttgtcagccgagctggattaatacataaaatgaatcacttgactggcatgctttccaacagtcatttaggcaaacttctatgaagtacaccagctctctacaaattgttttaaataattttaaatatttttaaagaattcatgtaccctggagtgatgtattactttatcgtatgtagttgcagggctgttggaatacattctgaaaaggaattatactgaattacctagaacgattccacagaactgtttagagtatctgacctgataaaaatgtggaaagaaattttaaatttcgctgatccaggatatttggttgtaatataaacgtattaaatacagaaatagatattcaatgtaatccataatttttttgtaattcactggattttatgccaatcagagataccagagctgtacctcagagatacaggttgaatatcccttatccaaaatgcttggaaccagaagtgtttcagactttgatttttcttttattttggcatatttgcattatgtttaccagttgagcattccaaatctgaaaatctaaaatcaggaatgttccaatgagcatttcctttgagtgtcatgtcagccctcaaaaagtttcagattttggattttcagatttgggatgctcaacctatacagataaatttactttaatggggattaaatacagcagtggcagaatttgagaagagcattttctgtgaaagctttgggggactgtaagtaggtagaaggctgtttggtgactagaatttaggaatgagagcttctgttttattattcattttcgtggcattggataagccacttttgaggatgtattcttatagtttctatttttagtaccatgaaataaaatggtaataataatacttaaaggccccagtttcctacattttgtttggataaaatgctttttaacttctaagatctttagaagaaaaaatttgcgtaaataaaagtttagtgaacccagaatattttctgtaggccggtttggggctggataatatactagtaatcttaatttgctgaaactggtctctgaaaactgtggatatatcaaacttctgtaaatcaaatattttaaaagaatttgtaagtctctcatcttctttccttatttgaacatttgttatatcctgctttgggaagctttcatgacaggccaagtgtagttaatgttcacataggttggcaaactctatatgatttgaaaggatgctcaatctattgtcttctggaatcttctcccccgtcaccacccggcctccacccgccccatacccttcacatagaaatactaacctaggcctgtgatttacaaactccaaactttgaatatgctttttctgcatttcctggacagctttttacatcagtggttctcaactttgggtgattctgaccccagtgggtatttgacaatgtctgagaacatttttagttaccatactatgggggaagtgctactggaatctagtaggtagaactcaagcatctttctcagcgtcctatactgcataggacagccccctgcaacaaagaattatctgactcatgacatgacttgtgccaaggttgagaaaccatattttagatagatagatagatataatagaaatatactacagatattttagtaagtctgtagttgaacctaaggatatgtattttgaaattatttctcaagtgattgtcatttatagccatgtttgggaccaactaatgtaggtgatggccccagagagatgcatggccaaatggaaagattacaaggcccaggagtgggttaaagatgactctgcatgaacaaacttatctgcttcaagtctcatgtgttaaatgagaaacctgtctttcagattgttgtgaaaattaaaagcaatatttacgaagcacgcactggttcagtctaggtgctgactgttattttctgacctgctttgggaattaaaaccccagataacccatacagtagcctttgggagcctagaatgctctgagacacaccatctgtgaaagttgctgaattggatcctgttatgatgaaggaggccaagttgagcggagactttgcccagctgggagtcatgccagatacttccattcaagaagcttctcctcattttttattgatcgccggttggaagttgctcctcaagcatagtgagcttggcatgagatggcagcacagtagtgtggggggtgctggctgcagccagttcttggcagccctggaaacacattcagggagaagggacacaaatggtgtgggtgactgccagcctctccaagtccacagggcgtgtgactgcagaaaacacttgtaaccactgtcattaaattcacaaaattctcatatttgcatttccattctatatattacattaagggggtggcaactccgatctgctaatatttggaatccagtctttggaggaaatgggatgaaaatgtccttttcttcccattccactctttcccagctacctgcctttgccctggagtataattacttaatgaccttacagtgcatctgaaggaaattcagattgctgtcccaaggaatctgacccctttcccaggcacaaactcctgcctttttctggtttgtgtcctttgttagcatctcatattgagagttagagaggctgaagtggtttgggctgtgcacagaagtggcacagaagcctgcttctccaagaggtcgtggaaaagccccctcaaccatattaaacaacagtaacaacaatgggctgtttagatggaagatataagtattcatgttcttggagaaacttacatagataatttctgaagttatgatttcttgaagcagagattattaaattatgacaggttggagatgaatgaatcagtgataattgctttgatcaaagtcattcctctctctcaaactttcagtggctctctattgcctactgcatacagtgcaaactctttgtcctaacacatctgactttaacctttctaatcataatttccacccctgaccaatatgacccctatactcagccaatctggaatgttcatactttctgagattaacactttccaatcactgtgccatttctagtaccatttctgctgtctggaatgctcttctgtctgagttggtccgaatgaatggaaattcaatgaaacctcgctttctccattataccttctcaaactacctaagttggaagagaattcttccattacctatcctgggtcaagttgcttgattgtggtaattttcagtttctttacctacaaaatgggtatataacatcataggaatgttgtgagaattaaataagactctgaagtgaagcattcagaatagtgccaggcacagagacagccaataaatggtgaacttactatttttcttcgtctttctttgaaagagaatgaacatgagtatcaaactgttgggtttgaagcctagctgttccctgtactagctgtgtgatggtgcatgttctgagaaaactttctgatcttgatcatttgaagaagaaaaaaaggataaaaatatctagccttcagagttcctataaaatttacataacatgaaatacttaaagtacctagaactgtgcttggcacataatagatacacattgtcattattattgttgttatttttctgcatggaatcgtagatgtttgtatttacaaacatgccttctctcccttactacctcaccatttccttggggtgaggatgatattgtaatcatttttctgtttctctcaggatctaatacattatgtttcacagaataggcactcaataagtagttgctgaataatggatgaatgaatgaacaactataaaaccgtactgattttaattttatttttcaagtgaataattgctgcaatggaactaagagcagaataggctaaatcaatggtagacaaagctatagcgtttagagatataagactttccctgggctatgaaatggtgtcaagaaatatgaggttatttgtaactggcagtaggacagtggaaatgaatcattgaagcatagtggccagtccatcaggactatcaacacttgtttccctgtggctgaaccagatcctgagagacacagccttaaagtgaatgaaatttcatccacttcacagggaaatgaaaatgctgtgggcccagagagctgttgtttgttgttgttttcaaattgggcttgtgtccccatcccctttcattgacttaaatttaatcagttgaaattagttttaagtaccatttattttaaccttttaaaatggaagatacgcctttttagggaaaattgaatttggttgtatggatgagacacactgtccttggcttattcttgtcaaatgaggatatttttgtgctgtattttgagctgattcagtcagaattcatggtgctgattgtattttgggggcaggcataaaaaactaatgtagatggaagatcatgaaaaatggcaacagccatttgtgatgtatcagatgccatcaagctactctttcaaggaggcaataggactaaactccaagcccgtgattaggagtccatatcataattacattagagcctttgtcttgtaaaatatttctaatctatattctcctgcaattacatgtcttttcttcatgtctaagtcctaattctcttgaggcatagattgtaacttgtttcattttcttacatctcagtaaagagaagatattcagtaaagtcctggttgacttaaaagtataaaacagcattaaattttgagtaagttacttagataatttcaaaaactgacaacattttattaatcagtaggaaaagaataactatctattaaaatatcttgccaaacattcttgcttatttttgaaagtatagtggcctccttaaaaattaccttgattataatagtatgtaccagttttttaaagtaaagaacaaatgagtagatgaggaattgcttagactaatcattttttgaaataatagtggactctattattgacagcatcaacagctaattaaaaattctattagtgaagatgtaaaagatggcacatttccaatctagattgacactgaggacatagacataattgatatttgttcaataatcctaaaatgtttcacagtctctaatagaggctgtgattgccaaagaaagtttcaagtgctaaaaatatatatattctaggcacttaaagatattttcagatcaaataatgcacctttaaaaaaaagtaaaattttagctgaatgagcatcaaaggatattttagtgggttgactttgttttaaaaaaaaacacagagtcaagataatgtatggtgtgattcacatgtttttaatctggttatagtggatgtaataagaaagtcaaaagaggataatttgctagttggacttttaaattttagagaagtattttgtaatggtcacataaatgaatgcatattgaaaaaatctgcaatgaccattaaatattccactttggaaaaacaagatcatagctttaacaaaatgcttcaatattatagttcactgcttttgacaatattaaacccaaattgaatatgtttctatataggatattttcacacggcaacttaaaaacttggcataataattttcctacttttgataatcaattctgctcccaataattatagatttacctcaccaattatttcaaaggatggacagagaagtaaagccttgccgagaaaggtagtaagtgaaaccagaacattttacaaaatgttaagaaatgggcacttaattcttgaggaaacataactcatttcaccagcaaacaaaaatccaatgccaagaaaactgacattatgctaaaatattcaatgtctcaagtgtgtatacgacttaaggtaaaaatggatgcctaatatcatcagtgaccaattcatcccattgaatgaaaaatattcagaggaataagcacactctactgaagctagttgtgcaatcctcattgatcaatttgaaataaccacctacagatatcaattaccttggtccatactgctcttgctcacataagcttgactgtgcctcaattcaaagaaatttttttttaattgtgacataataaactaatatgatgtgtgaaccaacatgggaatttaagttctcaaagatatactgaaagattttgcctctgaggagaaacacattttactaaaatcatgccaattgacacaggaaatttgatgaagatctccaaatatcacagattaaacccgaaatatgtagtatgtttttacaacttttctagggcatttgaaaacatatgcaactatgtagacatgtttatgattctatttacacattcatttttacattgccctataatcagatgacacaggaaaggaattttttttcatttgaaggaatatgagaaacagtttcaagcatagactagctgaggagtagggggctttattttattactttgtgacatcctgagggcatgcttctggtatgaagaagacttagctgtctgaaagtattcctgtttgtgagaatacctttaatgctgtgaccctgggtgtgcctgcatgtgtgtgtgtctttgtgtgtgatatagttacatagatagataatatgtatataggcttaatagtgtctggtaataccctgctacatcctcttatgagcatctgataaccattccttaatgaattggaaaagtattattttagttaaatgaatgattacatactacctgttttcatgctgtgtataaaaggataccagtgaagagaattaggttcttggagaaacagggagatgttgaaaagcaatcaagaaaaatgttgggggtaaagggactggaacacctgtggggaaggcaccattcctcctcacatatgtcttcatccctgaaaatctgctaagcccttggcctgcaggtgagcagcatgcacaaaagtagatttgttaattttctgaaaagaatacagctggctggctcaaagagttaaggcaacatgataataaggctgatatcatataaactatgcccctttatggaagattgatgcattaaaaaaaatcatgtaagtatccactgtagtgcaagtactgtaatagatgctaaggactcaaggattaattttttttttaaggagaaataagatttcttggtcttcttacaaggagctcaaaactgcacttccaaccccaggtaaacatctaaaaatatattctgttggaccttcaaggccttcaggctaagggaacaactgaacctttcttttcttttcttttcttttttattttactttaagttctagggtacatgtgcacaacgtgcaggtttgttacatatgtatacatgtgccgtgttggtgtgctgcacccgttaactcgtcatttacattaggtgtatctcctaatgctatccctcccccctccccccaccccccggcaggccccagtgtgtgatgttccccaccctgtgtccatgtgttcttactgttcaattcccacctataagtgagaacatgtagtgtttggttttctgtccttgtgatagtttgctcagaatgatggtttccagcttcatccatgtccctgtaaaggacatgaactcaccctttcttatggctgcataatattctatggtgtatatgtgccacattttcttaatccagtatatcattgatggacatttgggttggttccaagtctttgctattgtgaatagtgccgcaataaacatacgtgcacatgtgtctttatagcagcatgatttataatcctttgggtatatgcccagtaatgggatggctgggtcaaatggtatttctagttctagatccttgaggaatccccacactgtcttccacaatggttgaactagtttacactcccaccaacagtgtaaaagctgaacctttattttcaggaggaatacctgagagatcaccaaagggtagagcagacttgtcatctccatactcaaaaagttgcatagtctctcccatagtttattggatgcctctctttgcatctcatcctcatggcccccagcctgatctccacaggctagagccttccttgcaagatcaatccagcccccttaacctttcactgaaacacagaaatttttctgaatctgctctgcatttagcagttgtaggcaccctgcagatggggcctcctctggaagctggccttctccgggaacccccagtggaggcctttattgtgtcccacccactttgtgtgcacttgaaaatctaacaagcatgtgttttcctaataggcagtactccttggataaactattgttaatctgtatcatcttgtattctcttgtgtctttttttcttctttcctcatttttcattttttacgttttctcatatgaaaggtcacctttacttggtcacttcagtggaatagttcccaatttcaggcctaaaagcttataagaaaaatgtgtattttgatgaattttcatacttttgatcatctggagaactaatgtaatctgttttaggtccctggacctttttccttgagatgtgctgtcacacctttgaatctgaggttaaattgaagttatatgaaatttttccacttagaggatttgggtagatatcttctgctatgattcacttttgactttttaatttttttggcctgaactcttcaataattcagcaaatattaattgagcatctaggcacatgagggaaatggcaagatgcgtaaaacacaatctagtccctgccctcaacaagttcatgattaaggagagagcagagagaccaatacactaattataataaagctaactatgataaatgctgaaagggggtttaaaaatgctatatgatcacagagaaggcagccatgagaaaatagtgttgtagctgggacaataggacacaccctctttatcacccagtatttccagacacttgcaatgaaatcattagattcaattataaagtacaacttaactgtgcagcaaattagaagagactttaaaaaatttaaattcttaatcccatcaataatacatgatatttttgctgctgactagagagaaatttaagactcagggaaaattttcatttaaaatctaagggattttccaagcaatcagggtgttttccattatagtttctttctctaaagctgacagaatatagtaaaaagtttagggcaaaactttctgggaaaatagcagttgagacaggcagataactttgggtcataaatttatattactgaatattctgcagatacatacaaaatttatttaaatattttaaactataaactataatcttagtagcctagaatgtttggccaaaatatttctatacttataagtgggttacaaactattcatttgtatatagtactatgtaatatatatacatacagtaatacagcactgatatggtttggctctctccccacccaaatctcatcttgaattgcagctcccacaattcccatgggtcatgggagggacccagtgggaggtatttgaatcatgggggtgggtctttcctgtgctgttctcgtgatagtgagtaagtctcacaagatctgatggttttataaagaggaggagttccctgcacaagttctctctctttgctggccaccatccatgtaagatgtgacttgttccttcttgccttcgccatgatgtgaggcccccactagccatgtaaaactgtgaatctattaaacctctttttctttataaatcactcagtcttaggtatgtcattatcagcagtgtgaaaacagactaatacaagcaccatagtaaaaaatggtggagcaaattgaactttctttacagttttgaaaaactgaagaggccaactagggtgaccaaaggtcagttttcccccatctattgacatagataaggcagaccccagactgccagaaaaaaacaagttccatattacatacaagtcacttactctttaaacttctcaagttagtaattatcccaaaacttcattaatctgcagtctcttctgaacactccactagccaggagggaaacggggaaaggggagaatcaggaagaaataagaaatgcttcccagtgccaggcacatagtagactctcagaaatgtggattaaatggatgaggtcaggtcacagctaatatttagttacttcattgtgattcctccatacctcaagggttacaggatgaaaactgcagtggagaaggatggtcttcaaatgatgtccctccctcttcaaaaaaaaatctgttcagtgaatgtggctaaagcaaattaaaggattcatatattttcgaaagatttgcggccaagagattcgaaccaaaagcatttgctgctttactctcaatcaagcagaaaattcaattaaccgtaacacacctggtcccctgagcattctggccaatccaggttatacagcattgattaaaagtatctactctctgtctagggttccaggtggaattgagaaggagctaaaagaagctgtgtttatgcttttcaagagctattagtggtgtgtgcatgtgaagactgcataagtatctctgttctctgctctctcatctcccctgtctcagatgtggataactgttactgttattcctaacaattgctatgtacgtgccagccacactcttctaatagctttagtagtattaggtcatttagcctttttcctttggggcaggtactattatatctctcatttgcaggtgacagaaaggttaaataatttgtccgtggtacaaaattagaaagtggcagagctcagtttccatcccaggctgtctggctccctacatcaccttgcttttccatttctgaaatagcagagtgttcacatatccatcaacacctgcaggtctactctgaaaaaggctttgcttcagtggaactgtctgggtgaggaggatgctgcctcccatgaagatcttaaggcagaaatataaatgtaaattttgctcattaaaaccataattaatttattgaaagtgaattgttattatttcagggatgaatgcatattggaatatgctgattattttaatgaaccaagagcctcttctgggatacttcccttgtattatttgcaagcaggtcaccgtaaattttctaagagagagaatgaatagattgctgctcattttcaagttttgccttatgaaaaatgcaaaagaggctgggtgctgtggctcacgctgtaatcccatcactttgagaggcccaggcgggcagatcataaggtcaagagatcaagaccatcctgaccaacatggtgaaaccccatctctactaaaaatacaaaaattagctggatgtggtggggcgtgcccatagtcccagctactcggggggccaaggcaggagaatcacttgaacccggagggagtgagccaaggtcatgccactacactccagcctggtaacagagcaagactccatctcaaaaaacaaaaaaaacaaaacaaaaaaaacggaaaagaaaatatgtgctgtatattgggagatgataagacgatatctttgtttaggaaagaaaggcctaacatcatctgttttagactcactattctcctctaggtggccatttcttgcactacagatgtcagctgccgggaccagtttgtgtggtgctgtgcctacacaatgcaggcacattgcaatgtctccaatataattgttatgtttaacatttagagccatttatgtgggtttcctctcctgtgttccactgtattccatttttaatctcctcaagacacacagtagaaaagctgccagaatttgttttttctcttcatatgttatagggtctgaggtttcatctttcatatttccacattgcaggaaagatgagcaatgacatattgaccaaggctgtgaatgaaaatagtgcatacctaaatacttctctttaggtctcatcatcagttccattcattcataatcagcattagtcttctattgctgctgtaacaaattaccacatacttggtatcataaaacaacataaatttattctcttaacgttttggaggccataattctgaagttagtttcactgagctagagtcaagatgtcaactgagctgattccttttgcagactcattgtcattggcttttacttggctgcctatgttcctggctcatggctccttctgccatttttaaagtgcatctctccaatctctgcttccgttgtcacttggccttctctctcagaccttgctttgtctgtttccatcatcacattattgagtgcctactgtctgccaggcactgtgctagatattggagttctatcaatagacaagtcaaacaaggacgctgcttccatgaagattccattcttgtaaacagataaataaaaaagataaaatcaagtaatgataggagtatgaagaaaataaactagagcaatgtgatagaaagatggggctgggaagaatgcctaagatgccaagattcaatctcagcgatgagccagtcacaagaagtcgatttcagacagaaagaactgcaagagctaatcaggcctgaggcaaataaagctttgtaattggagttgaataactaagggagagcgtggcataagccagagtcacagaggaggcggtgaccgagtggatagcgtcacagatcatcgtagggagcttagattttatctaagtgttaaaggaagacatgaaagtgttataagcagagaaacagttaaatatttactgtttaagagattgtctgggctgctgtttaatgactagattctccatgaagggagctatctggccacaccttgcctccctcttaaaaagtatgtttccttactgtggttacatagagcctgaataaaatctaaatcttagtcatgcaggtaattgaaggatgtttccccacatctaaaacttagacctctgcagtaccctgctaaccacaataaaaaaaatgccaattcttcccttttttccaacattttatggatccattagcaatttgcagttcccataggagataaaacaagtctcttttcaaacatgaagagatttcctatggtaattataggcaaaacctggagcaaagggccactaggtaggccaaggaatagggagccagctgagtgatggaatgccatggtcaggactgagaataggccctgaaaagaatagcttggtgaagggacagtgagggtagatcagacagtaggctcccatggacaaacagtcattgcctatcctaacaaatgaaacatcctcattgtagttctcaaaactatgtgcaagtagcatatggtcgtctataaaagcctccttcatactccttgacacccaggtttgaactgatggccatggtagaacctttctcctcgacatccagtggagtaggaatgaggtcattcctggtagtcatcttgtgccctaactgcacaacagtctgacagaatcaccatagacacagcagacatcatctggattagcttgttggaccttctctgatggttgctgagcggcgattgcctaaggcaaatgttggcccagccagtgctgtgtcctcagtgtgcatgcggtagagggaggaagaccagatgatgaggatgctcacctcaggcttggacccctgttaaggaagaccctatcactatccttttggaggtaggaggggaccttagtttgcagacctgacggacaagcctgtggttctttcacctgatactcatgtgtccctggtccttttcatctagcctagtgcagttctaagtacttagtaaatactcaataaatgttggaatcaaaccaaattggctgacatgccccatttcttggcatatgcctggacatgtgagaatattctatatggtttctccagaacaaagtcccatcttaagaagccaaaaatggcaagcctaataagcaccatagaaaatactgtggtttacatatgttcattgcaaccctattcacaatagggttcacgacatggaataatattcacaacatggaatcaacataaatgcccatcagtggtagactggataaagaaaatgtgatacctatacaccgtggaatactctgcagccataaaaaagaacaggatcgtgtcctttgcaaggacatggatggaaatggaggccattatccttagcaaactaacaccagaacagaaaaccaaataccacatattctcacttataagtgggaactaaatgatgagaacacatagaggggaacaacacacactggggccttttggaagatggaggataggaggagggaggggatcaggaaaaatagcttatgggtactaggcttcatacctggatgatggaataatctgtactacaaaggcccataacacagatttatctatttaacaaacctgcacttgtacccctgaacttaaaagtttttaaaaaagaaaatactgtagttgaatacaatatttttgctgacctgtttaaagccttctgcgtgagttggataggagggaaaagactgtaccctctgtgtctttttaaactctctatgatgcagagaacgtgacttttcagaatatgagtgccctatacctttgaactagatggaaacctcaggtatgaagggtctgtgtttatccctgtcctaggtatagtcatggttctatacttaaggtggtttttccgggctctgtggaagtcggtggtacttctagagcttttcatgatcccagagttcatttaatgaagactctatgtaacctggggatgagtgtccagggccttgggaagtgtggcatttagggccaagaaaacaaaggaaatagagcagcacatgctgtgtggacagccgtgatccccatgcttcagcacatttttatgtgagtcggctttgagagataaagatcaaagacttgtccaggagtgcaccagccaggtgtgaaattccaggtgacagaatggaaagaaaagaaaggtttaaagggaaaggaaaggaaatgtagttagtttccttttattctctttatttttcctgtttcctcttcaggaagtttatgtagcttacaataccccagacattcaacagaaggggttgatcctcattcttttccagataatgataagcaccgagggcctgtcgtttagttttcaggtataacccttggcagtccctagggttaaacaatgctgtgctccagaaaattttaatacagaaaacttagtttgctttctgctttggtctgtgctacaaaaagtgggcaaatataaactgggagaatataaataaaataaaggctacttcttgccacttacaaatgtcattagcaataagaataaagcacatcaacaagttacaaattttatccaaccggcagggctcccccaggggcagattcttacagctctttcttcagtgttagtttggccagcagcctagggaacatcatttaatgtcttcaacactaatgacaccttttgtagggggactgtctaggattgttataaaggaattagttgttatcagagaatatcataagcactctgtaggttgttccccgtcacatccccacctctctttggggctaattttctaaggaaagctaaaaatgtttactaagcatttctgagaaacttgtctacattatgagaatagaaattacaggaactcagtgcattagcaatgggaaaggcttaatgggtctgggaaaggtataaatttagggaaaatgtaaattgcaatagttggagagccttcaagggcagttttcttgaaatggcagtgtttagtagcaatggaaagatactcaaggatcttgccatttggcattgtaaaaaatgcaactcgtaggtaggaattgcaaatcccattagtttagaatatgaaatagactcggtgtaaaaaaaaaaaaaaaaaacaacaacatttgatttggggaatgtgcttggttccaggccatgtaggatatggaagtcttttctgtggtcatcccacctagacaaagaaccagttaacttttcaggattctctagaattaggatgttctgagtccacgcctgactctcagaagcttcccaaactctactgccttgacttactttaatgagcatttaggatttagagaaaaagaacatcaacatgccctttgctccatgatctttggcaaaccatggactgtataagcacaatatccacatattggattctgcaaaccatgaagaattcaccgtgttatttgtgtgtgcacagaggaaaacataaacaaagagtcaattaatgacattaaaaaatttgcatgtcagtattatagaatgtcaaatttactgtacagaaatatatgtattatttttttatttatatcaagaaaagtgataaattatcccatcaatctagttcccttacaatgtcagatctggtttaggctgacaagaaaaatgggcggtactgaaggagatcgtttagaaaatattatagacacccagagaggaatgaggcaatggtgaaaaatattaatgcagttaaaatagttttgttgaaaaaatgaaacattgatcacaaagattgcatgtaacattgtattggctgttcagtataataattttaatactactactactaataataataataatagtaaactcacattgttcctgaccaggtacagcttgtagctttaaaactgcattgatagggaaaagctgaagaaactgagcctgttctctggaacaaaggataattatagtgacctaattgtagcttctattacaaaagcagaaatgatagccagacaaattatctctgctgtcaataaagaaagctgtacagcaggtagtttataatctcttttaatgatactacttcttttaccccagagctctccatgaaaaaccttttctgacctcgactaccattaccactatagggagcaaacctcctctttactctctgttcatctctgactctgttgtttgggttcatacagtagcaacaaagagaatttcactgcctacaacttcctagcactggccaagtcagtcagagctatgctattgtggacacattctgcatgagacaaaataaatcaagaaatagtatggaaaagtagcaaaatgttctaaggcttttgaggagtagaaaatatgaaacactaatcaataatcatttaatgaatcataaaatgcaaatgagaaaatcagaaaatatagatgcaatttataccacagataaagtgctaatattgctcctattcaaaggcctttgaaaaatcaagggggaaaatggctagcaatctgatagtaaaatcagcaaaagatatggacagctcacagaagaggaaatgaaaatggcccttaagcatatgaaaagatactcagcatcatataagaagagataggctaattaaaacttcaccgaaatatgacttctcacctatggttatcaaatttcccaaagttcgacaatgcactctgttgatgagactgtagagaaacaggcatcctcttacagtgtaggtggcaatgcaaaataaaagaaatgtggaaggaattttgtcataatctagaaaaaagtatatgtgtgtttctctttgacccagcaatcctgcttctgtgaattcctcccaaagccacagtggtaacaatatggactgacgtttgcacaagatttttcattatgacattatttgcaatagcaaaaaatcagaaatacccaaatgttcgcaaatgcatgactcgttaaataaacaaaagcatgtccacacagtagaatactatgaagcattttaaaaatgagaaagatatctaaagaaattgtagtgtctatgatttctttgctaatatggaatgttcttctgtctattactatgtaaaaaagcaaagtatagaaaaatatggacagtatgctaccttttgtgtaacaaagaaggcatctaaatatataaacatgcttgctttttttaaagaaacaaatatagttatattgcatgggatggagaagacagaaatgaaagctatatattatattttgctatatttaaattttgaaaaatatgccttacatatagcaaattaaataaaaaggaaaaaacaatccctaaaaactgaaaacaaacgaaaataaataacctaactgtgaaacaaattggttgcatagccattcaggaaaaagaattacttcaagtgacattagaatacacgttttgattatacatatttagtgtaatatattctagcaaaaaaatagagcaatgaagacatcttaaactttagtagtcaaactgttagtaattgctgtgatctgaatgtttttttcgccatccccccaactctgttccccacagcaaattcatatgttgaaacctaatcatcagcgtgatagtattaggaggtggggcctttgagaagtgaagtgctcatgaatgggattagcgtccatataaaagtggccccagaggctgggagtgtggctcacacctgtaatcccagcactttgggaggccaaggcaggttgatcgcttgacctcgggagtttgagaccatcctggccaacatggaaaaaaccccatctctacaaaaaattacgaaaattagccagatggtgtgcacctgtagtcccagctactcaggaggctgagatgggaggattgcttgagcccaggaggcagaggttgcagtgagcagagattatgcagtagcattcctgcctgggcaacagaaccagactctgtcacaaaaaataaaataaaataaaaagaggccccagagagctgcctcacctcttctgccatgtgagagatccagcaagaagtcagcaatccatcctggaagaaggccctcaccagaacccaaccatgctggcatcctgttatcagacttcccagcctccagaactttgagaaatccatttctattatttatttataaggcttccagtctattttattatagcagcttgatgggactaagacaataatattgatattatcattttaaaactatatgataaaaataattatatcagtgttaagaatcaagattttgcatttaaaggagggaggaataaatatacaatattaaaattttaaaagtaaaaattctgtaatgttaaatttgaatcagaaatattagtataaacatatgggctttttttcccccagaaatatgtatttcctaactctattcagagaaaaggctgagaaataataataacccagtggcagtgagcacgcctagggcccagattgtggtctctagatatcattccccactaaaaacaaaggggtccttggaggaatgactgcttccaaattaggaatacaagatactcaacataaacctggaactacttatttgtggtaaagcaaggaagcaatcaaaggctaaaggttaagccagaagaacgaaagagctcatacaatgcagtctcttgactaaatatggacaatatgtgcaagaaaaagtataaggaatgcaattgaataaaaatcctaaatatgttattacaaatgtgtattatatattatggacttacataaaaaaccataagtttataattatgttcacaatcccgtattcccccaaaaatgttcctaactactcgtttgtcaccattggaactatctaggacactaactcctgactctgaaaattagcagtgaaaaagaaatatttaagcatttattcagatttcccaatactaagtacatctcaccataatcaaaatgccaaaattgttgaaagattttctttgcagaagaatcccagctaatacatttttaaaatggccttcaaaaatgaccattgtgcaacccctaatgaaataattaattcagtcaaacatcatcagtgaaagaaatgattaaatgaaacattgataggggaactttacaatggagacatcagtttgtctccttagcattactaaagacaatcagatatttaggatggagaagacagagatgaaagctatataactgtactttgttatgttaaatttagaaaaatacacatttttccaaatttttgtgtatgacacaatttgaagcatatgtgcttcctttaaggtatttatattggtttcatagggccgccatttaacagattaccatcaacttggtgcctttactacaaatttgttctcttactgttctggagaccagaagtctgaaatcaaggtgtcagcagagttgcttctttccagaggctttgagagagaatctgttccatcttcttctgtgcttttcttggctgccagcaatcctgggtgtttcttagcttatagacacatggctccaatttctgcctctgccttcacattgccttctctggctcttctcttccgtttatgtcttctcctttataagaacatttgtcatcagatgtagagcctatatggataatccaagataatctcacaacaacatcttaaacttaattacatgtacagagacctgtatccaaataggattgcatcaacagattccagatggatatacaatttccctcgatatataagtgaggggcctgcagaactcacttatatgaaaggtctgccctccatatatgcaggttccttatcccacaagtaccatatttatccgggtttagttgaaagaaagctgtgtataagtgaacccgtgtagttcaaaccctgttgtttaacggtcaactgtctgttttagggagccaccattcaacctaccagagtactcctcctcaaaaatgttgaatctaactaagcctccagatgcactgtccaatatgataaacgttagtcacgttgaaatttaattcatttaaattttaattaaaattttgtaccttagtcatactagccacatttcaagagttcagtatccatgtgtagctagcggctgctgtagtagatagctcggatatggaagatttccatttccatcatcacggaaaatcctattggaaagcactgctctagaagttactcttcataaacaagatatttggggggatggaggaataagttaaatcatttcacaagaaagtaaacagagaaatccagcacatgggaccaactacaggaagatcaacttggtttccgcaataacccaaaggcatggaaaaaataaaaagcaaaaaggaaaaagagtacagttcagtacatttaatgagacttaagagaacaccaaatgtaacgtacaagcatttttacaacctgattcaaataaatcatctggggaagacagacatttttaaggcatttgggaaaatttgtttatggagtattagatgataccaaggaataattgttaatttttaggtgaaataatggcataataaaacattcatgatattttgatatgcctttggaagtatgtagggggatttactttcaaaatgcttggtaaaaaattaatagaaaaatatatttaaaatatgacagaatcttgattttatttatttattcatttagagacagagccttgctctgttgcccaggctgggtgcaatggcacgatcttggctcactgcaacctccaccttccaggttcaagcaattctcgtgcctcagcctcccaagtagctgggattataggcatgtgccaccacaccctgctaattgttgtgtttttagtagagatggggtttcaccatgttggccaggctggtcttgaactcctgacctcaagtgatctgcccatctttgcctcccaaagtgctgggattacaggcatgagccaccatgcccagcccgaaacttgataattattgaatacagaaatgaaacgtatatgggagctcattgtgctattatcctacttttggatatctgaaagttttcattatatcaattttttttttttgagacagagtcttgcactgttgtccaggcttgagtgcagtggcgctatctctgctcaccgcaagctctgcctccccggttcttgccattctcctgcctcagcctcccgagtagctgggactataggcgtctaccaccacgctcagctaattttttgtatttttagtagagacggggtttcactatgttggccaggatggtctcgatctcctgacctcgtgatctgcccacctcggcctcccaaagtcctgggattacagacgtgagccaccgcgactggccacatcaatttttaaaatgtgatcatgtttagattatttataatctaacataaatgaaagaaacattaatgttgaagacaaacacctcaacagaattcaataattcaattcctaccatttagtaaatgttagctgtcaggcaaagtgtgtagcctctctaatctcagctgcttcttctctaaagttaagacttctgtacattatgagaactgttatataatcatgagaaaatatatcactaatattattattgatgtcagttcatctttttaggtagatgaaatactggacaggatgggctcttgtgtgttgcaaacttttctattttgaggcatttgaagggcagtcttaattacagaattttgtttttaaaccagttttatttttagctcatggatccaattgcttcttaccatctccagtgatacacctgtatggacaaccaccaccttccctcacctggcttattgtaataaccccctaactgttctccacagtttttctctcacccagaaatgcccacttcactctgttctcaacaaagcagtcagagagccctttaccatgtaagtcagagcctattacttcactgctcgcaacctctagtttgcttcccacctcactgagagtaaaaaccgaactctaccatggacctccaggccctgtttgccctaagtccctgcttcctctctggcctcctccaaattctcactccctcacactggccttgctgtttttagcacatgcctgcctcaggggctttatatctgctgtctctctacctggaacactcttctcctgttatctgtatagtttaattattttcttcttcttcaagccttttattttatattttcagtagtgcctttcctttaagtaaatttagtgcctttaaataaaattaatttatttaaactttaattaattaaaattttgtaccttggtcatactactcacacttcaagagttcagtatccatgtgtagctagtagctgctgtatttaataatatatatttaataatgtaaactcccttcaaaaactcctactacctcttcctgtttcactttcccctatactacttactaaaaacatattttttcataaagtaccaatttgtaggccagcctttgatgttgacaatacaaatcattcttattgattcataaatacctcctctaaagactagacagcttgttttacatctattacaagtttctgcattcatcattcaaaaaattttggaagtgttttggttgcttgagaaggggtgtgtttgcttaaggaatttaaatattttcccagcaattgtattctgttaatttgttataataactgcttttagataatgcatttaaaagagaattatatataactcaatttataaataatgaatctaaatttgttagtttataaaaggtataagtagtataatcagcatttttgccttttctttttgtgttttctttttaaattgagatataggctgggcacggtggctcatgcctataatcccagcactttgggaggccaaggcaggtggatcacctgaggtcaggagttcgagaccagcctggccaatatggcaaaaccccttctctactaaaagtacaaaattagccaggcatggtgacaggcacctgtaatcccagctacacaggaggctgaggcaggagaatcacctgaacccgggcagtggaggttgcagtgagctgagatcacgccactgcactccagcctgggcaacaagagcaagactctgtgtcaaaaaaaaaaaaaaaaaaaaaggtaaattgaggtataatttacataaagtgaaatgcttagctctttgaaaacagagtaatattctcttttctcttttaatgaatgtatgtcaaattacagaacatttctagcacccatggatgttccctcatactttttcccattcataggtaaaagcctgatctagaattgcttacaaatggaattatatagtatatagtaaatccttttttctgtccaacttctttcactaaggatgataattttaagattcatccctgctgttggctatttttgtagtttatttcttgttattgctgatttatcttctgttgtgtgcataaaccatagtttgattatccattctcctggtgataaacagctgaattttatgtctaatttttgctatgatgaataaagctgctactgaacactcttcgtggatttttggtaaacatatgtcgtcatttcttttttcaattcacctgaggtgaatcactgggtcctaacatcagtgaaagtctagttttgaaagaactcctagaccttttccaaaagggattatgccattttatacttccaccagcagtgtgtgaatgttctggatgctccatatcctttccaacatttgtttttgtcattcttttacactttagtaaggacatctcattgtagttttaatttgcatttccctgatgatgtatgatacatttttcatttgcctattaggcatttctagttattatttattttttcattgaatgataattacttgtttatgtctcccttgatagtaagtcagagactattttttgctagtatatagtataatgtcagtaaaatattgaataaattaatctgtcaaccaaatattagcaggaagaacactcgtgacgcattcaaggagcccgtaatctagttatggaagcagaaggtctagaaaaaatcataaaagttttttaattggttttgttttctacaaagtgacatataacagtttcatattaatagagaatttactggatgtatgagttgaagaggagacaaagaattgttaaggtcattgtggagctgtttatgaataagttaagtccttatgccagagaaaactagagttaaatatttgattaatgggacatgagtaatattaggaaaagcagttgatttaaagagaccaaataaaagttcagtgaacaataatttgaagaaaattgtcataactgagttgacaaagggatcatgagaaatcaagtttacaagaaataaagatgccttttggtacagggtatttaatgttttcaaaaacatttttattcactacaacttgtagttgttaggaaattttttatattttttaagtttttaaaattttcttggggagggtgggatgggggtgagagttgagaaactacctgttgagtattatgttcactatttgcatgatgcgttcactaaaagctcaaactttagcattatgcagtataaccatgtatacccatacctgcacatgtaccccctgtactgaaaattaagttaaatttatttttttaattatcttaaaaatatagaaaatgcaaatagcacataaggtataaaggctacctctaattccactctctagatgcaaccacttaggaattttttgtgtattcttccagacattttctatgtatatgtgaggatatatatcatataaatatttatatgtgtagtaccctcacccttacatacatcatcttctttttagtataggaatagtatgaccctatgttctacagctgcataatacttttctatattcccctgttaatgcatatttagactgtttcccatcttttactattataatagcactttgtgtgtttttctttttgatacctgggatcctttaattataataaagaaatttattccatttacatttattttcataacataaatttggtcaacttatttttttgttactttcttttttactgctatctcttttttattttctgctatatggtaaagagtttattttgtgtatttctctcctgctgaaaatttgggttttagtggtttctttgtaattatatttaatatattcaaacctctgtttcttgatgtatcaattttagacagtaactactgatgcctgctttataaagtgagaaaatgaagaagggtgaaaataaagatagggtactctctcccaaattacttccttattaacttgtgattttcattagttttttctatattttatattatcagagtttataatatttacattttttctgtaattattgttcccacagatatttagtcttagttttatatttaaatgaatgtattgcttacctccagacctgctattccacagcttcaccattatcttagtccatttttgctgctataacaaaaccctgagacagggtaatttataaagacagaaatttattttctcatagttcaagagaccgagaagtctaagatcaaggtgccatcaggttcagtgtctggtgaggccctgttgcccatagatggtgctgcctaggtttcctcatttggcagaagaacagaacaatggaatagcaaagagggaccttagctagtgctctgtagcccatttataagatgttaatcttttcacgatggcttagtcacttcccaaaaggcttagtcacttcccaaaacctcctcttaatactaccacaatggagactgtatatcaacacatgaattttgggagacattaccgccgtagcaaccatgttgaattcttcattttgatgcagttcttagtttgctgttttccattattaataagtttttcaagatgggtcaataagtaccatattccctctatgttttcaaatgtttgagagtgtttttcttttatttgtgttagaggccagcatgagtttgcctgcatttgtcgattacttgattttcctccttgagacagcacttatgcttactatatgcaataagctctaacattttcttttactgtatttaagtatgaccattaaatttatattatcttctacggaagttttttttaattttctttaaaaaaaaatctgtgctaaaatatagtattaaataacatgggcatagtggtctaaggttaccagcagcttcaattctacatgatctctcaaaatacccttttgccagatttgctgggtactctgccctggtggcttcttttctacggttttctgttttgggagagctagtctgagatcagcctacttcttagtgaagtcacctagattactggtcctattttgatgagtctgggttatataactctgctaattctgcctatcagatacaaagcaggttcatacttctcttttctcactacttcacctccatgaagttttttttttttaaggtgggagacctgctcaggggaaatatctctcttctgtctctgcctctcctccattctgaagctggatccccacaaagaattaccgtacaattccagggtcctattcctatccttagactatattaaagtttattgactgtacccctctagactccctccttattttcagtgaaatgtatacatggctggagatgcagccatatatcgactggtggtgcactccgcctttagggctgagtccaagtttcatagcaaggcatgagattatggtcgttttctaattccactgtagatagaattttcttcccaatttctcaagtgtttgttcacatagagtttcagggagggaagtagagtcacttacttgacttcatcatttattatcatctcttattagagatcctcaatctgacagatatgacagaaatactctttaaggaagattattccagagccttttaaggtatatattaaagtgggatgaggtgacataccaaaaactctcagaataatctaggccagtacagtccaatagaacgctctgcaatgatggaattagtctctatttgtgttgtccaatatagtagttactagccacatgtagttactgagcacttgaaatgtggtttgtgaaactgagaaattgatttgatatgaattatttcaaatttaattttatagggccacactcagctaatggccattatattggacggtgcagatctgggcaacataaaagtctgaacattagactgtgatgaaagaaatggaaataaaagaggatacccaagaggtgttatggagaaaagaagcagcaatgttcccatagaggaaaagagaaagaggagatttaaacaattcaaacgcagtttgctcagaagaatggggaaactggtagtaccgtcaaataaaaaagggtatcttttgaaaaataaatattttaacaggttgagttcccagtggtaaggaaacctctaagtggaaatgactataaacaagtaaaattctcaatgaattgggggtgggggtgagggtcaaagctaccaaaaaaaaaatttccttgacacttccgtcttggtctcttctgccaccatacactccttttcagagattaccttgtcctcctcaacatggagggaccctgatatatgacataataatgattgttcagagaaattactattttacctgttgaatgattaatatgaaattagttactgaaacactcactggtgcagagtatcaaagaaacggttttgtttcagaaaggaaaaatataagataaaatattgcttggcacagacgtagtacttttcatctgagattctccacgtactcagcaagtttaattaatgagaaaacctctaagaaggaagtgatgaaataaggaacacagataccagtgttctatttctgtgatttttaaaaatcaagcttagtattttcctcttccattaatgcacacaagtattgccccatgaggcagccatgagatattcatctttctgctgaatgatttctcttgaaggcatctcacttatgagggatagcaaccacacagaatcctaccccctaactttattgatgtcctttgctctatttgcaatggaaatccatccctatcatcagggtgcagcaagcattctctgataatcgagtctgcactgtctctggaaagattgttttgttgcagaatggagcaggttatcttctttatcaaaaattacttaaaacaagcatccatgaatctaggactaacaggcattgaaagggaataggcaaggcccttaacgggtaccctactgtgtaatcttcctttcatcttaattcagaatcccttggaaattcaagttgccgtatgcaaaaatataaattcttctaattacttctgtgtagggcacaggtttggcctaatcaaaagagatatgcaataatatatcctggcatttgttttcatctgttgtaacttgaggataggtgctggggttttgttttggttttggttttggtctcatgccttcttattctttttgttttgttttttgctttttgcttcccaattgaaattgcccaatttcttttctgctccttactcagaaaaataaaaaacaaaaatgttgttctgccaaaagagaaaaatacctcagaaaatcctgcgttctaaagatttttacaaatgatttgatgttttgcaaaataaaactagcttccatgtgcaaaacagctgtttttgttcgaataggggaagatactgatgggtttcagttgtttttttaactcgtcctggcctcccgtatgtctccagtcatatacagatcattcacttctagcccacagccctcttatattctctgggcccaggacatcaagtttgtcccatctattcttgactttctttagccgcctgagccagcatcgtcttatctctcctcttgtacacagtgccccttctttgtccagtgacaaggtttacactcttttctcattagtgctgaagacctcctcacaccatcaagatcaccattgtccagtaagaggctatagtgacctttccattttaatacattactgagaatttagtagagctgatttaacactttccagattaaatgtcaaattctcaaaattcagatggatttggaatccacctaagtatatttttctgcttccattcccagtagactgcacagtggcactgattagcactagcattttgtaatatcacttaaggctttagcactgtggagttctgccagtaatggtgtttaattcacttatatgtgccaattcatctctgtcaggaacctattaatttcttcactattttactctgtccctagcgcctatataatgagacacaataatccccatttgtataaccaaaaaacttagagtctcttgtaaattatccctgatcccactgcttttagtgaccagaaagcctctgtatttctttttcatatttaaatcaattttcacaagttcctttctttagaagaatacacaggaactctagggcactaaattactgaagtcgtagaaaaactagaggattttgatgagtttgttaacatgcatccctgtcccaagaaaggcttctataatatcgaaccaaagatgcactgttcccacaagcacatgccatctgtggggagggaatgtgaatgaaaacagcctctgaagctactatcagcctagtcatcagtgggcaagatatcaaaatacccatagcattgctatcaaagtaaagaccctgtaacaaataaagatcagatatataaaattaatcttcttatgctgttggcatttctgcatgctgtgatcttgagtaaacaggagaatgacagctaagagacgaggaagagttaacataaattcaagagagtatttcattgtattattatatgaaactcacatacatctttgctacctgtactgtatttttcaggattggagcaaaacatcaggagctaagggaaaagcaggcaagaggtcttcttgattatgctactggtgcaattggatcagtgtatgatatggatgatgatgaaatggaccccaattatgccagagtgaaccactttcgggaaccatgcacatcagcaaatgtctttagatctccatctccccctcgagctggaccatttggttaccctcgggatggccatccactgtctccagaaagagaccacttagagggtctctatgccaaggtcaacaagccataccatccactggttccagctgacaggtaataaacttagtgaaagataaatgtagctttaattcagtatgtttcaaatcatctctactgctgaaaccgataaaaaatgtctccttcaatcaattaaaactgaaacgagtcagtaccctagacaagtgccatcctttgaccgacctgtaagatatccaccatcaaaaataaaacaatagccaattgtaaggtggcatgaatgaatagtagtagcagagttcatgatgcaatagggagccatttttgaaggagtattgtgacagacatctcatgaagaaaactttgaacgaatattgtcctttctcctaagagaccaattgtaaaagatttattcaggaagatggcatggcacatggaggtggagagtcagaaaagagaagatgatagcttccaagtaggtgtaattgaagtgggaattacagaaagctgcagaggagcaggggcctttgaaaagtaagatgggggttttgtactcaagggaaaggtgaccctgtatagatattcatggatgatcagaggtagaaaaagaaataatcttggcaataggagtttgatgaagtagagaaagataagaggtgacaagtccacagatctttaggtttagcagctaaggagagagataataggactatctgtcagtacaattgaagtaggtagaaaacaagatgattccaaccccacctcctgccaaaagtaaaatgcttcatgtcttgaaagactgatgtaagagagttttagtcgatatacattgttaggtgacccttggaattacacatgcaaggaatgagttgactgatcttggactaatctgactagcttgacgtctggagggaggtggtggggaagaagggtagcaggcacagagggctctcattctggatgaagaaaagacttgttttccagacttcttagggtcctgacaaccacccagtccctattagtaaccagcctttgtgtgatggcatgatatattgcatatgtttaccatttacatttccccagctgggtgatattatgcactttcaattaggttggggagaggaagggaaatcatggcatttttatgcagactgtaaagtgtagcttcaaaagactgattacctttcagagcctttccaataaccaagtgggaaggaaggagcaatttttaatccttactgtcaggcatccaggttgataatattaaagaaagatggtgaagtttttctttgggacaaaatgaaaatataaatttttatgactgtgatatagccataataactaaactgctaattcaaagaattgattaagagttggatttttctccccagccttcatagaggattgaattttattgtataaataataacaccaggcatgagtctcttctcacccaaaccatagtcaatcttaccttccctaaattagataggtcttcataacaatcctctctgcgtattccacagctagaatcccaacacagagggactgtttataggaacctcttaagccagtattttccaatactaattccatggaaataaatgtgaggcattttataaaaaaggattcacaagtccaatacatatggggaattctaggaattctagggtaagccacaaggaacaggttttccttttttttttttttttttttttttttgagacggagtctcactctgtcgaccaggctggagtgcagtggtacgatcgcggctaaccgcaacctctgcctcctagttttgagcgtttctcctgcctcagcctcccgagtgagtagctgggattacagatgcctgcaaccacggctggctaatttttgaatttttagtagagacagggtttcactgtcttaaccaggctggtcttgaactcctgacctcatgatccacccacctcggcatcccaaagtgctgggatttgaggcataagccgccgggcctgggaagaacgggttttcttattgcagtctttttatgcctaatatgctgacatgcattctgagtttctaagaggaccatccaacaaccagcatgcatcatcccccaaatttttgtcacctaaagcatatgtttcccccagatctttggaacactatttaggaaactctactaactaatctatgtcgacgtgaccagaaaataagtttcttatgataatcttaactgcagccactataaaatgatatttaaaaaattattgactgcccagtccagacatatgtgtaaaagagtgttacttttggctctgacccctttatattaaaagtgatctaaagctgctttcaatagagttttcaccgctgtcctatttttggatagcagatcaaaatgtgactctttatactcagaattatctttatcctgctcttatctttaattatgcttaaagactgccctgctccttgttcttcaagtcttcaagcaagccgattttgtcctggcacatagtaagcattcactaatgttaggtattatcatcatcattgttactattattattactctcctttttcaatgaaaatctgaacttccctgatatgcctgtgcccagataagtctaagaagagttgctatggcagtttccctaatagtatccgtaagcaggaacctacaaattctaaacataccatacgtactgttagagggcaatgccattcatccattcatcttttcattccttcactcatttagtaagtatgtatttgacacctaatgtgttccaactactatagaaagctttagggaagatagagagatgattaagaaacagtcccaggccagaagaggtcataatctagtgaatagaggaccaacacatgtagaaatggatcattgcattgtcttgtaaatagaaggaaaagaagtttttcctttctaactctgcctaagctagtcaggaaagtcctccaaacagaggtgatatttgaactggctctagaaggcttagtaagacaggagcaattgcagtggaagaattgttttctttgcagaataattaagcatgcacaagagcaaagtggcctgaaagagcaggcctgttaggggagctcagaagcacccagacacggagcatgggtgggaaggaaagtgataggaaaagtggctgcaaagcaggctggggtcagtttgtgatttaatgggttgtatcttaggctgctacttattgattggtagtggctgtccagaaatctgtgttaatgaaggtcctgaggcaaggcacagtataatcccagcactttgggagtccggggtaagggggaatcacttgaggccaggagttggagaccagcctgagcaatatagcaagaccccatctctataaaatattgttctttctttttttgtgtgtttgagtctcactctgtcacccaggctggagtgcagtggcatgatgtcagctcactgcaacctctgccttctgggttcaagtgattctcatgtctccacttcccaagtagctgggactaccggcacaagccaccaacccgactaattttttgtatttttagtagagacggggttttgccacgttgaccaggctggtctcaaactcctgacttcaggtgatctgccccccttggcctcccaaaatgctgggattacaggcatgagccaccatacccggcctctacaaaagttttttttttaactatccaggtgtggtggtatgcacctgtagtccaacctactcaggaggctgaggtgggaggatggcttgagcccaggagtccaaggctgtagtgacctgttgattgtaccactgtactccaccctgggtgacagagaaagatcctgtctcaaaacaaaaaagaaaggttctgaagttatgcctgaataagggtatttttcctggactccagaatgatgcgtggtagcaagtgtgtagtgggttttgatgtatttgccaatcccgtagacaatgggagccactgaagcgtcataattggggaatgagctgatggatttgtgttttgggaaaatagctcttccaacttgatggcagacaaagaagaagatggttagactaagagacagagtaagagatgattacagtagtaaatgaggacaggagcttgaaataagagagtggcattggagacaggagagtataagaagcagcccaaaactttaacttaaaacaaagacaaagatgtttagcagatatcacagacatgaggctttcaaatgcttcagagagctcagtggaataaggactaaaaagagggctttagatttggccactaaaaggtcatcagttaatttagagagaacagttttagtagctaagtaggaccagagggagaattataatgagaagagaattgattaagaggtgagaacttaaggagtgagctcttggtgacaaagagagagcagagttatagaatggaaaagttgcagctttgaagttccttctgtgacagtatttcagagctaacaagagaattcagagactgtctagagtgaccttctcatatgattactgcagaaactggggcccagagaagatgagtgacttgcccaaggtcacacagcatggaatcaggactttatcctagatctctgtgttctacagtcttcttttccctaccccacactatgatatagacccacactctcatttcctgcttgacgaatgtattagtccattctcgcactgctataatgagatacctgtgactgggtaatttacaaagaaaagaggtttaattggctcacagttctgcaggctgtccaggaagcatgatgctggcatcagctcagcttctcaggaggcatccacaaactttcaatcgtggcagaaggcaaaggggaagcaggcaggtcttacatggcaggggcaggagcaagacagagaggagggaggtgctacacacttctaaacggccggatctcacgagaactcactcaccattacaaaaacagtaccagtggggaaatccacccccatgatccaatcatctcccaccaggccccacttccaacactggggattacaatttgacatgaaatttaggcagggacacagatccaaaccatattaaggaaattagtacctggataagtaaagaagcatccatctgggctcccaacatataatggcagattaaatcatgggtatgggaatgaagctgatatgggtccagtccacttccaaatactgctgcatgagctgcatgacttatccaagatgccattttttattttcatgcatttaattcaacaaatacttattgagtatccactaagggtcagggcctgagttcagtactggactcaccagggaactgggaggaagatgactatgctgccttcattatggatattaggatccaatggcaatacaaagacctaaacatgcagtgagaacacagtgtggaaagtgcagccgaagagtaagtgcagggtactgtttggggccaggcagcaagggtgaaaacagaggggagaggaagcatgatgtgttagggggactgaaagactctcagtaaaatagaaacctggtgggaggggtaaatggaaagagagaacatgggatggcctcagagctgaccaaaggcagatgagagaggttggccggccttgacgaagagtttggactctatcctgagggaggtggggcagggtttgggttggagaagagctcgctgaggggaagaactcactgagggttttaacgtgagatataatcctggaattcaataggctgtttaatagcataggcggtttatcctcatctacttatttgtaaaagggaagattataatatagccttgcatcctgtgatggttaaatatgattttacattttgcatttttttctatctccatatgaaacataccctatttgtccatatatctctgtcacataggaacagatcgtgtgtatgtggtccatagtagctttctaatagaggcgacttcggtctcatacctacttgcttctcaaaggttggccctgaaccttcagtccatcttagaaaaaaaaaattgccttataaaagattcatctataaatgacagtggttaaaaaaaaatttctaccaccaggacagagacacgtgactggattttcacaatgctggttcttccaggatttgaacgtagcatgggttaaatcctgccctcaaagcctgacaattactcaggtttacaatgtgttagttttccaccgcaatgccagcattgaaagggctcccagagtgtatgaacatgaaaactttatgtctggatgaggacaaaacagttccaaatagggggctagaaggtatatgtggcacacagcacaaatgcagttttgcattagtttgtgtgacaatttgacattcatttctagaggttgccaaatgggtttgattgcacacagtatcagtaaaagaaaaaaattgctttcgggtgttaacctctaaaaatatgggcatttgtttctaactgatatatactaatttaccctactaatatattacatagaagacatataccaaatagagaaattaattttaaaatgagactttaacaaattgtaacatgagtagtggttctgatattttcttcctccctcaaatggggtttatacagcccattttggagaccactggtctcagcttcaggcttcagggtggtagggacctatcctgcttttgctcacctgtctcctcagttcctggggcagtctgtcctcaataaatatttttggaataatgaatgaatggtttaacaggatctttcttttttttcttgagatggagcttcactcttgttgcccaggctggagtgcaatggcacgatcttggctcactgcaacctccacctcctggattcaagcgattcccttgcctcagcctcccgagtagctgggattacccatgtgtaccaccaaacccagctaattttttgtatttttagtagagacggggtttcaccattttggccaggctggtcttgaactcctgacctcatgatctgcccacctgggcctcccaaagtgctaggattatgggcgtgagccaccgcacccggctgatttaacagtatcttaaagttggctagcaccttcagtggtcaagcctcacgtcccactcatcagaggcatcttctccatgaactgcctcatgaatgtcacctaactcacattggcatacttcagtgacaaaattcatgaggcatcctttttcttttagatcactctagttgatgtagaaatgcccactttttacccacccaaacactgtctccgtgtagcttttaccagggatcttgggttgagctacctggacacagcatctaagcctcattaacagccttttaggtatttaaagtgactgctatgaccaccttcactaacaaacatttatgaactctaaacatatggccaggctctgtgcttagcactggccttaagaaggatgtagaaaacacagcaaatgaccttgagaagtttcttgtataatcatttcttcggcataaactcccccagctgttttagccccttcttaaattataattcacaccttcagccctcttggcagccatttggggaatgtgtacactaaagtctattgagtttatgattgctttgttgggcatggcatgcagaactgggtaccatatttcagatatggtcagaaaatcacagaagtcagtgggactctgggtatcctttgattttaatcctttacacttattaatgtggcctaagcttttatgtccattgtcattattagcttatattgcactttttaactaaatgtttggtttttttcacttaagttgctatcaaacaagattccccaataaatttacaaaatcctttattggtacaataactttttaaaatgtgggatagtctctttatccaagttgaatatttacttgttagggttagcccattgttgtagccaataaagatattttaaagtatggatttttgtactccaatgtatttgttattccctagattttaccagcctcatatttaatcattgtgggctcctccatgtcattgataagatcgttgatcaatgtcaaatacaatcccagcactcatcactcgagacctccattaatcaacactctttgggatcttcagttagctattaatctagtctgctattatctagtctgcattttccagttcatctgaacttatcttagtgataacgaggtacaccatgtttgtgaaaatccattgatttaccactctggtaaccctaacaagaaaaggaattacggttgggtgccgtggctcaagcctgtaatcccagcactttgggaggccgaggcgggtagatcacctgaggtcaggagttcgagaccagcctgaccaacatggagaaaccccatctctactaaaaatacaaaattagctgggcgtggtggcccatgcctgtaatcccagctacttgggaggctgaggcaggagaatcacttgaacccgggaggcgcaggttgcagtcagccaagattgtgccattgcactccagcctgggcaacaagagcgaaactccatctcaaaaaaaaaaaaaaaaaaaaagtgtgggaaactatttgctcttgatgaatcttagagaccgcttttttttttgttgtttggagacagggtttccctcttgttgcccaggctagaatgcagtggcgcgatctcagctcactgctacctccacctcccaggttcaagtgattctcctgcctcagcctcccgagtagctgggattacaggtgcccgccaccacgcccagctaattttttgtatttttagtagaggcagggtttcatcgtgttggccaggctggtctcgaactcctgacctcaggtgatccacccgcctaggcctcccaaagcgctgggattacaggcataagccaccgcgcctggccccctttatttttcctctttctaattttcgtaaataatgtgtccatttagacttaattatgcaaaataacactttctgtgagctgatgtaataccaggcacttagaggcacttagtatttgcttactaaatacttacttagtaactgatatatggcagctgtaaaattgaagtggcagacagcgcacagctcctgaatgctccagttaagcagcttttgttttccagcatgtatccactaattttgcagaaaacttttattgagcatctgttgtgttccagaggtcacacaaagaagtttagaagcaatctgactctcaaggaactcagtctgatagccaaaactatctcataaacaaataattacaatataatatgttccattagaatagaggtgtatgtgggatatgttgtaaaaatcatgaaattgttaagtgcattcagtgtgagaaagacctgagactatagatttatctttccagggccttggttcaaatgtattaatttttcaaagcctgatttctcactgtaaaatgaagacatgagtatatctgctcttgtctggtttattcgtggattaaatgaaatcatttcagtgttaggctcaataaatgtcaactatatttaggaagattattggactatatattatcagactgtattacatattattggtatatatattgagaagattattgaactaaatataactattgaggaaggttattgattgtatctagctgttgaccatttaaaataataggtttgggaacctgttggagtccatctgttccagggtcccatatttagtggttaattcctagctccagcctcaactcctgccagtgtattgcaatcatcagaaagaaaaagtagaaacagaaaagcaagtgaggagatgaaaggcaagaaaacttaaaaaatttaagtgcagattctttttttttttttttttttttttttgaggtggagtctcgcactgttgcctgggctggagtgcaatggcatgatctcggctcactgcaacctccgcctcccaggttcaagtaattctcctgcctcagcctcctgagtagctgggattacaggcgcctgccaccacatccggctaatttttttgtatttttagcagagacagggtttcattatgttggccaggctggtctcgaactcctgacctcaggtgatccgcccgcctcggcctcccaaagtgctgggattacaggcatgagccactgcacccagcccaacaggcagattctgttagatcagtcatatcatctgcataagtgaagagagcattcattacacactgagctactttggcaattgtttgttacaaaccataactcattagatatccctaagctcatcatcggaactgaggcaatatcctaccatgtcacttgattgtccatttggttctgagtcaggcttaacaatcatccacagaacagactagtccaatttctatgggtcccagaagagctgtcaataacaacagtgtcaagtcagatcctgtttgactgtaaacaacagaaaactcagctgatacacatgtgtctcgcccattaaggaatttagatggccttttttcctcttcctctcttgcctttcccagtggcaaagcctcttcttcatgttgcatcatgattccaagatggccgtagccactctaagtttcatgtccaccttccagggagaaaggagaaaggggcaaatggccaatggaatgtgctagtcaagttcatccctttgaaaagattccccagtagactccaacaacttctcattggcaaaaaatgtattaaaagatttactctagtggcaaaaaggtgttgaaaatagaatttcaactttccagtaaacaaagtcaagagagaagtgagtagtgagtggcttttagggcgacactctatggaatccaccacaaatagattacctttagatgtcttttctcttttttttcagttccctttaataatgcaaaagttatagattcatagtatatagtactttcgtcaaatatattcttattaactccctgtgagaggctatccttattatgtagaccctcttttatagctaaggcagaaatatttcagcctgaacaacttgttttacattttttatttttaatttttgtgattatgtaataggtatatatatatatatatatatgtatttatgggatgcatgagatattttgatacaggcatacaatgcataataatcacatcatggaaaatgggatctccatcccttaagcatttaccctttgtgttgcaaacaatccaattatactcttttaggtatttttaaatgtacaattaaattaatattgactagagtcaccctgttgtgctatcaaatactaggtcttgcttattctttctaactatttctttgtacccattaaccatccccacctcccttccaccgctctgtctaaataactcctagaggcaactgggggacatacattcctaattttcatgaccactgaaaaagcatgtgctttgggaatgctaaaataagggcaatgagggatagaaaaagcattaacaggaagctttgtagctgtgtgaacagctggatgtgaacatatcttgtatcactggggcaatgtaggatagttgatatctctttgtcacgacagtttgttaatttcagagattcagcatttcattgagccatagcattgtcatgtacagctcatacctctgttggtgtttgtccccagtctctttctctctagtgagttttccagttaattttattttagtttaatagcattttgtctgtcacctctgactcatgacttcgtgtggctgtgtgtagggacttgaacagtgaatacagtagattacttagagatttgtttttagtttttacaagtgaacaaaagtgatcacatttcaatgtgggaatcccagtgataaatgccatttccgtagagagttaactcatcaattgaacaaagcaatcagattttttttcttagaacatattaccatcaatttttaagtgacttttaaacaataatgagaaatctcttaatgaaagaatctctgtgaccagataaatgctaatagtaactgatataccattaactctactttcctccatcccatctctttaaaacttgatgttctcattaatttttttcccgtcgtctgagagccctacccttgggactatactagttatatctgcctaaattgtcagtgtccaggggtgacagatgtagacaatctcctcctttattatgcatgagctaggcaaagagggtttgtactcagtgaccatccattttcaaggccccttccccccatcctcaaccactgggggtaaatgggcatgtttgaggaatgtttgccaaagggttaccctgatttattaaagctgtcatttaagcatttaagcattgaccgggatgcttttcaaacaaatgacctgatccttaggatatattcatctaactaattctgtttactaagaagaggttggaaggtatatgcagaatttcttcacttcgacataaaataacacaaagagaatggcacagaacccagagtttcttgccctccagagagatgcagctgacaatctggaataataacagtgttatgctatgatatgataagggtgagccagagatgcttgaatgcagatctggctccttgaaggaatccatattatgacctaaagaagaactagaaactgagtgggtataagggcatgcacaaaggcccacagagaaaacatggtacgtttaggaaaccacatatattagaagagctggagtgtagagtgtaagtcagggccagctggaggccagagatgaaagttagcacaggccatgttgttaaaggccagataatctaagataaaacatttagactttagcccaaggcaatggggaacgcttaaagtagggttggcatgttcagatgtgtgctttagaaagatgacagaaatcctgtggagtaggaatctatttcaccgatgaaaaactagaggctctgagaaattatgaaacttacctatggtgacacagataataagtcggcagagctaaggtttcaacccaagtcttactccaaaactcatgcatgagcttccagccatgctaaggtttttcaaacttcatgttacaccctattagtacctcttaaaatcaatgtagtgtgatcaatgaatatttgttaatagaatataaaggaaaaagaaagagcattacatatactgtaagtaattaagcattgttttgtatttttgttgcagttgtacatgtatgtaaaatgtggacatagggtatgtgtatagctgagtattggcacatgatgcaaaatgcatttctcagagtagattgcagtcaaaaatgttggaaactactaagcatgtgcaaatagcatgcatgctgctgctgacctgccagatatttctcccttcctccctttctccctcatttattcattcattaactgattcattcatcccattaaaaaaattatatgtatgttttgtgcaaagcaccctactcaaggctgcggggtacaaaagtatatcagaagccttgggctttgacctacttctctgtagtagtgctagatttgtgtggatctgccacacttactccaggcctcttgtgacctgtgctttgcattaatctcttaggctaagccacataccttttcattatacaatctttgctgatgctaaggacagattccaaagtgccctccttataatttttgtatttaatgcaaagtgtaatcaagaataggccattgttaggtcaattgcttttctgtatttatcttttcaaacaataaataatcagtgggatgaaaaagggccggaaaagatagttttaatggtatactcataattatccaacattttaaggagacgttttaatatttatatgctgtgaaatatcctctcttctggaaagctgactgaggattggtatgaacccatccagaaatggaattcaggagccattgttttgcacagacttcagtcaatcctgagcaagcactctggattttcccaaacttggccgttactcagcctctcactctccaaattgtcaagacttctgtataccacactaagaaggatattctcttccatgtagatgcagaagattttctatgtcaagttcagtagggggcctaggctcaagccatgctcattcttagaggaaaacctgacaggatatccatatactatgccctctactgatttattcacgaaaaaccaagccccaaaaatgccagtcaggtcacacgcacacttaacaccaagagcttaaggtgtagtcacatcttacagggaaggttagtctttaaagtcaaacacaagataagaatagctcacagtcaaaattacccttgaaaatcccttaaactaccctttaagcaaagtgtgtatgatattatatacaacatttatattaattagtatttatttacactgtggtttaagagccaggagatagaacaaaggaagacaataaaggaaaatctgtatagaagagacagcttagcagttaaggccatagattctaaagccaaaccttcttgatttaaaacctggctctgccactcagtatagttgtgtggctttgcggaaattattaccatctctctggctcagtttccacatctgtaaaatgagcataatcgtagtacctacatcagagtgttattacaaggatttgcattaatctcttaggctaagccacataccttttcattatacaatctttgctgatgctaagaacagattccaaaggacagattacatatatgagttcatatatgtaaacagaaaaacagcagctggcagttaataagcaccatttaagtttaagctaatgtaatatatgctgatatgtgagcatttacaccattttgtcattaagattgcgattcattccctgttagtgaactttgaagttgggtagggaattacaaaatgttcttaattctcaactttagtagattttttttttccatttggatgacagttcttatcaaataacttcatatatttgtctttacattttctgtaaccatatagttataattattatatagtcatagttatatatagttatatagttatttttaactttttattttgaaatttttctagagtcagaagttgcagataaaatattgagaagttccttgtacccttcacccaattttctccagtggttacatcttacataatcgtagtacaatatcaaaaccaggaatttgacattggtacaatgcatgtgcatagttctgtgccattttgtcacacaggtagatccacgtaaccatttttgcagtcaagatatagaactattttcatcaccacaaagacatccctcatactactcctttacagtcacacatctttccccatccctaactcttggcaatccctcatctgttttctgtccataattctgtcatttctagaatgttacctaaatggaatcacataaatggggtagcatgtgaccttttgaagcatgtggcttttttcacaccctggagatccatccaagttttgtgggtatcactagttcatttcttcttacttctgagtagtaacccatgtatggatgcactatttgcttaatcatattggatatggttaacccatggtatggatgtaccattgcttaatcatgctatggatgtaccatttgcttaatcattcatctgttcctggatattttggttgtttccagtttatggctattacaaacagagttgctataaacagtcacctacatgcttttgtgtgaacatatgttgtatgtcttccattcttatctgtatgctttttatttccttttcttgcctcattgtgctggctagaacctccagtactatgttgagccacagtggtaaaaatgaactttcttgacattttcctgaaagaaaacattccttctcactgttgagtgtactgttagctataagttttttgtagctgtctttatcaagttgaagaagtttctcttcattcctggttttctgagaggttttatcataaatgagcatgaattttgtcaaatgctttttccacttcagttcatatgatcttgtgatttttttttgtttaggctgttaacatgttggtttacattgatcacttttcaaacattgaacctgccttgcatttctagaataaaactaatttattatagtatataattatttctagtcatagtatataattaaatgtagtcatagtatgtaactattttatatatttttaattgtattaaatataatcatttaataaatactcagttaaatataatttaataaatattaaattgaataatcaatttaatattgtattatgaaataatttatcataaatttaataaatttaataaatcgtttaataattatatatatttaattcatttgctaatatttattgctgtcttcattgaatgtgtaaggaaagtattacctccccttctttttctggaaaggattgtgtagaactcatgttaatttttctttaaacatttgttagaattttccagtgaaatcatctgggcctggagagttcttttttatgaggtttttaattatgaattcaatgtccttgataactgtaacgctattcaaattatatcatgttgtatgagttgtgggagtgtttacttttctaggagttggtccattttaagttatcaaatgtatgtgtgtagaattgtttgttgtattcccttattttcctattgatctgatattgttagtatcttattgatctgcatattctgtagtgatatcctctgtttcattcctgatatttataatttttattttctcctttttttgtcaatcttgtagattttaggctatgttttcatgtatcttaaatctacagatgttttgagccaaacaatacactgtaattactgtttatatggtaagcatttattttaactgttgctttttctctttgttcctttctgaatatctgtgtttcccagaatacttttccttttttccttaattatttcctttagtatttttgtaatgtggcaaattctctgtttttatttgttttaaaacagttttatttcatctttatttttaaggatattttctctaggtatgtaattgccagtgatttttttcttcttttaatatattaaagatatcattccattgttttctaactttcaatgtttttatcaaagtttgttgtcagacaacttactcctttgaagatacaggttgaacattccaaatctgaaaatccataatcctaaattttctgaaatctgaaactttttgagcactgacattatgttcaaatgaaatgctcattggagcactttggattttggatttttagatttggaatgctcaaacaataagtatataatgcaaatattctaaaatccaaacacatccaaaatccagaacacttctggtcccagacttttcagataagggatactcaacctgtaatgtatcatttttctttgactgccttaaattttttcctttttgtcttggttttcagcagttttactgtgatgtgtctgtgagcgtgtgttggcagggaggtatgtttaaacctgattaggatttgcagagcttcttaaatctgtgctttagtgttcttcatcatctttgaaaaattctcagctggtcacacctcttcagaattgtttctgttccctcctgctcctcttcctctcctcttcttcctcttgtcttcctcctcgtcttccattttcttctgtctttctctctctctcccttccttctgggatccaataaagcaaaaatatttgacctttctgtacatgcgtcttgctctctgttcgtttctggttttctctctgtgatgcagtctggtttttgagttctctgtcttctgatttactactcttgcctgtgtgctgtgtccagtcttctattaaacccttctgttgagcacttaattttagttattgtaattttcagttttaggtgtctatttgtttgttttaccctgagatgctacttctctgatgaaattctccatcatattatcttttttcttgaataaattaattgcagttattttaagaaccatgtctaataatgtcactatctgaataatgtcactatctgaactgtgggtctgttcatattgtttgattttcttcttcactttagtcatttggtcttatctcctggtatgcatatttttgatcaaatgctagacacagtccttgaaaagctgtagaaatctcaggctgatgatacctttcttcagagaagatgtatttaataatatgtcccattaagggacacattgccttaatgcagtctttgattgagatcactagaagctggattttagttatgtgaggggtagtgtattagtttactcttactcctagagggtaacctttctgtgattctaactgagagtctgtgttgtttacgagtcccttcttccttagcaggttctcaactccaattcctatcttcccatccctgtgagaatgtcagaatctctgctcagcctccaagtctctttgccactgcactctgctcattttcttagcatttgattctgtgccacttgtgaattagcaaatgacttggagagaaaaaacgccacagaatattgggctcagttcagtgtgcttacctacctaccttttagaatcagtcttggcctcccaagtcctagctgtcttgggagttctccaatgccttcaagtagtttttaggtttccttttttttaagcttatccagcttttttgattattctcatgagagtaagaatgcaacaaattcttccaccatcgccaaaaatagaaacccttatcttttttttaatgttaagtgttgacaacaatatatggttaacagacttcgttgttagaaggataaaaagaaattaatatatatgaaagtaacatgaatagggcctggtacatgatagacacttttaaattactttcaatttgaatttgaatatacagtgattttggaaacactgaaaaggttagtgattagcattacatttttgcctgttgatctttcttgttgaggccctacagtcactgttgtgctcctgggccttggtcttatgaaccttccatcagtcacattcctgaaggctgcctcttcccatcagtctccctctcagagacctgttggccctcctcaccatttcagtgaccacgtttagcaacaggaaggatgggtttgcttccttctctcgtggctcatgtctcagtgttcaccacagaaaatagctaatctggtggtggtcaacttcagacctttgtctcgtttgttttcctgaatgtttgccactgctttgcactcactgcagccttgttccagcttctttctcctggcagtgaggccagtgttggtgaaagatggcatggatcttacaaatttgtacttatgtgagtgaaaactgagaaatgccgagaaagacaggcagaactagatctaagtgtttcagaaactaggaacattacagtaccagaagacttggatgtgcttaattccagtttagaatctggaaaacaacttttttgagtctctgcaatttccaagtctcaaaactaattcactagaaaacatttaaaatgtaaagcaatagacttcagtagtaattttcagatcatttgagtctaaatgcagctttgaggatatgcagttcgtaaatttcctactgggtcattttttttctgagagggtatttctctaaactatatcagataaaggatgcccagaatttgctcagatgtgagtttcaggatctagaaacacaatatgaggattatcaagactaaggatgttgatagtgatgatgatgatgatgatgatgatgatgatgatgatgatgatagtcaatagtagtatttattgtatatttaatatatgcccagcattgaggtactttacatgcaatatgatgtctcttgagcaacatttaactttctattgattacttctcttgaggttatcatctttctcctagtggtcattaacatagagtttgaagctgggcataaatcctaggtataaatcctaactccacagctgctgtgatctttgtccatacaatgtaacatctttgagcctctctttgcctccagaatgaaggtgataccgtatctcataaaattcacagaggcctgaatgagttaatgcatggcaaacctgaagcacagtgactggttcttcctattgtgtgatcagcaagttgtagccatttttttcctcacttttctaccactattggttgaagtgccctttatttgacccgtcaaatagaggatctggagaataaaaaaatctaacaatgtaagaagaggaggctacagaaaccactgatgatgtattctgtaccagcttagcctccagtccagggcttaggaaacaaggttctttaacagtcatttgatttccataacattcattaaattaatgaatctccattcaacagatatttattgagtgagatttagacacagtccttactttcatggaacttaagacctacaggaggagacaaatattaaatgtgtagttataagtagagtgtcataaacatatttgacactgtggaggatcaagaaagaagtcactgagaaagcgacatttaagtcgagactcaaagagtgagtagccatgagaatttgggtgctgaaagaggcatgaaaggcactctgggcagaggagcagcatgggggatgccctgatgtggaaaggaacttggcatgtgtgaagaagtgaaagaaggtcctcttaccaacaccaagcaagaggataaagagcagaggcttagtaaatggatgagtcagtctgcctggcgcctttcttcccttcattgaaccaagaggtattccctagcacggactgccatgtagaaaaggtcccctattatttcagcaccacatttcagcttacccatggttctccagctgtccagggacatgcaccctctacctcccagagacctaacctatttccctatcacttattttcagggctatgaggtgccttattaatgtgataaatgtttgctccttggtcaacttttagtggtcctagataattgttctcaaatttgagcacgcatcagaatcacctggagaacttgttaaaccacagaaaccttggactgcacccacagagtttctgattcaataggtctggggtgggaccctacaatttgcatttctaacaagctgccgaatgatactcatgctgctggcctgggttctgtcggtggtgaatcattagtttaaggtgtctttcttctttcagcagtttaatagtcatcatcagttccttaactgaaagagaaatgctcaggcagggcttaaaggaagaaatactaaaatcaaaagtagactttatgagtaagtgtgacaatggcctaatggaatggacttctttgtaagcatgacttaccttatacatctgtgttcccagtgcttagcacatagcgggtaccaaatacatatttgaaggaatcacataatggatctagcttagtgactaaagaaatgggttttgtgcattagtctttggaaagctctcatgattcctttcaggttgaaagacgttctgggagaataaattattgtcattctcttggaatacagccctagaaattgcagagtcaagatatgcttgtattttaagtacttacttggattaaaagccaaattgctaacaggattacaaaatgccaagtttgctgagtctcaaattgtttatgcgcatgtttggttcaaatttctttcatcaatcagtacatttctgtttctaattacagtcttaatgttttttttgacacctgcacatgcattcttagtctaaaccagcttcagtaatttgcacagatataatataactgaaatgaggctcttaaccaccagtgtgtcacctataccacgtgtctgaggaattcagaggtgctgcacctcagttcacattgtgattttgaaaacagcctgctatttttcccattttcatgcccacaatgttgtaaacattttaataaacactaacacttttcctcattccaggcacatggagttctagtagatgatgcaacatgattttcgttgtgattttttatttatgtttattcttggaatctctgtacttggataaaagaagaagacagatgaccaagattaccataattgtccagaatataatgtatgcaatctggaagtttattactaccaccgatcaaattgattgcagactcttagtctagtcccagaagtttggggctggttttgatgtgagccattcatcaaatctcagacgtgactcacgcagtggctcatgggtcaaagccttccacgtattgtaatgaaccaacctgaacaattctgtacccagtttttagtttggattgtgcccctatctgacacctgtaaaattgtgagttccctgtgggctctaataatcagagtcctagttagagaaaaagtcatctcagcatcaactgacaattattttttttgccctcaatatccttccctgcccccttatttggtttgaactgactcacctaattggggtcaaccactgaaaaaaaatgtgttgctgattttgtcatttctgaatgcctagaactaaggaatatcttggcaatgacattgcttagtcttccttacacataaggagagtttgaacaatggatccaaattatcattgcaagagtgcactcagttaggggaactcagctgaggtgaggaacacgtccacgagtttcccctgtgggcatccagagtagccatggcctggccaggcactgccttgcggcccttccaaaggtggcagaatgatgttagtgttaacatttcactgcacattaattctttaaaaaaaaaaaaaaaaaaaaacctgtcatttaattttaaatgctaatatgcatatggttaattaagaagccaaaattggctataagctcagtgagctctgagaacggggagagagatcattacacttctgctcatggttagctatttgtgaaccaactgataatgtgcaaaattaagatttcgtaagtggcattttaaatgaatggttaatggctgaagattaattaaacagtcagagttgctgaagaaaagctgttaaaaattatgtttataggccagtcacttgcacgctgagactgaaatcctgaaagattgtggcctgtttactgggagagcattttaacaaagcagcctcctcgaggaaggaaagccagccacccttccccacataccatgcagctgttgcagtagccttagggactttgctttggagtaaaagcagccgagtaggaaaatggactagaaaagtgttttattgaagggatcttcactaaaaccttcatcccaggtaaccaggcagattttatttcctacctgcctgccacagagttctgagttagagtagtcagaacccatgggatttttaagaaagtactccataattctctaaaagagacaaagaattgcagtatattgttttcaacctgtagtggatacttcttaagtctgaaactgccagccctcttggtggtggaaacatggattctgtacatctggctctatcctaggttggttccttggaaaaaggtttgcctttgtatttaccactgtgcattgtgcataggaggtaccatactgtaaaaatagttgtaaaatttgttgtcagagcttacctgaataaatattggataaatcaatgaatgaatgagctacctaaaagttggttagtagactaggaaacgctctttttaaattcctttccatccatccaacaaatgaccaccctacttctctcgtagactgggtattaatgtgtggtctcagcctctgggaccacacaatctagtgggggagtcacaggcctgtcaacaagtaagttgcagccacagttaagcacagctagagcagccagagaggggggttaggaatctttgggtgcagggtagtcagaagtatattttgctatcacttgtaaggaagtttattctacctattgaaaaaatattagcatttatggaaaggctcttcactaaaacctttctctaaaattatatttcattaagaatatacactagtaaatatggtagttcattcagttcaatctcctgcttctaggcagaagacccaaatcacacaggccagatagttgtgtctgttgtttaaaagttccctaggaatggagatcctgcagcctcccttggtggcctgttgcagggtttaatcacccttctaatcaaggagttaatcctatttcctcttctctacccttctttgggttagtggaacctgtaaaaacacccatgagacccctcggaagccttaaggaattagtgagtcaacactgggctactctgggttcagcagtgtgcctggtaatggtgagactctgtactgcacgataacaatgacatgacttcgttacatctcaaatcaaaagttttcttcctggtctaaagaaaggaagagttgtttatgttagcatgttttagatgttgttttattacattttaatctatatgtttagttaattacacgtttgacctaatgtcatataactcagaagccaaattgcagtgttttgatttaaaatgaaatcagtaattattaaaaacaactaacactaaatagtgagaatccactattgctagacacttgctaattactttgcatgtgtcatttaatcctcctgacaatctgatctagtggtactattagtattcccaaggtacaaacgaggatattgagttgtagagagggtaaggaactggcgcgatattatcaggtgagccaggatttgtacgcctgaataaagagcctagacgtttaaccactgtgctatgctgactattcatttttaaaaattattttgctttctataaaactcgatttcattatctgaattcttttttcccctatgtgtgtaaagtccaaatttataaactttccttgtgggaagtaatagcattctgatgaataatagtccccaggtcaacggcagctcttgccgcaattactggcagttgagtggcaaatacattctactttaagaaaggcagtagcagttcactttagaaaaactgataattcaaagcttttccattctggtgaaaattttcttagcaaaagctaagaaaataggtactgatgggagaaaacctgccccattgaaggaatgggataaaaacctcctgtttgcagatgccagaagcatctggagaacagtgatgtccaataattgcagctaaaagctgcattaattgaccagtgataggttgaaagctgcctccaaccaggatccctaacactctggtgctttttcataagcagagtgagaggcaggaggtggtcagcttccatggggttctccatacagaaagggagcagctgtgacagagaagtgtatttctacagaagaaagtttagcgtttcaaacggatgcattcaaatcacctggggatcttgttaaaatgcagattttgatgccaggggtctgggatggggcctgagttgtgcatttctaataagctcccaggtgacactcacgctgctggtccagggaccacactgtgcttagcaagggtttagactagaggaaggcagtgctgaattgttattgattttaaaaaccattttaaataaacatgcagcaaatctttttataaccttccaaaatttcagctgtcatttcctcatatcggtgagatttgtgagaaatcccattcctctgcaggtcagaatattgttggtgctgttagccctgtttcctggaagagagggtatgacattttttgggtcttttttatattttaactgctgctgtctgcattagtgtccatgctttgacctcttgctgcacccagagaaatctcttgcaccttagtaatatgctgtgtctccacagttgaataagcatgaatttgaatttctttcctcaagtgctgctacgaacctgccaagaaaagttttattaatacaactaagtaatccatttttcccagtgtaccccattcacttaagagtttcaatggctgtgtttattccatcatttcggttaaagctaattatgctcaaaagatgtactttaccctaatatgtgtggcttggtttttgttttgttttgtttttgtttttgagacgaagtctcgctcttgttgcccaggctggagtgcagtggcgcaatctcggctcactgcaatctccacctcccaggttcaagcgattcttctgcctcagcctcctgagtagctgggattccaggcacccaccaccacacctggctaatttttgtgtttttagtagagacagggtttcaccatgttggccaggctggtctttaactcctcacctcaggtgatccgcccaccttggcctaccaaagtgctgggatcacaggcgtgagccacaacgcccaaccaggcttggtattattttaactgaatgctgctgtcttaatgtctctgataaagtatatcatctccattgatctgcatcataaacaagcacaaaggtttctagaatatatctttttggtcattttgtttgaataccaatattttaaattacgtgacctttttttgaccaacagcagcaaaaaagttgtcaccacaagagccatttgtaatggtcaaaagagaaaacagaaatgtttccgtggggcttggtttgcagatctgtgtgtttattaattctgtgaaatgccattgaattacaataaataggaagatgttctcaatgggactttcttctccatgtaggaaacattcaaaatctagaacagaagcaccacccagcttggtgtcacaacagtggggctgtttgacttcagagcaactctatccaatagagatataatacaaaccacatatgtaatttaaatatttcaataacctcgtctttaaaagttgaattaattttataatatattttatttaactcaatatatgcaaaatatattttcaagatttgttcacaataattattctagagctattgtacattacttttttcatggtggaatgaagccaagcatatctcaatttggactagccacaattttgagtgttcagtaatcagaagtggctattggctgccatattagacagcattagaaccccttcaacatacttccagtgggagctgatgcctcagttggaagttttctacacactggagtccagggcagcgaaagaccctcccatttcatggtagttcctgaagcagaaaacattttcttatgttaaacctgaactgccactaaacaagcaccattgtctcttctcttgtgaagtttatagactagggtaagaaaaagacatataaacaatccattcctgcttcagggaacagacacatttgtcagccctagcttttcaatatctagaaaaatgttccccacattaggtgccagatgctgcacagtaaggtaacctccaagtgggctgagctagaccaggcctaggtctgctttcatcccagttctttcttgctttgcccgaaaggaaggcaaaaacaatgatctagcttagcttacaaggcttctttttcctttagacataggagaatggaggctggtcttcagatatggaatatgtgtaatccctccacagaaggcttcgacaacaactaactcaggcacatgtgagaccaaactcacagtataataccagtgcgattctcatttagctacaaacttttccttccttaccaatagatatttcactattgtagccaggaatcctgagaggcagtgccttacagcagagccttctctttccctgggctatactctccttctcagtaaaccaatcatccctcaagaagtcgtgcctgtaaaagatgatgtaacaacagatgtagtcttcactttattaatttgcatttatcaccacaagcttttcttcatgactattgctgctgttttatacctgtgacatctcagtatagagaatgttatccacctcattgctcaagccagaatctgggagtctttcttgaggcttctgccttccctgaaccacacaactgacctctttctgaggaagaggtaggggaatgggtagcactggttctcacgtctctgcactgcattttcacggtgagcatcaggtacttctcactgttgggtccagtgttcctcaaacttttatttgatccattgtgctttccctctggcatgctgcagtcatctggacaaggcctcaagctccctacatgcatttcctttaacaaatgcctctcaaaatatatgtctatatggctctcttcttgctaaagcccttccgtcctcccaattttctgaggagaccaaccttagctgcatgattcaataccattgtactagtgaccacagtaccatttttcccctctatctttttttttttttcttaatgaagccctgtgtgttattcaggattcaactcaaacatcccatcccttagtgatcctctctgagctttctgtgtagacttctagcacagaatgatcacagtgtgttggaattgactgttaacttgtttgtttcctctatcaaatcttgaagcaggcatgatgttttcaatcctggcatagttcctaaagcattgggtagtcaataaatatgtatcgaatgaatgaatgaatccaagggactctacccttagctacatgacttcaaggtgacacgagcttattggacatactcttggactgaccaacccccaaactataacttgtcttgcctcctagtcagcacggcttccttctgattgccctctccttctgaatcatgatgccatgattctttggttttagtgatcccacatgtttctcctggtctttggttctcaccactgggcaaggtattcttcctgttcttcagcaggaggaagcacttcctactaaagtatccttagatgaaggacttctccagggcacagcaggtgactttttcaccccatccagtctctgcttcagaagcttcttaaggggaacaaggttgtttgtactgtccagaaactatagtcagcctaatcttggctgatacctcaagaggaaaggctctacttggcaattacctttttgtaaatctcttcctcacaccctatatttgacatagactcctggtattgctctctaaccatttctactgttacatcccagagaacgttgcattagcaaaatttagaagttagcatcaaatagaagtcctctagttattctcgaatttgcttcccccattttaaaaagcttgaccattacttgcttgcctccagtatcaagacacatctgccattgtctataatttctcaaccatgctgactacgcatccacgagtataccttccagctctttcagtaccttgaatataatttgtaagtaccagtaagcagggtgactttaaagaatcctggatcatgcattttctttcttcctcccactatccttttctttttggcctctctcctgctttccattgatggagatgtcaggtgagtcacttaatgtctgtgtgcatctttcctcacctacagacacacagggtggaactaagtgatctcagcattttttttccagttccaaaattatatggttctgcaattctttaatggaagcaaaataggagttcaggttgctctgccttttctctggcactgttaccatgtcaaagcatcccctcccagcagtgccctagcctttctcattcctcttcaaagtagctttcacaattaaatctttaatgtcattatcatttgtttcacaaccctcttagctcctgttgaactcggcttttctgactgtcttcagacctcttcaccaatttctttgttaaccacagtgcccatgtatccactgtcagatgactccctctgctcacccctgcaggagtatttaagcttaaccccagatttcaggagttagagcatttctcctgaatctccctaaactcgcatcagatctcttttgtccattcaggttgtcctgtctagataatgagaatttaagttataagatttgtaaggatcatggaataaaggcatacaggcaggtcactatcagcatttccagggcaaccctgtctcccacttagatcctctggcttagaaactactgaagatctgtaaaacgtaatgaggtttcaaacagatgtggccactgcccctaggagttggataggatcctctgtgagacagggcagagaaagtcatgtttgactctattaggaaaaattctatggagtttacaatagaatcatagggaagctcttaaacagcaccctggcccattacagacaagtagacatggaaggatactttaaaacaaagtgtgttttcaagtgtttcacgtgtgtttcaagtttaaaacaaagtgagttttcaagcccaggaatgatgtgaatcagacatcagaagggagaatcaattcttgcagtctgatgtttgacaagttgcaagttgtgacctcgttcataccctttaattcagtgactggcagtgttggtcagctgtgtctttttaagtggatccatgttgaagtttgttgtccaggtgagtttcaaatactgggagtaacctgaaaagtcttgggcacagtttcctagatgtattgtagatccataggtagacacatggcttaacatcttccattcagttttatgtaaccagtaccactttttcatattgatatatctatatgtctttttctatatctagatgtcttttcttaagttaaatgcattggcttaaaaaagaaagacactatcagtgcaaactcacttttctttttttttttttttttttttttctgagacagagtttcactcttgttgcccaggctatagtgcagtggcgcaatctcggctcactgcaacctctgcctcccaagttcaagcatttctcctgcctcagcctcctgagtagctgggattacaggcatgcgccaccacgcctggctaatttcttgtacttttagtagagatggggtttcatcatgttagccaggctggtctcaaactcctgacctcaggtgatccacctgccttggcctcccaaagtgctgggattagaagcatgagccaccacgcccggccctcatttttattttctaaactaaaaaacagtaacctgagatactcactagaaaataccttggccattaattggtcagaactgtaactttcaaagtaacctattgtctgtttacatgccacatgacatgaaactctattttaatcaggaccgtcacagataatttctgcaataacatatatctagggatggttttcaaatggagttgtcatgttgtgtttagcagacaggagattctctattgttgtcaggccctctttacaaaagcatcagtaacccagtgatcctagagaagcagggcttaccactcagcttacttagaataaaaaagagcaaggctggtttctgtctgcacgtagtgtgtttgagggctcttttgtttagctgggcttccttgtagccaacaatgcttttacagtcttggaattggatttcattctcctgtactggtttttgaaaagtgtaaatagtttaatgcatattgttattctctgaaggtaacataggatgcataaaaccgtatacatctgaattgtctcctcgaccaatgaagtcatggaaagtcaagaaaaattaaaccgtctctggatttatacacactctccctttctctctctctgacacacacatgtgcacacacacacactttctctttagtgcctttcaaagttgtcctagttttcttacaattagcacccaagacatactttttcaataattagtaaaaaaaagttaatttttgtccattgttaaaacagtgaaattttctttttagagtacataggggccatcatactgagttttatgataataaatactattttgtatcatataaatatgcaatgatatataacatataataatttatatcattaaagaggggctgaaaaaaattgttggcttctacatgtttgttcctctcaagacttctcctcttaaattcccaaagaataatacttctttattcttaaaactcactttatgctcaattcccagaaacagaagccaaatagggtaaaacaagatgcccagtaatggttcttacagttctcaggttctgtagtacaccatttgaagctatgtagtcttcaaccttgagtgtatataacagagggaaaggcaagctctagacatccattccagtcctaggattctgtggttctgagaagtgagaagggagacaaatgagagtatgggaagttgtatagagggggggaacagacagaaaggaacagaacaatgagtagtcacttggattacagaaggaatggcaatggaggaccaataaataagtgaatgaataaatgaatgaatgaatgaatggaaagaaaagtaagtataaggaagagaatgaccaaaaatagaagttgaagtggtccatttgagctagaagcttggcaattttacaaattctagcaacttcttaagaagctctaaaaagaaagttctgggttaggaagtttctcataatagttttcccactatccagtccccatattgtcttccaccataaacatctgccatgataattctccactgctagacctcagaagactctccctttcccattaataaaaaggggactgatttcataaatttagcatattacgcattgcagcattctgcctttcatatcataggttaatttttcatggatcgttatgaaaaatataaacaaacttaaaattctatttatgattcagacaaccaacaaagtaatgagattctgtgttatggtagctgtcacatcttgtctcagcccattgtgtctaaatgttaactctcttattaagctccattaaagggttttacaataccaaattgtttatacactgctggttttctgctgcctgacagtagggcacgtttcactcattaatatgggtgatatcttacattgttggaaagagctgaaataaaaataaacaggaaggtggcatgtactaactgaaatgcttctttcttctatgtttcccaatataaggttatatatatgtgtgtgtgtgtgtgtgtgtgtgtgtatgtatatatatatatatatatatatatacacacacacgtatataaaaccctaaatatatatatatatatatataaccttaaatatatatattttatatttttttaacttgcagttcaacctgttgtcttacgaaaggggagatattcttttctttgttacgtttaaatgaacttcaccctgagctaccaaattatacttttgcaagcttgatcttcaacctcacttatgtccccatgacaacctttcttgccatgtgaaatttagagtaactcatattggtaggtttcattatgggtcataaagcactgtcatatacatgttcttatttcatcttcaccacaacccggtaataagggaagatagagatgctgaatctggtagaagagaaagctttcctaaaactactcagttaaaaaatacaggcaccaagtttctgtcccactgtggttagttcagttctaatgctacttgccttctttttatatttttattatttaaagatatacttttattttcttaattttctctgagtattctatattaaatttaatagcaaaaagctaaggaagaaaaaaataaaattgctaattattccacgatttaattggctattattaactttttagagtattttcatccagtgtttcttctggttttttgtttgtttctgtgtttatcactgcatataaaatatatcatttgtgcatgcatatagtgctcacacacacatatagtatttacatgcatatacacatttgagtattttgcctttttacaatgatactgtgatattttcctgtgtcaattaatctctttgaaaccatcgcttttaaggttgcatgataactgtatcttaatttatgtaacctttcccttaatgatggacatttgggatgtttcagagttttcagtgttataaattaccctctgataagcacctttataaaatattttgctacacagcttgaattatttccttaggattcctggaatggaaatgatgaatcaaaggcttgaaacatattgccaacaattttcttgaaaaattgaaggaaataatgcttccaccagtaatgcagaaaatagctaatttcaccccattcctgacaactttgagtatcatcactttccttcctttaccctttactaatttgattcatgaaaaatagtactgtatcattttacattgaacttcttagcttactagtgaggttaagcatttttatagaagctcacgcctgttccaaattaccactagaagttttcagctcgcctcagccgtgagtcattaccaggaggaatagttttttgaatcaacttctgtttcctccctcaacaaatctatgtatatttatcaagacgtatttggatgcaggcttttatctccctcttgacaaaaatgaatgattatgcacccaggtcttttatgcactgaactaagctatatctacttggaccttgttttaattgactcacccttcccctaatagaatagcgtccctttgaataggcagtattagaaaaataagagcctcacagtagattgtgaaagaaatgtcacatcagaatctggacattgctatgacaacccaggccccgtctatcaccactcccatcagcatgtgttgcaaaggaaacccctttgcagtgtttaatctgagaattttaatattaaatacatatttgacattgaaagctcacaccttatttgctattgtcaggcttgtttgatagacagctaactcggtctctttttatagtcaatttctgaaatgaaactataaattttgaagctgggcttcatcatcgcagagagcaaagcttttctagcctattgttgaaatgtcacattttataggatttatgtggtccagattcaggaagatcatttgccaagcacttaaggctggttttgctgccctttgcttttctcctccctgcaaatacatatggtggcagggggagagccattagaaaagaaaaattatgaagaagaacttacttgattcaatacaaatgtcagcctaagaaagaaaaagtcctgcacatttagtgtgaggagcgttgactccagaagcctgctctttggtgataggcatactgtttgcttctgcaaatgaagtgggcatcatatttgttgtgatagtcagtgaaagcctctgatttggtgcagcagtttgaatttatgctcataatacaagttctctccaatatgcttccaggattccttttgaaactccatgatatgacaagctctgtgatttggtcatattccatttagcttgttttattgctgttaattttacacaggaaaatagattatctgaaacttgtgatcacagtcgctgtcaagtggtcaaaaatgaagaaaaccaccagacagtgtcagatttattaaatgctctaggagtacaaaattaatgcagttctttgtctttgaaaggttcagtgtccacaagctggatttatcctaatggacaagcagtggaaagaacagtcgtcaattagctatctctttagccagactacacgttgtcggaatgcatgtagggtgagccaccagtgcacctaggcagacctccaatttgttcattttgactgtaagtgacttaatttaacattttttctaagaaatacattaggtagaatggtgaagtttcctttttttcatttttttcttaaaagaatcaccggtgaaaagccacagtaagtaggcttctcactccatttgttttcaatcaccacccttaatgcataaatttctgagtagcctgttactcttccaagccctaaactgtagcagtgaatgtggattggaaagttctggtgctgtatccactgggtctatgttgggtttgaacatgttttatatgcatagcatgattattcctgtgctagatgatcttacctgtggccctttgttttctgggttttttgtttgtttttttgtttgtttgtttgtttgttttagcaggaatgaattttgcattaccctcttatgagttacagtgtgcaaaatactttgaaagtaaagttttggttcccacatgaaccatttctcttttacacagcaatcatttatcacttataagtgttaatcacttattaacagtaatttcatctgctgaagaatttatcccctaatcatgtgattttgtttcttcatgtgtgtatgtgtatgcgtgtgtgtatatttacagcattgacattttgtattcaaaaatattaacttctcaccttggtattctggtagtgtaatgaaaacatctgttacttgtgtatggcaatgatgtttttacatctatttatatttgtgggtagattccaaattgattctatgtgaagatgcacttcaaacaaaattcagtaactacatgtctggctttgggtttttcaaactgtggggtttcaaccctgaacatgaagccctgatgcaggacttaatcctgaactctgcaaacgtttccttttgcacttcaacctccagtcccactttatataacatggaatattcttctggttattatgtaattcattatctaaaatatgttgtgagcagataagcacaaggactctgaatgtggcttgtatatttttacagcaactctgtgaatattctctttggtgcagagtggagatgtgtgtggaagcattcctcctgaattttttatagactctctccctttgccactctagttgctgtctcccacaaaatttgagtcatacctcaactgtacaaatcctcctttgatgttcagttgccctgaagtgtgcagttgtggaatatgtctaaatgtctcctgtgaagagattggaggcgttggttttaacaaaagcaataaaatgattacagctgaaaagcatgctggaggtaaacagacgtctgtccttgttgctgaaccattgctctgttaaaaaaaaaaataagcacatgatttagcctctctttgttgctcttgtgtctaggaaagtcaaaaggaaggaatttgatttttattgtccccaagatttcagtatagagtcagccctacagtatgagaaacaatatcttgcttatcgccctgaattaccattgtccaactgtgagagcatttgcaagaaggtgagagtgtttgtgaaatagacagaaagggaaatcatgtgcttggataaagctttttggtttctttagtgaagtttctgaattttcttctctaaccttggcacaaaggccaacactctacatgcagtaggcacttagtaaatttattttggtgatgggtgattggtctttagtaccatcaacatcccaacccagggctagccttggagaaggacacggagcaaggagaggtttaattggggaagccccactccacttcatccaaccttctaccaggacatcaaggtcctcatgatctgtagctttccctcctggcattacctcttgtccacaaagtattaattcacgtgcaatgaatggtgtctatggctacctagcactgtctgtacttcagcgaagagtaaagccttgaagtaaactgaggctgaatttctggcatcagcctggaggcaatgggtggtcactaggggcgcccccattaccctgaaaacctgtctgtgtgtctctcctccctagtccgtaatttcctttactaggcccaaccagtttctcctgaaaatattaatgagagcacttcaaaatgtaggttgttgaattttaaattaacctagagcatcacattgagtgggttttcatggttttctacattgtctgctggatggacttcctgggcagcaagcatatcttattcctaacgtcatagtctattcgcttttacccagagccgggcttcatttaacaataaggagatgttttcgattttaccgtatgtggaatgtaacatttgcatttggcagttctccctttagtcctgctcaagatttcagctacctcggcagagtgctagaaagcgatatgcttattagaaaactttattaatcagagtagagtgctatttggcagccagattctaatgaggatgaggagctaaatttaattcaaagctaaaggtcagcaaatggtgctagcctaccttttttaaagtgtgtgagcttggacgttctcacagtttccggacagtttcatctagaaatgtgcatgctatatttagtatgaaaaagcatggaaaagttttctaataacaccatttcagcacacatatattccatgagcattaataagccaagcacattactgcttggctagacaattcttataggagctgatggcactgagatgttatagcaattgccagccgaaaacaggaggccataagaacatgttacaatggaaagaatttcaaaaacttgtagacgtttctttaaacaatgaactgtctgtggaatatgtgtaaatggcagagtcactctcacaaagtcatgaaggatatatttgtggtgttcagcttatgtccctaggaaagaaaaataggaaaaagaaagttctccaggcagtagatgaaggtggtgttgagcggttttggcccttgcacatggcctccctatccttaaatggcaccatcatttcctcccttctccttcccacttctccttcattgcacactttcttattatcacctcccacaaaaactcatttattgaacacatcctaggtgagggccctgtgccaaagtctacagaagacacaagaatgattaaattcctcctatcacttagccactattgggggactagacaaagactcaaaatgtataaaacctatgaatgatcaccatgccacaaagcagaaggtaagggccataatgtaagtacaaagcactgagggaattccaatgtagaaaagactgctttcctccaggaagggttcatggaatagcctgtgcttaggaaaaaatgcacctgaattcatctatttttctccagcttcgtgaccattacctaggccagtctaccatcacccctcacctgcctttctgcaacaacctctattctgtcttccacagaaaagccagagatgtattctaaaacttttagttagatcatattacttcctggcttaaaatctcctaatgtccactcattttactcagagtcaaatccaaagatctgtccaagtcctgtaaagcccatatgatctcagttttgcctgtctgttcaacctcatcacttgccactttgttccatgagcattaagctccagccatatgcaatttttttttttttttttttttttttgagatggagtcttgctctgtcacccagcctggagtgcactggtgcaatctcagcccactgcaacctctgcctcccaggttcaagcgattctcctgcctcagcctcctgagtagctgggattataggtgccctccaccatgcccagctaattttttgtattttttagtagagatggggtttcaccatgttgaccaggtttttcatgaactcctggcctcagatgatccacccgcctcggcctcccagagtgctgggattataggcatgagccactgtgcccggctgtgtactttctttctcctgcattaattgattacactcattccctcattagggctttggctctagctgttttctccagaatactcttcatggagattcttctggatgattcctacttgtaattcagaccttagattaaaagaaagaggactttcttgactattcaatctaaagtagccacctagtcactgtcttctcatcatattgtattttaagtgactggtggcactgaccacggcttgatatttctcttcattggtttgtgtattgtttcatccccatcctcaccaccagtcaaatgtaaggcccatgtggttaaggaccttatatatcttgtattcctcctatatccccaggacctgtaacagttgattatgaatagtgggtgctcaataaatatttgcaaaatgattgtaagagtcttgaaggatttcacaggtagagagttgttccttagttcatgtggtaggccctgccactggtaaaacagcctgaacaggacctagtagctccgtgctctcaacaccttctgttcttgtggtggaaggcagacatggagaagtgagaattgatagataatgaagttgatacattcagggggtgatcattgctacaaaggaaacaagcaggctaaccaggtagagattgtcttgaagggtctacagataaaactgccagaggaggcacctctgacaagggagaatatgccttgagaacgtggaggcagagtgttttaggtggaagacccaccaatgacagactcctggggctgtgacaagcttaggctatcaaggaacaggggagagtgagaaagaatctctctgtgagcacaggagaagaataggtcagcaaggaggtggagagggaaacaggccagttcagtgacgggagggccatgtagaccctggggaatggtttgagaattaggctaaacgtgatgacaaggcagtggatgtttttaaacaattgatatgatcttaattatattgtttttaaaaggaggggcaagaattactggtggaagaggcagtgtggtcaaaggcatagagcagggtgtgggtgaaactgaggataagtttagggaacgatcagagcttcactggagactggactgcaagtggaaggaaagcaggaggctggggtggtgtcgacaatggaaagagagcaaagaggttattgtcacagggaattccatgagcagagttgcatctttggaaggctaatgtgggaatgtattagaatgaaggagtcaggagcggagagactagctgccatgctgctatgaaccgggctcgtggaagaaggaatgcaggggaggccacagtgctagaggctcatcattacaaccaactgaatgtaagatgcatgggagaaacgaagccaacaataatatcaaataatgtcatagtagagcccagtagtcattgtgcaccaggcactattctaattgctttaaataaaaactcactttgctcctcaaaactaccctacttggttttactctcattatccttatttcagagataaggaggttacacaactactctaagatagggagatggaaagtggcagaaccagaacccaagcaatctggctccagagcctgggctctaatgctgatcattattcccatctctaatgagcacagagaaacaattacgagtccagaaaataggagggaaagaagatttcaatggaaatgtgagaaggttgtttctggacaagttgagtgtaagacattggctcatttcaagttcaagtgtggagcaagggtgagcatggcttttggagctcccatgagatgttgcagctagagaggtgtgtcctcatgcaggcgggctctgttgaggacctgccccatgcgagccactccggggatcatatgttgaatagatggacaagtaaatatatgaaatgcgagggaataggataatcaaagtgctgggagtaaatagtatccccaagagtgaaaatatagacaaggagcctttagactccaaagtttagagaatccttttagagaatagctaaagagacagtgaaagaaacagacaattagattggagcagtaggaaggcaacaaagaagagagacttgccacaagggttgctctgccatatctagtccagcagaggttagggagagttttgctgggcagttttagcagtggtgaaggtacaaaccggattgtcatctgcccaaaagaaagggtggcagatggcaaaaggagacggcagaggattgttttttaaagtttagtgaaaggagaaggaaaagagagagacaggaggcaatagcttgaagggggagggggcggttaggggctactggacagtaatacatcacaaaggacccctagttgctccagagagagaaggaggaacaacatctttggggcctccccaggcgggggtggggggcattgtatatccacacctgtgctgacaagggcagtgggggcctgatttgcatagcagcaggataaaaaccagcctctggcaccactggattcttccctggtagaaactctcccagggtaggcacattagataagagctacttggattaattcggtgacaccatcttttagaatgagggtagaaagtactgacgtcaccatgcggctgattttagagaaacaatctatttctccactgacaaggatttgtggcagtcagcagctgttttatttctttttttttaaagctccctccacccctttcttcagacttctctggacttacatctgtcctcccagctgtgagcggctgaattccagggtgcaaaaccaagggagacaagtaggaggggcatacaaataatgattacatgctgcttcagtgtaaatctcggttcattgtgtgtccatgggcacatgccttcaaattcaagtgcatgcctctctctctgcctttcagtatctgtctgtaaaccttgatgggattaagcatatgttttaataaatattttgtttgctgtattcccattaatattcatagggaatggaacactttgggttttgtgatttctaataaacattgatggtgttgctagtctgtactgagcattcagtatgctccatcaaaatggcagctctaattaggttccttgaattagctaatggattttgagaaagatagcttagaaagctcttacagctgtccaagatattcctgccatggcagaaagacaaaaggcccctggaagctacagacttcagagctttagaaatgcagctgacagttaaaaagataaattacattcatattttgccagtgaaagtcctaatactgaattaatgttattcctgtagtgagtatccattaagcagctcattttattataaggatgcattttgaccattagctctttttctttcctcgctctccctcccctctctcctttttctccctccaattccctagatattttggacacggtattaaaaagcatctttgaagaagaggaaatgattccctttttttcaagttataaatttagaagctctcttagatatacaataggtattcagtttttttaaaaatgccaaagtaaatatataaagaaataacatagtgattcaatttaaaccttgaggcttatattttatgtagaattggaaggggggaagcttctagctagggggcagtgggcttgtttacacttggaaaagagattatttgttagaaactatctcgaataaaacatgttacctcctttcatcttaatatggaatgtacaacataacacaacgccattccacatgttcctcgcctgtacttcctaagaacacagtcctgtaacaaatgaggaactaatgacatctgagtgactacacttaatgctacaaatggggggaaaaataccacggacaatattaaaagttcatggcaaatagcagaattcgggaaacaaggacagtcacccaaaagctccttttattagttggatatgtcagtactcattaattctgtaactgtgttcagcataactttttgctttcagtttattcatttgtaaaactaatacctggtacctttcatctgaaaagttacattcctctaggaacacaacaaatcctctagggaaatgtttcctgggtcattaactctcaaatgtccaaattctgttttcctccgtgagcctctgtagcccctctgcttttccagtcctgcctgccttttggccttttttcttctcattagtgtctttaccaaacaaggggctgggcaaggaaaagaatgtgaaactcgtgtcaattaattggggtattatttacagctctgggaaagcacttgttgggaaagaagctaaagttgttggtttaaatgagatttttttcaaaatcatctgtagtttttatttttcatgctcttccaaacctcctgtttctgcagataattgagagctgactaaaagactgttgctaataaagctgttggaacgaagcaaggaatcagaaagcatagtgttgacggaacatatagattacagatcagacagctgctttacctcagtatgatataaataaaatggaaaagcattgttatgtgaagtgccagaaaaaaagatactcaattattccccacacatgacttcaccatgatgggtaaaaggcataattgacatcatgtttattgaaaaaactagcaactgtcacactgtcgagaggctactgagagctggaggaagggcatttttttattcgttttcactgtgggttatttatagagttcaattgtcagcagcagagtgcctaattttccttcttctttgatattcgacaactcattcactgttcagatcaagaagacagctgcaaattgctccatggcagatactcaggcattgccattacctcgcctgaatggggcaatggctatttattaattaagattctctgcctactttcccttaaagtgccagtgggaaaagtctttgtcaacccataatgggtctagtttcatttgttttgttttgttttgtttcattttaactttttgctgtctgatttggcagccagacccagattcctaatgggaaatttatcattatattgctgatgcatcgtgcttcatcaccagatgatgttactagtcaaacaagagctctggttatggaaaatgatcagttttcaaactgaaagaaagtttcaatgtcccatttcccccatctccagtggccctctggcacgttagccaacaagtagggagattgaaatagagaacttttgccaatgattttatcaaccatttagcctgcactgtatgcacacacaagaaatcatcaaatctaagtacaagaaaagctcagagaggtcagctagttccttccataggttgtgatatatggggttacagagagctagcgtctcccagagttctcttgatatgaagcagaactctgaggatggtggtgctggccctacttgcaattcttcagtgggtctgcatcatcccctttagaaagattggtggatggggctgttaaggtcctaccagctgtatttcccagtttctccacacattccccacacttgtgcggtgcctgactgtgtgccctttcatgtggccactccatttcaagtggtgttccttccagctggcatgcccagccaccctctctttatccttgtctcttctctaataggcctttcctgacctccccaagccaagttaacaccctctgctctgagctactgctggagttcatcatacttcatgatacttcctcttaataattgccacattgcactgtcattatttatttatatctgtgtctccccaactagactgtgaaatccctgagggtcaagtcggggtcttaatcacctttgcatccctaaggccacagcaatatttatgaataagtaaagcttaaataaatgtacacatcagaaatttttcagagggttattggagagcttttgaaagcacttgaggatttaggtctgctaccagtttattattttctattctgttttgaagagaaagccagcattcccctagcaaggatttataagaatctgagcatgttttaaaaacaactgaaacaatccataggagatggtaatgtcagctgtctgctattctgtacacccctaatgttggaaggtcagtagaaggccctagggttagcagagctcactttgcatctaggctaatgagagctgtgggatcttcttggattgaatgccctttgggagctaagtagatgctaacttttgatgcaatctgcatcagtccattctagcactaatatgaagaaatacctgaggctgggtaatgtataaacagaagaggtcgagttggctcacggttccacgggctgtacgggaaacatggcagcatctgcctctggggaggcctcagggagcttttacttagaggggaaggcaaaggggaagcaggcacatcttatgcgtctggagcaggaggaagagagtgggttgggtgggtgaaggtaggggaggaaaggcgctacacacttaaacaaccagatctcataataactcagtcactggcacaagaacagtaccaaggggatggtcctaaaccatgatccaatcacctcccaccaggccccacctccagcattggggattacgattcaacatgagatttgagtggggacacagagacaaaccgtaccacgagttgagaatctatttggattaattgttatgaccttattcaaaaatctcagagtagcatatggacgtaaaaggaatgaaaagaatgtaggtgatatcagaacatgttcataaattcttggacctagacctaattgctttatgctaatcatattagaatactgcgtatataattctgtgtttattacatagcacgatttaacaccatatgtgatcattaagattggcctcatggtcacttacctatgtgacccaagcatcccttctgggcatttggagaatgtatatcctttaacagtagaaaagtaaggactcgttcacttgtcacatatatttagaacactttgactcttaacaccgagggtcgagctcctaatcacaatctttagcttctttcaattgaaaaatgttttctccttttttaaaacactcttttcctttgtcactgttattattttcccaataccctccattggggaagaaaaacaaaagcattgttgtgtaagtaagaaactgctgtattaatctactgacgttttgttatatttttcacttttcactatgcactatcctgactgttctcttctaactgacataatcctctaaattaaaaaaaaatacaagctaccatccgtgcactaaattatttagagtgtccttatttttccttaaaattgtgtggtccattaaaacttactttcttattatctgtaaggaaaggttaggtacccagctgttgggaatcagtggcctttgatggtattccaggatctcttgggagaagagagaacttctatgttgtgtcctctgaggaagaaggaatgtcatggaggcctaggaaattcccaaggtttcatggcctgcagcccacaaaggcttatttttcccagaattgaccctgaaagtttaatccccatataaatgtcagatatgtattcttaaaactcaactgtgtttgatttaagcctaaaagataataattttatctttgcagttcctgcagttgttggtgagaatttctttgagaaggcgtgagtgtgtgcgtattagtgttatcattaatttgttcaagtaccatctaaacaacattttatttctccttaaactgtcttttgttcagttcaagaaggtgaacgataattaaaataatacaagttttgtaggtttcctctatttacctttttaatcaatattttgctaattttgttttggaccgtcgagtcctttgagaaaacctatagtattccaagtggagtcatgtcttaaacaaggttagtttctaaagtcattacatgagacaaaaattgtgtattgacaaaattaatcttgggaaacactttaggacagtggtccccaacctttttggcaccagggactggtttcctggaagacaatttttccacagggcggggggtgttgggggttggggaacacagggccaggcactagattctcataaggaccatgcaacctacatcccttgcatgcgtggttcaccatagggttcgtgctcctataagaatctaatgcagccactgatctgacaggaggcagagctcaggcagtaatgctcacctgtgtaagctcaccggtttctaataggccatggactggtaccagtttatggcctgggggttggtgacctctgctttaggaggatactatattggactctgcctatgatctctcactgaacccactcactgctgtttctttagcactgcattagatggctcttcccttggttgagcatcagctgaagtagttggcttgcatatacaaggccatgttgtacaagtaatatacatccttaaacgctgaaatgatgttcagcacagcataaaacttacattaggaaaggtgcctaggaactgacactgaccaaaggaaatcaactcagttcatgttcagggacatatgttcgttaaatggaatgtccaatggaatcactatcactacttaaattgctattctgcccccaagcctctgtttgtgtctaagctcagatatttggtgtatcaattaaatgcagctgggatgcagtatcactatactccagccatgttagaacagctatatctatatgaattataatatagactatggcttatttatcattttttaacagaagacacaatggatgcacagttgcaaattgatccaaatctatttttctttgcatgtatgtatgcttgttttgcaaagatgtagagtagaaagaaagggataatattgctgccatccagtgtgaacttttcaactatattttaaaatctttcttttttaagaaaccaaaattatcgtattaaacacttgataagtttcttctgtgacacccacatactgtatgttgttaataaaattgacaaaatgccttgagacaatatgtatcacacacttacacataactttgaagtgtccagtatttgtgtaaattacttaaggctcaaaaatattgcactgggggctgggtgcagtggcttacagtggctcacacctataatcccagtgctttaggaggccgagacaggaggatagcttgagctcaggagttcgaggttacaatcagctattatcacaccatgtactccagcctgggcaacagtataagactctgcctctaaatatacatatatatgtgtgtatatatatatacgtatatatatatacacacatatatatggcatatatatgtatatatatacatatatatacacacacacacatatatatggcactgtgttggaagaactgtattagaatactattcaaaatataaataactcaaatgggtattttatgactgatggcaaaactgacttctaaaatttgaacacagtcaggaggtcattgtacagtattagaataaggcagttatttgttactggcttattatggtgaactgaagccataaataataactggcatgttgttgaattttgagttacactgtcggggtcactcctaaggtatttctccctttgtgagaaatggagatacagaagcagaatgttctgattagaagccagccttgcattgccccaagtgataaagagcaaaggtagagcaatgccttttatcagaagaggagatgacattgatctggtgacgattctcagtcacaacaatcaatcacataggaggaagttgccttcgtgaatcaatggattactttcagtggtaaatggtagctgtggttcatggtgtgtgtgaaagagcttaccatttcaaaattgccaagggaagtgggcctttatttcttttttatatatatatactttaagttttagggtacatgtgcacaacgtgcaggttagttacatatgtatacatgtgccatgttcgtgtgctgcacccgttaactcgtcatttaacattaggtgtatctcctaatgctatccctccccactccccccaccccacaacaggccccagtgtgtgatgttccccttcctgtgtccatgtgttctcattgttcaattcccacctatgagcgagaacgtgcggtgtttagttttctgtcctggcaatagtttgctgagaattatggtttccagcttcatccatgtccctacaaaggacatgaattcatcattttttatggctgcatagtattctgtggtgtatatgtgccacattttcttaatccagtctatcattgttggacatttggcttggttccaagtctttgctattgtgaagtgctgtaataaacatacgtgtgcatgtgtctttatagcagcatgatttataatccttcaggtatatacccagtaatgggatggctgggtcaaatggtatttctagttctagatccctgaggaatcgccacactgacttccacaatgcttgaactagtttacagtcccaccaacagtataaaagtgttcctatttctccacatcctctccagcacctgttgtttcctgactttttagtgatcgccattctaactggtgtgagatggtatctcattgtggtttttgatttgcatttctctgatggccagtgatgatgaccattttttcatgtgtcttttggctgaataaatgtcttttgagaagtgtctgttcatatccttcgcccactttttgatggggttgtttttttcttgtaaatgtgttggagttcattgtagattctggatattagacctttgtcagatgagtagattgcaaaaatttcctcccattctgtaggttgcctgttcactctgatggtagtttcttttgctgtgcagaagctctttagtttaattagatcccatttgtcaatgttggcttttgttgccattgcttttggtgttttagacatgaagtccttgcccctgcctatgtcctgaatggtattgcctaggttttcttctagggtttctatggttttaagtcttaacatttaagtctttaatccatcttgaattaatttttgtataaggtgtaaggaagggatccagtttcagctttctccatatggctagccagttttcccagcaccatttattaaatagggaattgtttccccatttcttgtttttgtcaggtttgtgaaagatcagatggttgtagatatgcagcattatttctgagggttctgttctgttctattggtctatatctctgttttggtaccagtaccatactgttttgtttactgtagccttgtagcatagtttgaagtcaggtagtgtgatgcctccagctttgttctttttgcttaggattgacttggcaatgcgggctcttttttggttccggcctttgtttctttatgctccaccactatggcttgattcattgggtcaaggtccagcccagggttaagatttccaagacaagtcttcgagctataggagtcaaaggatcagtttaccaagctagggatggaaatactaagacaaggatctcaaaggaggcagatgctgaaagcaggacacatattgagaaagacaaaaggtcagcctcaggttgccatggtgaggtcgggagcccagataagccaagccaagttgtcagattgttgcatccaggtcaaaatgccacaggcagcatcaggatggctggggggaggaccgcagttcaggattatagtctgagctgatgtattattgtgattttcaggtttcctctaccttatgaccctaacttgcatgttaacctctctggaccagtttctcaggttgcccacaggatcctgacataaggatgagtaattttgttgaacccttgaaaattcatgcaaagacacacttttcaaagttttatgttagtgtagagcatagtttttcatcagattctgctgccgttttatgtgacattaaatactctcttaagatgctgaagcattgtttcctcacctactaagaggtatcatgtcagagataatggacagaagaagcccttagaaataaaagcagattttacatttggaaggtttgtgttgtctgtttaatattattcaccctttccctaaattcattattcttaacatagaatattataggcaattatagtaaacaaagaccccttaatttagagtagagtaattgttttaatcaacaagataacttaaatctggtagaaattaaatgtccatataagctaagacatagtcttgttatttggggggaatcttttggcaaaaataatttgaaatgggggctaccttcattaatagtgacagtaaatttgggaagaaattagaaagaagtatccccaaagttgtccatggatagtcagctatcagtcctaaaatttcaccgggctaaacagtgaaaaatcttatttgtcaatgcacctttgaaaaaaatagagatgctttataagaaatgggaaacggggaaaatagaggatttacacaatcataactttacctggatatttacactggataattttcagagctgttctagacttaaatgtcatttgaagaatgctatggaattaagttccttaaaaagcaattatttattattaaattagtatatatgggcacactatataaatgtattttcattatgagatgttaaatctggagagtatgagtgtaagtggtgttgggggtgtagtttctttaaatcttaaatgctcttcaattaagaatcctaaatgcatgtacaagagtctctcaaagttttatttgacagaaatctttattaccaactgaaaataaataatacttatgtccatgactatctgtcttcagctgaatattcttttccagaatcttttcttgggatttgagaaaaattagcaaaataagcgtgcatatagcctgtttaattatattatagttatgttattgagagtgtgaatgccatagaatctcaggtgttttagaagttctgttcccactatggaaaaaaaaatctgccctgttttctaagacagaactatggtactgttaagttttaagtttaaaaataaagctgggatgatttttagcttcttacatgccaaaagacaaaaacaaagaacactccccctgtggaagaagtcaggaaaataatagtatcttggcgttcttaaagggtaccaaggtgtttttctttattccatgtctttaaaccctttttgagaaaaccattgaaattccacccttttgtgagtatacaaaaattaacaccatacttacataattaacaatcttaaaggaagcatcaaaataacattttatagtaacttcataaaaaattaaagactctgtaaaacactaaactcaaaaacactccctatcctactcactgttgttgacacgcatacatccaatttaaagggttttattcagagagttcgtaaggattatcacctccagataggaatattcctgttaaagttacaggctataaaagccatttcttttcatttatgtatgtatttatttatttatttatttatttatttatttatttatttatttatttttgaggcagagtcttgctctgttgcccagcctggagtacagtggcatgatctcagctcactgcaacctctgcctcctgagttcaagtgattatcctgcctcagcctccctagtagctgggattacaggtgcatgccaccataccagctaatttttttttgtatttttagtagagatggggtttcaccatgttggccaggctagtctcgaactcctgacctcaggtgatctgcccacctcagcctcccaagtgctgggattacaggcgtgagccacctcacctgaccttataaagaccatttcttaactgcatcatcaaatctggacaccaggctggtacccacaaataagggcagtgctcaccaaaggccaacacctctccttccaaatgaagagctacatcttgaggctgtatgaaaacaacacgaaaacagaaacagctgtttgaaatcaactatatacaactgaatcctggttaggatgcatatatttacatagatgcccacttatacatatgtaatcacagataattcccaggtcccacagtggccagggtttggtggtagtgaccacctccctctcattcagttagtggtgaacttccccagcagttctgtctgcctctcaatcctggtcctgatccagaatgtgtctttcatgtaggatctttgtcatatgttgattctcctttgcaccccattccgttttataccagctctctacataagcctgttagagatataatattaattgcccagaaatctcagcctgcagtggctccaacatcattttttaatgaatacggacttcattgcatgtatttctattactttggttacttctatttttattgcaaagatctgtgcaaataaaagaatatcaaaaggtacggctataaatgtgctctgctaaattccctctgccttgaaatgcctgtgaaccgcagccacagaatgcctgctgcattttaatgcctttcttgcgaggcaacatgatatagtagaaacagcgctggttgggagtcacacaaatcctggcccaccattcaccagttgtgttccttaacgtctctgagcctcagtgtgctcgtgtgtaaaatgtcaacaacaatgtcatcttcacagatttgactgaggcttaaatgagatgaggtatgtaaagcacaaatgttgtctttaggacatcataggagcttgataaatgttaatttttttcagcctgcagcagtcataggaggagatgaaggcatgcacagatgaacactcattttaaaaagtactacagttgaggtcatttttaaggctagattccaaatgccttagtgtgatgtttatgacatgtgggaatttgttgctgtaggtggccatgaagaaaatgacatggtttctgaaatccattacaactttaagctctgtccagctctaaagtgttataagaaagggcctgtttaatgatacatctgcctttaaaggcataagcaatgtaatttatttttaaaatcattacaatatacatcatgttattatactgcttgaattaatttcacataaaattccagcacatcgaaagtgtaagactgtcattgatcacctatatagggatacagctgtaatagaaactttttgtaaggatggccagggctttacttcattcagtgaataaataattaggaaagcctaattgttaaactaacaatgtggagatgaggttattgacacttttactagttttatatggtttcaatagtatttgaattacatcatgatctgatgtcacttctgaagctatttctagaatcagtgctgctaaattccatgaagcaaggaatatagaacaaacgacatataaatagggaaggaaaatgggaatcctcagaaagtaaatcctgtaggctagccttcacttccattcttgttcagtatcttgctagaggacccagtctctaaaacataaaatgagatgaaggaagggaagtaggttggaaggcagtaagccatagtggaagagcagtctttgaaatgagaaaacacttgttaatcatctatttgctaggagcttcatattcttcatctttattgagcagaataataaatccatcagtattttttgaggttttaagatattgacagcacctgtcacacaggaattgtaaataaactcatgtacaattcctatagattagtagtggctttctgaggttctaggctaaaagaattctgagaattctttcccaattacagcattgagaaagaatgctctaattgattcgtgatgtctgctgtggacagagagtggagtaagtaaaagtatatatagatatatttgctatataagtgttcaataaattataaccattatgatgattgccactatcacaaaggtgtatgtccctctaaaatttgctaagtttctacatcttcagtgcaatatggaatcaattaattgctttggttataatagtggcgtatattatttttattaatttggtggtaagcatatgtgtattatctgctgagaagagctacaaatcagaaattggaatttgctgtccctaatcttaccaccttaaatacctatttaggaaaagtctgataccatttctaaaagtagaatgagggttgagaggaaaaaagaagagatgatattgagacatcgtcccaggttaccacaaaaggtttgcacagtgttccatatttttaaaaaatattcacacaagggagaagatacagcatgttttgcacttagatggtccatgactttctgggctgttttcctgttttttctcttgggccagatttcttttctgggtaaatagccatgctcctgtcagccacaggggactttctgaatcctgaacagctgattttgtattcctgccccattcccttatttgagaacagcaatctgatcaaacccatatttttaaatttatgcatttataggcatatggaagaatagtttacagtctcagtacaattttttttttccaccacaaatggaagaaaagtgtgttcttagaaaacagtgctttatcagtttcttttttttttttctttattactgatgacttcattctacttgaattcaaggcttcagtttctttggggtaaactaatagattatgtatgcgatgtttgcaccatgttgattgaactcatctggtgagtttgaacgcagctcatgaatttccgtaatcgacagaagcctgtgcgttggatacagacaccatggtcatctcgtattactcaagagctagggaagctgttgaaaatagactgtgctgcttttcctgcctgcccatggttcagaaaagcttatcaagacttttaatttgttcttactatctttttcaagtgctcaaagaaaactttttttaagtatagtaaagaaagagaattagaactattatgagagtttcaacatacatattgaaaaaaaaaaaaaaaagaaagaaaggtacgtgattcccaagggtttgtcttttctgaaccaaaggcatcagctgctgagtgtctgtcgagcacccaggaagcccagaaccctgtgcgaactgtcagggagcagccacaagacagaggtacatcatccagtttgcaattaacttaccatctagtttgagaagaatgcttttcctccaaaaggtgtttactcaccattttttttttttttttttttgtaatttacaaacacagttgtaaaatattttttaaaaatagatgacctctttctgttgcttttaggtacctcatattatcagatatctcatttaaacttggaacccaactgtaatatttggggttctttttgacatgcaaagctcttcacgctggggctctacctacctttccaagcctcacttgtccctcttctctttgatcctcctatatttctttaaaatactcacacaagagagaagatacagcatgttttacacttagttcatgactttctggacttttttcctgtgtttattccccaaatgctacagtagtgatcctcacatacccgtgaaacataagtgtcatgattgataagatgttatcaattgagttaaagtaccaaaatttgtaagtgatatgcttctgtcattattagagtaaattcaaaatacccccaaactatggctgggtgtaatggctcatgcctgtaatcctagcactttgggaggccaaggcaggcagatcacttgaggtcaggagtactagaccagcctggccaacatggtgaaacctcgtctctactaaacacacacacacacacacacacacacacaaagaatttgctgggcgtggtggcaggcgcctgtaatctcagctattttggatgctgagacaggagaatcgcttgaacgcaggaggcagaggttgcagtgagccaagatcgcaccactgcactctaccctgggtgacagagtaagactctgactaaaaaaaaaaaaaaaaaaacaggccaggcgtggtggctcacgcctgtaatcccagtactttgggaggccgaggcgagtggatcacctgaggtcaggagttcaagaccagccagatcaatgtggtgaaatcctgtctctactaaaaatacaaaaattagccaggtgtggtggtatgcacctgtagtcctagctactggagaggctgagacaggagaattgcttgaacctaggaggcagagggtgcagtgagccaagatagtgccatagcactccagcctgggctacagagcaagactccatctcaaaaaaaaaaaagaactttaaagtcaccagaactcacttttattcgaatttgctttgtaaatgagagtggaaagggaacatacaccatacacctggtatgtgtgtaaggcaggacaaaagaagttgaggaccagtgcttaaccaaagtgatcgacttgcatgtctctaaagcaagatgctttctcattgctttactttgcactcactgcccttccctctacctggaatatcctcctctcacttgtctagctgttgagcacctttgtatccttcagggctcagctgaagtgtcacctcctccatggagccttctgtgattttcttcaatggccctgctctcaccttgtcaaagtttaagcactctgcgttcccatgaccccatgcaaatctctgtaagagcacaagtcataatggactgtagtcttctgtatccctctctgtcccctacctcccagactatttgtttttgcaggtaaggactgtgaagtgttcctttttccattcccagattttaacgtctggtgcaatggggcactcagttatgcctcaaatgaaccagataagtagaatggctgttcagatctgcctgtcattcttttgctccctagccctgtataatatcatgtgatactggttccactaaaataactacaataacctaatctaagctacaagggaggtgctagctgagcagtttggggttgggcagatgagttactggaaaagctataattcataagaggaaatactggctaaagtacagagagaagaacttggattagcacgttctactctacaccagcttcccccaccttaaaaaaaaaaaaaaactttcttactgttttgttttgtttttttactgtcaccttttttacacgtgtcctaactgtacccatatattgacatgtatcccatccccaacccccactcccaaagttcatgagcctcatggaaatgaatgctaacatattccagccctgtctcatatccagccttcaggtcaaacaactggagctttgtcccaaattagcaatacttattgagaaaatgagatatccatattaaaatgtgacaaaactctgtgtgtgtgattataagaaaaaagtggtgggccttttaattgctctaaaaggtaaagactctatcttaccttctcattcaaaaggcatttattcatcccaagtcagacatttgacccttggaactaaaggtaggcacgtaaagaccactttttgttcatatttatgactgatttcaccattttcctggcatatttgaattacattattgaatcttccaaatttagatgtcaactcctttaacaagaagatccaaaagtgatttcaaagatgatgtacactgtgtgaatctgattatttgtctatatcctgtagtggccgtcctacgggtggaagcactgaccgtatccagaagttgcggaaagagtattatcaggctcggagggaaggtttccctttatatgaagacgacgaaggaagagcaaggccatctgagtatgacctactctgggtaagcgcatgcatgatttcaatcgttgaattcatcttttctaagaatgtttagagcagaagaacacggtcaagaatgttctgtacataccagattctatttaggtttcttgggcttcatagacaggaacattacccaaaccacaggcatattctcccacagaagctgtttatggaaatcaaacgccgtgaacgtgcagtagttcattctgattgctctcatacttcctgttatatgccaactggtttgggggaagcagaagttagctactttaaagagggcaagggatctttgtcaccatccactgagctttgattcttgcaacacaagccatctctcctttggaaaatggtgattagaagtaaatttcaaaagggttattgtcagagatgtcagttgtttgtttattggatctgagcacttcacattctgctgatcttaccggcatactaggatggatttgttttgagataagggcagtttttgtattagaggattctttttgctcaatcctttgacattcagggaacagaaaagaatacagtgaccactgaagaaaaactcattgggttttttcagagtggcacgattcactctcttgttttcaagaagcaagtctgtgcctacaagatgtacttaactcttcagcatctacaaaaatgcccaggaagaggatgcttagaattgcatgaaatgtgcatgcacatcagatacatagaacagtggctgacatagagctggtgctcagtaattgttagttcttgttactggcattattatcagagcagagctgaacatggtaatagcagtgtccttgctggggttcagttctcactcaccctctaatgatttctgccttctactgcgccttttagagctgctctgagaaccaggtaggggactctgttatccccggtgcccatgaaagacaccggctcctttgaaaggcagatctgttaaggcaggtttcctttcctgagtttcacactcaggtttatgctcataaggtcagagtggggagaatagagtctggcgactgagctgattccctctagttcttacatctgtgtggggggcctgtcatgcgttcatctctacactggggtgtgaaaatcagtttcaggatccaccactgttgggcagagcaaccggaactgctgagcccagaagattgcacctgtataatggagttccaaaacactaatcagaagtgcacagtgcagatgggcgatctcaaggccaagtggcttcagcctctttggagagaggcagcctgagactatggatcggaacaaacagctatttattggtcttattatagatgttaggattaaacagaatgacacctagagtgatgggaaaacttgtctcttagcttctctgtagcagaagagaaagatttccacagaataacagattagataacaattcactcagtttcaaacttgatcgagatcgatttactgcctctgacaagagatgtgagctacttgttaggtaaggctcagctccctcgataagccaaacaagcaataaaataaaggaaagtcatttccactgtacccaaaacagaacaccgtgtccagcgcattgaaaagtgctctatctcaaaacctctatgaattcctatgagcaaaataagacaaataattttagacaaagtagtcctggttgttttgaccttattttatatgatttccttacatcaagctgaaaggatgaaggtgcttaactttcaagagacttgaagtttcctctgaccctcaccaaacctgagctagataactatacccttgggtgctcccttttttaatgattctatttttatgccaagtaaacgtgtaaccagaccatctagtgagtaaagaagtatctctagtttaatttgtgtttcccatgctccggtgtgttgagctctgccaaaagtgactgattttatgtttcccagacaatcggggtctgaggcttcccaaagggatgcttgggaaatgcactgccgtaaaacacgagtgttctttgtgactgcctgagatactccaagccagggattagaatctcagcatcctttcctctcctctccccacgccaaggaaaaacactagtgttttgtattaaggcaggtttcctttcctgagtgtcttttgttcagcgtaggcctgagaaattacactgttgtcttgccacttttggagagatctaggaaagcaagttaagaaagttaacatttcattcctgtcaagcggccagacccaacaaggcagcttttatgagactgtggttcctagaaaggcaggtctttagcatcatcaccagggcactagctaaaatcagatcacagtcgcgtgaaggggaagaatgggcccaggagagaccctcaagggatgcgccacgtggtcatcaaggattctgatccacaattctgaaaataggacattgacttcaatcccttgagtaaacacgaaagcggtccaacttctctagcaaaaccactgtggaccagcatcatcagaaatattgttatgaacttagaactcccccaagtccagagtctctggttgaaaggcccgatgagtgttttctggagtcattctatactggggaacttctgaactatggagaaggaaattacaaagataagttacctaacaactactcgtaaacccatttcaaaataggctagcaagaatgaaagtatgctcactgaagtcttcaaagccaaaataatgagaataatcacttgaaagtttattagggtctatgaatattttaaaatatatatataaatatatatgactaatactttttctttggctggccctggactttctagatcttctcagaccaacttgtatgtagttctctaccactattgcacctgcccagtggcctgaagtctaagctttctcttactcctccctagggttctcacttggtttcatgcctgtcttctctcccctctcccttatcccctcccctctcccctctcccctctcccctctctcttctctcttccctcttccctcttcccctctcccctttttcctcccttctcctctcccctgactcctattacattttaacaaatatttgctaaatcttagtgtagaccaggtgctgataacaagaatatgacattacttccaccttggaggaactcaggatccagccaggaatagatctaagcccaaacaaaatggaacaataatatatgtgataaatgctgtagtatagagaggtattagcttctatatgtactgagagagagtagttcattctgctggaggtgcatagttggagacagagtgctaggaaaactatagagacattttgggagttgcctcagctgacatactttgttctttttttttttcatactttgttcttttattctcaaatttgttggatttttttccccttttgcaaaagatctcctgatttattcgctttgttttaaaataaatgaatacttctgagggctctgttctgttccattggtctatatctctgttttggtaccagtaccatgctgttttggttactgtagccttgtagtatagtttgaagtcaggtagcatgatgcctccagctttgttcttttgtcttaggattgacttggcaatgcgggctcttttttggttccatatgaactttaaagtagtttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatctcttgtaagttggattcctaggtattttattctctttgaagcaattgtgaatgggagttcactcatgatttggctctctgtttgtctgttattggtgtataagaatgcttgtgatttttgcacattgattttatatcctgagactttgctgaagttgcctatcagcttaagaagattttgggctgaaacgatgccacatatctacaaccatctgatctttcacaaacctaacaaaaacaagaaatggggaaataattccctatttaataaatggtgctgggaaaactggccagccatatggagaaggctgaaaatggatcccttccttacaccttatacaaaaattaattcaagatggattaaagacttaaatgttagtcctaaaaccataaaaaccctagaagaaaacctaggcaataccattcaggacataggcaggggcaaggacttcatgtctaaaacaccaaaagcaatggcaacaaaagccaacattgacaaatgggatctaattaaactaaagagcttctgcacagcaaaagaaactaccatcagagtgaacaggcaacctacagaatgggagaaaatttttgcaatctactcatctgacaaagagctaatatccagaatctacaatgaactccaacacatttacaagaaaaaaacaaccccatcaaaaagtgggtgaaggatatgaacagacacttctcaaaagaagacatttatgcagccaaaagacacatgaaaaaatggtcatcatcacttgccatcagagaaatgccaatcaaaaccacaatgagatgccatctcacaccagttagaatggcgatcattaaaaagtcaggaaacaacaggtgctggaaaggatgtggagaaataggaacacttttacactgttggtgggactgtaaaccagttcaagcattgtggaagtcagtgtggcgattcctcagggatctagaactagaaataccatttgacccagccatcccattactgggtatatacccaaaggattataaatcatgctgctataaagacacatgcacgcgtatgtttattgtggcactattcacaatagcaaagacttggaaccaagccaaatgtccaacaatgatagactggattaagaaaatgtggcacatatacaccatggaaaactatgcagccataaaaaatgatgagttcatgtcgtttgtagggacatggatgaagctggaaaccatcattctcagcaaactatcgcaaggacagaaaaccaaacaccgcatgttctcacccgtaggtgggaattgaacaatgagaacacatggacacaggaaggggaacatgacacactggggcctgttgtggggtggggggagtggggagggatagcattaggagatatacctaatgttaaatgacgagttgctgggtgcagcacacgaacatggcacatgtatacatatgtaacaaacctgcacgctgtgcacgtgtaccctaaaacttaaataataaaaaaataaaataaaataaaataaatgaatacacacacactgtaaggtttgtaaatatggacttgagaccttaaaatcttttcagctgttctgttgtgtaactgttttcccgtcttagctctgaaaagctgtaaagaacaagttgaaagaacttcagtggctgcaagtaaaacagtctggtgagtttttataggcccaattaagtaagcaagatatactagctgtgaagtgttaatatttgccagaggaaaacataatacctgttatctgctggtattttattttttgtaaaacttaagatagtcctctgacaacgggctgcttttttcttagcagataaagctgatctgcttatttaacagcagcatgaatatcctgtaaataattttagcaatgagatgcctctgaagttttctaaaaatattagtgcctttattattgtctttttcaagagctgaatagcagtatcattatccccccgcccaacctttttaaaaaaaaattctttggctaaattagaagaaagtttatttataaaagaggtttgtagacacatggttgggaagggagtacatttgtttatatatggaaaaaaaagtgggagttaaaacatcttaaactagcatgatatacctgttaccactgtcattaaaaacatggtgctggccgggcacagtggctcacgcctgtaaccccagcactttgggaggctgaggaaggtggatcatgaggtcaagagattgagactaacctggccaacatggtgaaaccctgtctttactaaaaatacaaaaattagctgggcatggtggtgcacacctgtagtcccagctacttgggaggctgaggcaggaaaatcacttgaacccgggaggcggaagttgcagtgagctgagatcgcaccactgccctctagcctggtgacagagtgagactctgtctcaaaaaaaacaaaaacaaaaacaaaaattgtgctatatctctctggcacaggggttggctcaggtagatcatagttggaacaatgagatggttgggtgaataaatgtaaacatctgaaagatttgttcattctgttgtgaagatggtctagaagccaacttgaagaaacgtacttggccgctgatctggatgacaagagacaaatctggtgaattccacacttggaggaaagagaaaacacaatgctgagatcatgctaaccatcttaaggaaaggatttaagatggaatgtgcaatagccaaagaagtataaaagccatcagaaggtttttcataaacaccaggagaaaagaggacaagtgccatcaatggtccaataccagagtggagatttctatgtattttccttgtctcctccttaaaagcatctgataaaaactaagtacattgatgaacaattctggtttaggcaatagctcttatattccaaagaacagagacctaaatcaaactgacctgattcataaaggaaattttgttgacttatttaaaagaagtccataaccatatcttgacttcaggcaaagctggatccaactcctccagacaggccattaggagtctcttttttcatctgtcagctttgctattctctctgcaggcaccattctcaaggggctacctgaggtagaaagacagccatctgcagctctaacacaacaactctgaaggaggagatagtctctctgtagatcaggaaacatcctggagtggatgttcagcacaattctcagtagcgctgattgattcagcctggatcacgtgtccacttctgaaccaaccttcatggccagacaggtgcagtattttttttttttttttttttttttttttttttttttgagacagagtcttgctctgtcacgcaggctggagtgcagtggcacgatctctgctcactgcaagctccacctccggggttcacggcattctcctgcctcagcctcccaagtaactgggactacaggcacccaccaccacgcccggctaattttttgtatttttagtagagacggggtttcaccgtgttagccagaatggtctcgatctcctgacctcgtgatctgcctgcctcggcctcccaaagtgctgggattacaggcttgagccaccgcacccggccacaatattcttatagactaaaactaggccacaagaccacccctggaactagacagtgaagtcaagtccacccagactccataaataaggataggtgaagagagagtcctcaaaggaaaatcaaggtgctgttaacagggaaagagaatgtagatggtaggcacaattacaaactgtctacgacaacttcgagttctaataatgatataaactttcttcatcttcttagatttccagggaaagagaaagaaaagccttccctttgtgtattctcctgtttatcgttagaaagaatagatctattatcaaacttaaatttgctgccattatttgttatgtaaaaggagaaagaaaattcactttgtctattggttcagcatctttgaactatcccaggaacccagatgatgtcactgaattattcatgagaaattatcagacctctggaatttatttatataggcaaatgacattttagttcacctcggacctagcaattcaccccagaacgatctgagtacagattgtctcagcaatactctggggacaaatctgatccataaaggttgtagggatagtgaaagaggagggaacaattcaccccaggagaagcagtagaattatttgaaaggactaaagttgctctctttctttacatagagttgctctgtttatatcttcatggattattgtcttgtgacaagcacatagtctgttcttaaaacctttagaaggtgagatggggtaaagaattagagccattaaatgtttgtatccaggccaggaggggtggcccatgcttgtaatttcagcactttgggaggccgagatgagaggatcacttgagcccaagagttggagaccagcctgggcaacatagtcaaacctttctctatgaaaaataccaaaattatgggggtgtggtggcatgcatctgtggtcccagctacatgagaggctgagacaggaggactgcttgagtccaggaggtcaaggctgcagagagccataatcatgccactgcattccagctcgggcaacagagcaagaccctttctccaagaaaaaaaaaaaaaaaaaagtatgtgtccatagactcctgcagttgggctgctgccacacgatgggcaatcccttctcagttgatgaaccttcttgagctctatcccaatggttccctcccagtggctgactttatcaacacatcttttgatttccaaaaacagtggaactgaggattggaagcaataccaaggcagagaaaaaaagagagaaaaaaccatgtctatacattgcgtgggttttagaaaggcctgaagttttattgaacttgatactggtgaaacatcaatgccactggaagagttgagattttgctcacttagatttcagcaagtagtaaaacaaaaagaaaaaaaattgagaaaagaagaggacaaaataaactgaatttttttttttttttggttagtggctttggcccttttatatttcagtgtgtctttcacaggaatttgttgacatataagctatatgggagaagatctggactatacaacatgtgagtgaatttctagcctttaaatatagcataaatcatttttgaaaggaagcaacatgtttacaggcagtccccaacatagaaataaactgttccagaagtccatttagaagctggcaatttagaactaggaattgatttttcccatagggaaaaaatatatatatattgtttgttaggatcccaaaccagcctacaaaaacccactaaaatccagtaaccttgtgctaatcccagaacaataaccttgaagcagaaacagggagctatctaaccccctcccttcttttctggacacatttttttgggatactctctgggcccttcccatctaccggtctttaagtctgttgctccagattccctgaccattaattcccctacctccgcatcatggcaccccacttaagcccactcctcccctaaagcattcaggcattcagttacttctctgccctgtccctcaacagagttaccattctcagtacagatagtctcagcaatactctgggggacaaatctgatccataaaggttgtagggatagtgaaggaggagggaacaggagaggggctaatggaatgtactcccaaacagtagtgttagagctattcctgatgctctgttgctactacactagcctctggattctccagcgcttctgtttccacgtatggagcccaagcttacacagagctccctgtctgacactgcctgtgggcagtgacctgatcccaagagtggatccgatttctccagcaaactggccctttctccaaaggaagccttttgtttctgggtctgccctctgtggcccaagggccagtcgctacaactaacatgggccaggatgcctcagctctgcttaaaaatctgccctgataagatagctcttctaaactactcctgtccactcatcctgtcttttgaaacacacagatgtccagagttttagaactagtaatttagcagatatgggaagcattttagcacaggagactctgaagctaggctgcctgagttcacatccaggctgtacccattactcactaggtaaatttgggcaatttattttacctgtctcctttaaaagtgagagaatagtactgtctccttgaagtactatgacacacacatgattacatgtaaagtacttagaatagtgtctaaacatgtaggaagtgtcaataaacaagaatttttaaatggtacacatatcaagttttgaaataacacattcaattggccagacaacccttctatcttagttattattggagctccttagcctcttcggttattccagagcccttggacattatatagcacacaaagccttgagggtggccttcacatcctgctccctctggttaccactgagatgcccagggtcacttcaggtggtaactgtcaagcttggtcatcaggcacttttagcaaattccattggtccaaaggtcaatatctatttccctctctcccacacacatacttttccttcaaaagtacattcctttcatccctgaccctgggggcacacctaatctctttaatgagcttatgctaaaatcaaagaccagaagaaagttgacttctagcagcttctgcctgcagctctgcaaaaaaccctgaagcaaagaaataccagggtccagttaagcgcttaaaataggagggtgagatacaaagagaatatatacaaattatttactcaataaattatactacaaccagatcgttaataaaaatggcatcatttactcagtgctgactctgccttatataagctattccatatactagctctgtgaggtagatatctttaatccagttttatagatgagaaaacaaaggttccaagaccttgcctcatggccacacaatcattagcaaagctgatttccaaatctctactgactcccggtgaaaagagaaaggaaagctcctatggctggtgttgagatacttcttaatataagatgtttgaaagaaagaaaatgtgtgaatattcatctataagcactatgaaaactgtcttctatctttgttgaactactcttgaattatcactcctcttaatttgtttttgaacccaataatattgaaccaaaatcaaagtgtggtgttgttttatcagtcctctttcaaagtctaaatgaaatcattctttttatgctgtaatcaaataagttacccatctctggctcaaacccaaacctaaatagcaaagagcagaaaaaggaagttcaggaacacatgatttttccatagtatgtcaaaaaaccctatgctatacttccattagagtgaaaaaaagaactctttctgcttttaatgagcaattaattccagtccaggatgtcgagtttagaataggttaacttcccccaaaccacagccgtttgtgttggatcatggttaaaaccccaaattccaacttctacaataataacattcttttcttctactgcaatgggagaaatgaccattttatgtaacataagaaaacctatagcagaaacccctatgaattccagatttcttaaactgttctcaaagctgtttaaaatcagttgggtacattttattttagcagtgcttaaatgttctaaaataaactttgggtactaaattaaaaagtgaagatgtctggagtcgaagatatgaatatctatctaactggtatttatagcacatgtatcacttaaatttgacaacaattaaaactccacataagccatgtttgtgttcagatcctgtggcctgggatgtcccctcacacagcttcctgactataaccaaccaatcaggtcactacagcggccatcttgttctttcagtttaaggaaatttttgactgagagtcgttctgagatttaacatcatttggttcttattaagtagtaactagtctggtgttgtgatgggaaaaagaaaattcacagaaagcttacctctgaaaggaagacagaaagcacacttgaatcaaagaaaaccctaaaatgagaatgatcactacggtaatattggaattgccattctccacaagaaaaatgaccacttttgaatacgattgtaacgacacatactaacgtctatgactttccagccctcctgtgaatctcattaatgtctttgtatttcattctgagccttgaaatcacagtgctaaattttcggagtgtttatgaaagagtgcaaaagttgataccactgaattttagcgaggctaacaggaaaacttcccatttactttagtaaatgatctaagaagaaagaatataatgttgctgttataaaccactgagaaatagtctcttttctactttccagataaggcttctgtgaagcagtggagtatttagattttatctccatgaagcttccttcaaatgatcattccgtgtcatctctcactcacagacatagctccattccctaagcagcaaagtcaaagttgcacatgagagaaacgtattttctgcaattttccattccttcgttggtttttttcattcagtgaatactcagcaatttatgaatgcctaggaaaatgtacatcgagcctgacagttgtatcatcaacacttacctacaaggaaagaaaacttgtttggtgtatgtgtgtatctttaagcctgtgtgtgtgcataaagttgtgtgatttgaagtttctcctttacagaaacagaaggaaatgttgtatgagaaagacaatccccatcatgacctggtgtcttttctttaatgaaccttctggcccactctatagtattagatacccccaaaccatgtggagacacctccttttttctcttttgttttcccatgatcactaattggcagagccacagcttgtttctcagtagcaaatttattttaaagtttttatatctatcatctactttttttccttctttttttttttttagtatgaaccaagtttcctgttttctatgcaattccctttgcagtaatttcccagatttcaattgccaggcgtgcttcagcagcaatgtacaatatgtgtatgtggttataagggaatcagagactctcatttcagaggaggaaatcgtgctctcacaattaatgtgaatgatagcaggaagcaatctttaaagtagtacttgaattgatgatcagaaaaaaacaaaacagaacaaatcgctatgggctttaggaggttgtggctttcgtgtggttccagaactatgttgccttttcccaatttaagaaaatggatagctttctcctttctatgtatggatatatatatataaggttaaaaaatctaatccctaaatacatgatgatgcggggaacagatgacaggcaaacaggaaagaactgacattttttatcaagcattcaaattttcccctttgttggttcataagaaaatttgagtaccttcccatttagaaacttaagagtttcctagctttcttaaagattttatctgcaaaataagaagaaaacctgttaatatcctatcatcaattaaggaaaagaatagtcattttcacgtatgttctgtcactttggccccaggattggagaacagaatttcaaaatgtgtggttccttagtcatgcattcatttattaattaatgtggtagacctttactcagtggcaaccttttgccagacatttacttgactctgaggaatcgaaagtgaataaggggttcatgtctgctgggaaaggcagacaggaaacataatttcaaatataatgagatatttaggagtagttatgcaggaataaattgataagcgaatgcataggaaagagagactaaccaagaattaacgagatagatttgcttttatccctgtgaagttttcccttgtgtgttcagtcttcccttttgtctgcatttagggctgtctgtccgcctccaaagtaagctactaaatctaaacaattgccctttgtaatttcaaaacaaatgtaaagtggcttttatcatatgtttcatgatgatacttttctttatgcccaacctctccttttgaggatctgagcatttctgcatcacactgtcccaattaccaaccaagatcagcccgagagagtagattttctaacaactgtgtgtcacaacttattagatgataataccatcaattagttggtcactcttatcatttctaaatgattttgcataggatatatcaaagggcatagcaggtagtcaaggtgggtattggtacagtttttgtttcacatccaatgcaggaacacacacacttacgtttggtcatgatgtaaattataagtcttcctatgagttatgattttaggaggctgaaaaactctggtttagaatttaagtttcatatctgcttatttactgtttcacttataagaacccacatggtgctatttcacattaggaactaaaaaagacatttttaaataaacattattaataaatcttatctgaaacacataatgaatggcacatagtttgcttttcttgtttatatctacatatcaatacagatagatacatatggatagaaatataaagatagatacagacacaatttgcatatatttaaatgaattttagtttaatagtcaatgatttatgaaactcttaaataaacatattgcaagaagttacaactacagccagaaatatgtggatatacttggcatactccaggctttctttattctcctgaaaattacttcttttattttatatttaacaagtttttatgtttttattatttttcttacagttctttttttttttttttactttaaggtttgagggtacatgcgaaggtttgttacataggtaaactcatgtcacgggggtttgttggacagattatttcatcacccaggagttaagcccagtacccaacagttaccttttctgctcctctccctcccccgaccttccaccctcaaatagaccccagtgtctgttgtttctttctttgttttcctaagtgctcatcatttagctcccacttttaagtgagaacatacagtacttggttttctgttcctgcattagtttgttgagggtaatggcctccagctccatccatgtttgtttgcacaaaagacatgatctcattcttttttacggctgcatagtattccatgctgtatatgtgccacgttatctttatccaatctgttattggtggagatttaggttgattccatgtctttactattgtgaatagtgctgcaataaacatttgcgtgcatgtgtctttatggtagaatgatttctattcctttgggtatatacccagtaatgagattgttgtttgaaatggtggttctgcttttagcttcttgagaaatcaccatactgctttccacaatggttgaactaatttacactctcaccaacagtgtatgagtgttcccttttctccacaactttgccagcatctattacttttttattttttaataatagccattctgatgggtgtgagatggtatcgcgatattgagttttttttaatgtgcttgttggctgcatgtatgtctttttttgaaaagtatctattcatgtcctttttaatggggttgtttttctcttgtaaatttaagtaagttccttatagatgctggatattaaacatttgtcagatgcatagtttgcaaatattttctcccattctgtaggttgtatgtttactctgttgatagcttcttttgctgtgcagaagctcttaagtttatttagatctcatttgtcaatttttgctttcgttgtgattgcttttgctgtctttgtcatgaaacctttgactgttcctatgtccaggatggtattgcctgggttgtcctccagggtttttgtagttttgggttttacatttaagtctttaatccattttgagttgatgatttttgtatataaggaaggggtctggcttcagtcttctgcatatggctagctagttatcccagcaccatttattgaagagggagtcttttctccattgctcgtttttgtcagctttatgaaagatcaggtggtcataggtgtgcacccttatttctgggctctctcttctgttccattggtctgtgtgcctggttttgtaccagtaccatgctgttttggttaccatggccctgtagtatagtttgaagttaggtaacatgatacctcctgctttgttatttttgcttatgattgcctttgctatttggtctctttttggttccatatgaatggtaaaatggatctgtaaattccatatggatctgtaaattgctttggccagtatggccattttaatgatactgattcttcctattcatgagcatggaatgtttttccatttgtttgtgtcatctctgattcctttgtaattgtaattgtaatctgttttgtaattctcattgtagagatctttcacctccctggttagctgtatttctaggtattttattcttttggtggcagttgtgaatgggattgcctttctgatttggctctcatcttagctgttgttggcataaaggaatgctagtgatttttgtaccctgattttgtatcctgaaactttgctgcagtttatcagctgaaggagcttttgggttgagactatagggttctctaggtataaaatcatatcgtctgcaaacagagatagtttgacttcctctctatttggatgccctttctttctttcttttgcttgattgctctggctgggacttccaatactctgttgatcaggagtggtgagagagagcattcttgtcttgtgacagatttcaagagaaatgcttccagtttttgcccatttagtataatattggttgtatgtttgtcatagatggctcttattattttgaggtatattccttcagtacctagtttattgagagtttttaacatgaaggggtactgaattttatcataaaccttttctgcgtctattgagataatcatgtggtttttgtctttagttctgtttatgtgatgaatcacatttattgattttcatacgtcgaatcaaccttgcatctcaaggatgaagcctacttgataatgatggataagctttttgatgtgctgctgggttctgtttgcaagtattttgttgaggatttttgcatcagtgttcatcaaggatattggctttaagctttgttgttgttgtgtctctgcctagttttagtatcagaatgatgccagcctcatagaatgaggtggggaggagtttctcttgagagggtatatgtgtccaggaatctacccatctcttctaggttttctagtttgtgtacatagaggtgttcatagtagcttctgatggttatttttatttctgtggggtcagtgctaatattaccttcatcatttgtaattgtgtttatttggatcttctcctttttcttctttattagtctagctaccagcctatctatcttactaatttttttcaaaaaaacaacttctggaatcattgatcttgtgactggtttttcatgtctcaatttccttcatgtcagctctgatttttgttatttcttatcttctgctagctttggggttgattcgttcttgcttctctgattctttcagttgtgatgtttgttagtttgttaatttgagatctttctgacttttggatgtgagcagttattgctgtgaatttcccttttaacactgccttagctgtgttccagagattctggtatgttgtgttttgttctcattagttttaaagaactttttgatttctgccttaacttcattatttgccaagaagtcactcaggagcatgttgtttaatatccatctaattgcaagtttttgagtgatgtcttagtcttgagttgtatttttattgcgctgtggtctgagagtgtgtttgttatgattttggttgttttgcatttgctgaggattgattcatatcccattatgtggacagttttacagtatgtgccatgtggtgatgagatgaatgtatattctgttgtttttgggtggagagttgtatagagccctgtcagttccatttggtccagtgttgagttcaggtcctgaatatctttgtaaattttctgcctcgatgatctaataatgtcagtggagtgtaggagtctcctactattattgtgtgggagtctatgtgtctttgtaggtctctaagaacttgctttatgaatctggctgctactgtactgggtttatatatatttaggatagttaggccttgttgaattgaaccctttaccattatgtaatgcccgtctttatcttatctttttgatctttgttggtttgaagtctgttttgtgttaaattaggattgcagcctctactgttttctgttttctatttgcttggtagattttcctctgtccctttattttgagcctacaggtgtcatttcatgtgaaatgggtctcttgaagacagctgtcattcggtcttacttttttatacagcttaccattctgtgcctttttaagtgaggcatttagcctgtttacattcaaggttaatattgatatgtgtggatttgatcctgtcatcatgttttagctggttattatgttggcttgtttgtggggttgctttatagtgacactggtctgtatgtttaagtgtgtttttgtgttagctggtagcagtcttccctttctatatttaaagcttctttcaagatttcttgtaaggcaggtctggtcgtagtgaattccctcaacgtttgcttatctgaaaaggatcttatttctcctttgcttaggaaccttagtttagtttagctggatataaaattcttggttgaagatttttttctttcagacacttgaatataggctgccaaactcttctggcttgtaggatttcagccgagaggtctgccattagcctcgatggtgttccctttgtgggtgacctgtcctttctctctagctgcttttaacattctttctttcatttcaaccttggaaaatctgatgattgtgtgtcttggggatgattttcttatgtagaatcttgcaggagttatctgtatttcctgagtttgaccgttggcctgtctagcaaggttggggaagttttcatggacaatatcctgaaatacgttttccaagttgtttgctttctccccctccctttcagggataactgatttggtctcttttcataatcccatactttccagaggttttgttcattttttaaattgttttttctctacttttgtctgactgtcttatttcaagaatcagtcttcaagctctgagattctttcctgatctttgtttattctgctgttaatacttgtgattgcattgtgaaattcttgtattgtgttattcagctctgtcagacccattatgttctttttttggactggctatttcatccttcagctcctctatcactttgttgtgattcttacattccttgaattgggtattgccatcctactgaatctcgatgatcttcattcctatccatattctgaattctatttgtgtcattctagccaattcaacctggttaagaactcttgttagagagctgatgaggttgtttggaggacatatggtactctggccatttgagttactggagttcttttgttgcttctttcttatctttacatgtgggtgttccatttactgcagtgtagattgagtacagtcagtagacttcttttctggatgttttcactggactaaggctttgtgcagggtctttatttgaagctgacttcttatctctggtttcagaggtgggtatgttagcagggcatttttggtgttgaagctttggggtgtgatccagtaggtggcacttaggcttattagtcagttggtagactcttgcttggttttgtggcttcccctgtgtttcctcatcattgcagctatgttccctctcaatgctctgaaagtttgggttctctcccctttcagtgctggctgtagataatggcttggcactcctggactgcccactgctgctctggagagatctcagtgtttttgttcctcccctaacttagaggcaaaaaaggaagggaccttagtagtgattgtggccaagggtcttttgtttgtttgtgtcccgaagcctctgctccagagagatgcaggtcagtaatccctcagtgcaatcagcccaggatggggagggtctgtgctgcaagcccaagccagggattccttgtctggtgataagtagtggtggatatgtgggaaacatgggagatggactgtcctcctctccttgggtcgactacagcttgttggaggtgtgataaagcacttgggttctttgctccttcatcagtctaagggtagcaagggtggttccactgcagaggcagtggcagagaggctttcagttgctcctggaggctctctgtccagggagttgccgagttgctactggctcaatagctcgggccgggggtggctggaggcttaggcctggaagacaacaagtttttatcataaattaatacatgctctaaaatgcttaggtaattggtaaaagtgttaaaatgaaaatgtaaattattcattatctgaccacccaagaaatgaacactgtttatgctttggagtattttctttctatacacacacacacacatatgcataacatgtagtaattaaattgggaaccttctgaatatactatatttaagtcatatttttttactttgttatattttgaaaatttctcatgacattaaacaatcttcaaaactgtgaatttaatgtttaatgcatagtattttctagaaaggatattaagtaattggttaatcactttaccattattggacgtttaagttgtattcattgtttcttatcataagtaatgaaatagcaattagccttacaaataagcatttgtattattagttctttatcataaatcaatataagatactaattatctagtatgaggcgatgaaatttatttaaaatttggcacatattactcatctttcctatgaaagttgttaagtttatattcttgccagcagcatattcattaatacactgaacaaatactaatggtctgttttatacagcttttagagcaaccctattaaaattgagtgtttgtatttttcctagtattaccaatttgatggcaaatatcaattatgttgttttcatttcttaattacaactgagaataaacatttcataggtttattggccatgtatatttcttctttttatgaattttttattttttctattacaatgtttgcctctgtcactcctaacttgttaaagttcttgatgtggaaagaatattaagcctttactgtcaaatttcattcagggttttttttctaacttcgtcaatagactctttaactttgtgataccttagagcttaaggacttttatttttgtgtaaacaaacctgggatattgactagttttttcacataccatttaaacatctatcaagatgattatatgattttttttctttttctattaatgtgagagttcatatgaatagactctaatgttgaatagcccttgcagttctgaaaaaataagtctacacttacatgctgtctgttttgtcctttagagagacctgggcatggattgctaatatttcatttgtgattttgtatcttatttgtaagtgaaattgataagtacgtttgtttttttgtttgtttgtttctaactttagctgttttatacagaagggttacattacctttgccaaatgatctggctagcttttcatctgtttctatgctttgtaacaatgtctataatgtaggaattatctctttgtaaagattttaaataactcatccataaaaatatctaacttgatcctctttcctgggtaattctttgacacctttttcagcttttctgatagatacagatatttggaaaaggagattatttttttcctttactgaattttggaaatctgccttttctgtaaaattatatctctttgagatttttaagtttttagtgtattttatctttaccaaataatatatttaataattattttttgttttcatttatttttacttcattatttttacatttatttttacttaattattgtttccttaaaaacaaatgaaacctattttttgaattattcagctatttaattttgcttttgaacttagtttaggtatacttctggaagtgataataagctaatgttctttttttttctaagtattctaaaatattaaagactttatttttcctttgatcaagaatgatttatatgatctttaaatcaaggaattaggttttttatttaagtttttattattaatgtatggttttaagctctgtagtcaaggacagcgacgtctcccatttttgcctggtggcatttattaaaagttggcataatatatggtaactattgtcgttaaaaaaaattaaattaattaaaatcaaaataatgatttttctgtaaatatgtattctctaataaatacttactgagttcctatagtattataattccaggcaccatgaaggtgctggaggatagcaaagagcacaacagacaaaaatatcttggcttgtggtactggcacactagtagatgataaatatatgcataccatatttccttaaatatgagtcagcaccgattattatacacacaataaatttttactaacagcttttcaagaggagaacaaaaaagaggaaaccatcatattaaatgtaaacttttccattaaaagacatttcaattttacaaatatttaggtatgagaaatgtgtttcttactattgagaaaatatggtaaaacaatcttattaattatattgtttttgatattgtaaatacttatttgtcactttttatctgttaaacacagatattaggttaaaattcccatatactgtttggttctgagggctttcagtatcccttttttcttaggtctatcacttattataaaagttgaattgtgccatttgattcattctgaggctttttcttccaaagaaatgtttaactcatttctatctgttatgataactgggattcttgtcctttctgtcatcttgttttaggcttcctgttttatatacccttttctgttttcttacccccgtgtactatatgtgtgtgtgtgtgtgtatatatatatatatatttatatatatatatatttttgagatggagtctcgctctgttgcccaggatgcagtgcagtggtgcaatctcggctcactgcaacctccgcctcccaggttctagcaattctttgcctcggcctcctgagtagctgggattacaggcgcccaccaccatgcccaactaatttttgtctttttaatagagacggggtttcaccatcttggccaggctggtcgtaccatattttctttgatgatttttagtaatttcagtcatactggctttataaatattatttagcctattttctctatcagtcaacatcaaaaataaataatcttttgagtaccttacatgttaaagaaacaaagtaacgtgactgtgttatcaaaactttcctttatactttttaacctgtggtatttaatatacagttgtgtttctaaagaaggtgtatatttttaaaatatttttaatgtgacatagatcctactatctagggattatatgcagtgtttaatgccagtccttccttgctatgacagctccattgctcagttctttattttgattcatctctctgataacctttttttttttttttttttgagtaattttagttcaggaagaataggcagtatatttttaaatccttaaaatctgatgataatattctttatatataaatctaaatacttcttataaggatgtctggtggtttgaagtttgaagtacgtaacaaatttttttttacctcaatgacttgactgcttcccaaggtttttttcctgaaaattctattatctttaggtttttaatattgatgaaggagaaatctgaggcttatctaacttttctttctctaagtaacttgttttctctatctggatcttaggggcttctttattcacgatattccaatgttttacctacatttgtcagggttttggtctctgcattcattttgccaagccttttttgtgttctttttattgatggcttcatgttggtttctgctgttttcttgcttgaaagcaccttaaatgaggtgattgaagtctccttgattctcatcaccttacatctgaagatttgtagaagagtcccctcaaacctcaacatcaggactgtctgatattaactacacctcctgtttagaagttcagcagctgagaggacaggagtggagccaaaaccctcaacaatacttggaggagaactttgcatctgcttagttttgcaggtgcttttgctgaaatcactggataaggggagagctttctatgccctgacttctttttggcccagccgtctcgtcctctattgcctgtggctgtgtctgcccttcaccttcatactattgcccatctaattagaagagagagcactttctatcttttagattttttccgctgttacagctacttggagaatccaagactttccaggtgtgctgttcagaatgctgccacttccaacataacaaaaagccccatgttaatctcatcagtctcataacctctcctccagcctcacccttctaatgaaaggcttagcctcctctgcctgctccccaggagggttggttttgagctggcaccatgccctcctttccgcccaacccatggcactatttccaatacatactcctcaatgactcacactggtgcaagtttcacctgttttatatgcggttggtcatttcagccagaatctgggagatcagtagtaaattgtctatgctcacattgccatttttattcagaatttgatacccatcaaaacacttaaacctcgccagaataagagatttcttagtgatgaaccatggcaagaaccaggacagttttattgcctcacaaaggctattttcttagctgcaactttcttattcacacacagtaaagcaatgcctagctcatggtatgactggaaaatactagggcttttttcccctcctacatggttaactcctaattttcctttaaatggtcctgaaaacaagagacatggtatgtaaaacttccaaattggtttccttaccactccaagagtggggtctctggaaaatatagtaacaaagctggttttctagtcacatgtcaccataacttcagtagggctaagctggaaaggccaaagaaattcggaggattaagaggtttttttgtttttgtttttacattgaagatgtaaaaaataattacaatataatgctgggtgttatgtatgcacagttacctatgaacacaaaaaggtttaattttttctgtcaacgtgcattgttgtaattattaaagataaaaaacaaagttcctgctataaacataggggtattggttgcatgactttattagctcctagactgaggtctattgtgcggatgctaatctaataacagaatcatatttataatacagtaggaaattctctctgcaggttcagaacagtacacatgagacccagcattatcgaaggcttatcctttctcacactgaactaatactcacccttcattttggtgacaagtccagctcaatgagaatctcgacaaagggcctgactctctccccttccagccccttcgctacagcagatatgattacttggattctgcctatgggtccacgttgtgtacccagtcccgggaaggtgcaagaaaatctgatcctttttcaaaaatcatcttagaatcgaaccagtcttactctgattttcatgacacccccaccctgcccttgcttctcgcagggtctggggctccatgtccttatcagtatcagacttccactgaggctgctgtctccagtacccccagaacactaggattatagtttctactggaattccctaaactacattgctcatccatttcaactagacccaactgcttgacaactggtcatggacaatcttgaacatagattctgtttcacagtttgtcctaatctctttcttctcagatccatctttttatccctgtccctctgtgtacccatagtcacatctgggtgtctgtggtgggattgtggatgtgcacttctacccactgtaagcagctatcacaggtctggcccactcaactgctcccctgatatctgtagtgacagaaccttgccttcaaaatcaaaagatacaaaggtgattccagtattgccaggtagagttttacaaagagtacttgcctttgtggcccctttttctaaaattttggtaagcagatatacccagaagtatgccagccagaaagtctgcagcagctctggggcctcagtaacataagcacaactctaacttgatagcaagctcaaccttgatctccaactgctcgtctgctgtttatggcacttactgcctggccacgttttcatttttgacttggaaacaacaaggcagatgccacattccataccactaccttttttagttctagtgaagaaaataatgtaagatggtgaattaattgacatgaaaaaaaattaaatgtacaagattaccacttctgcttagtgctttgtctttagtaattattgcatttttgtatagttaacgcttaaggtatgcaatggccaaagcacaattttattgcctttattttgctgtttagaaatggcctctgggggtggaagggagtagaggagaccaatctttatcaataatgggtagtaattttaaaatcatttaaaatgatttttgtactcacatatgttcaaaccccctttccaggtaaattctatgtggggacacaagtggtcactgagataccacttggcttttagacagtgaagaagtcaaatgagaggtttgcaggtataaataaaatagcacaagtgtagaagcatcatcagacacagcaagtgtaactataatgaaagttaccttgaacaaatcagttcccaggatagcattcatttcttattgttaaatatgcttgatgcagtgaagtatggcttccagaaagataatggagcagataattaaacactctatttggaaacacaaacacagacacatacacactgcagggagtgtgggttagcacaaatcttgtcagtacaacctaatgaccttctgtagaccaggcctttgacaaggggaaaaaaatagaaaaagtcattttttttactgcagtaaggattttttataaaaattctgtggtacgtgaccaacatcagtaaaagagaaaagagcttagctcttacttcttttatataagtggactatggttcgaggttgatgataaatcactaatgtttgagtttcagttggctacagcatactaagtagtcttttctgtggtgacaagtgacaaggggcagttaaagatgtggctacctcaagttctcctctgccatagaaaacctcccagaggtcaaccattagacccctactgtttctatgtcagtagtgtaaggccaggcaaaggcaataaccttcatcagggtctgtctcaacctcccctgcagcctcctttcattcttcgtatccgatgatgccattatcatagagagtacatacctgataaatgcttgttgaattgggcagcattgtttctaggtctctctcaggaaaaggaggaggatcaagacataccatattcatcttaggagtaacacagaagtttccccagatacaaggtccaattctctctactgtaaagcctagtcctcatctcactacatttttcaattagctgatgacacctacatgatgcatcagagatggatagatggattggctgcttttgagaagttactcatggtccatcatgcatcaggattcttactcatccacagtcccctgcaaacagccagctattatagtcagcagccaatggtctatgtgagtgatccagaagctaggttagacagcatcccattggtcttcctggtaagaggttgtgctcacatttcatacatctgtacagtcacagtagcctctcatgaagccttctccagctgctccagcctcatctccctctccctgtcagcacttccagtctacaccaggaagtaaaacttaaccacatcctacctggtaccagcaaacaacttatttaagaagtcatgcacatttgagccctacgttgtgcccaacctcatgctgagtactttgctgcccctcaacaaatgtttgaattcttgatggcccagatgggtaactgaggcagaaacatctatgagtctccaaagggaaagcacatataaattgagacctgtgctgtattctcatctccagcctcttctcttcgtgtcagacatgacacaatcttttttttttttttgaaacagagtcttgctctgttgccaggctggagtgcagtggcacagtctctgctcactgctacctctacctcccaggttcaagcgattcttctgcctcagcctcccaagtagttgggattacagacatgtgccaccacacccagctaatttttgtatttttagtagagacagggtttgaccatgttggccaggatggtctcaatctcttgacctcgtgatcagcccacctcagcctcccaaagtgctgtgattacaggcgtgagccaccgtgcctggccaacacaatcttaaatactcaacaagctagcctaacgaggaatgccagcaaataggtcattgctaacatctcttttggtgtctttctttgacaatgttccaagtggctacctaacatgctggcaattatgcctatagggtgagtacctcatttaagtatttttgtagattaagtcaatctatgtttatgaattttgaaataatggatatggctatggtggcatgaccctacttgagcattaaaaaaaaaaattaacttccaacatattttaatgcaaatgttacctttgtaagtggatgacctgaaaagaaagtgtttccatagtaacctaagggaacacataactgtttatcagaacttctccaggaaaagagcttggcatggactggggatctgctttgatgtctgctgaaagaaaatagctgacagcattgtgtgagaaaatggttagaagatcccactttatttgtagttaatttagaaaataaactttcataatgaactgctgaaatacacacttgaaacaaccagatgatccatcaggatattttttaaaatgtaatttgtcgggtgtgacaaccaagtcatcagtttaagagaaacagattagggaagagatcttacagcaggtctttgccaccatttcactcattttttttctgtactctgtgttcttctgtaggaatcactaggcctttcagagctcttagatttttttttctttgcttactttttttcctttttaacttcagaaaacgttacgtaaaagctgccctttgggaattgagactctacattgtgaggctatcaccaaaaagaaacctattgattgattatacttcactttctttactgacacggctgtttgagttagtagctttttggacatgccattaggtagaaatgagtttgacatccacaagccactatctggttatctgctggttattttccctttttcttatggatgtaatatctacttaaagaaaagctgatctacgagggttttcttttttcattttttaaggttcatttgagtagagaacagatgcatacagttttgagaagtatttctttgaagcgcctttttagagtcagctcactgacaggtccatgcccgtgggctctggtgtggacttagagcaattacccacctggtctccatctggtagcatgaacgaaaaatcataacagatcatagagaaactataccaactgccaccttggtataggcaggcaaagaaaggtgccacccaacaatgctgtgaagagtaagaaatgctatccgtagggtatgcacattcccaccacaagatgcaaaagagtggcacacaggagcatgtggaaaggaaataatatgcacatctaaccttacagctgcaactcgtgaaatagtaaaccaaaagttctctccgccacatttatgtttctagtgaagtttggagaaaacgtattatcctaatatgcttgagacctgtcttttgctacccactaccacccacaacagggttaaacaagacttgaggacttttaggtgaggagtagatgccaacatcataaggatgttgatgtaatttacatgtaatgccactttgtagtcagttcaattgtagcaaaaataagggttttatggttgctggaaaataatttaaatgtttgttgattcgttattgtctttttgtttttattttctccttttctgctttgtctgctttcttccagaatacagcgtgctctggttagtacaatagctaagggttcagaatctattactacaactgccagagatttgccctcttcgggtaacacccttccatcctgaggagctagagaatccgagattcagagaggggcaaaatgtctctggcgtgtgtgtggttagcagggtaagagctaacttggattcctttctttcataatcccctacaaagtgttgcacatgcttccactgaggactaaagcaatgaaaaatatcttcctggattggccacacagatactcatgctggacgattcaagaagatgaaatggggaagaaagaaacgatgactctagaggcatgacccacctggataagaattgttgtaaaggaattatgtagtgcaggaccattagaaaatgccagagtgggaggtgagtgaaagatgagatgtcaaaggagaggggttgtgatctgaaaggtaagatttcaatatctgtatgtagactgtgacctttgcaaaagactttatggaaaagccaacaagagcctaaacgtgattgctgtggaagaactgaagtgcatactctctgcaagaagatataatattgtaaattcacttgctttttcttcttccaacgtatggaagggactcaggtttttttcaccataatttatactaattagtctttccacttaaatcaagaggggaactgcaaatgtggccattgatggtctgctcctcattagagacaattaagagttagaggaacaaaaacacatcataggattaatgatgagaaaagccacccagagagagaaacatgaagcaggaaatgatcttattgagctggacaaaggaaactgatagcctgcaagatcagaggctcttggagctgaggtctaaacagtctaaagaagaatcgcctgggcatgcaagccttcccctgctgtattctcatctgtatttttcatatctcctgtcatattgcatttattaagaaatgttcttgctctctaaatccaattcattagtttccctccatggataagagggatggcattactgctgagagaaaaataagtactaagctaatcagccttggtaaattccagtcttgcatgttattgtcattgaagctttatgtagcattcagacagggcaccgagacacaggagagagactggatatgaaatgtcctaacaccactctcagacccctgctgcttatatcattttatcgtcttccaaagagagagggaggagattagggaacatttaattgccttataaactgattgacaaattggtgatctgatgcatatggatgatctttttagtgaaatggttcagaagctgctaacagatcatcaggaaccatgatttgcacgctctccgcagagttattacagagaagtggaaggatgggttgattatttattatctttccttctttctgttttttttttccttgaatgttttcttcacctccagggaaatgcattctagcagcgtgaacaccgctattaatcaacacttgtagcaataatcagtgagtgaaaaatggtgaccagaatctgcgaatgcgctggcataactgtcttctgagtgttcctttgtgatcatgccttggcattcgaacatggataatttatacaaaattaatgttgacaccttctgaggtgcaaagattcatagaagcagtgcttacttcttcatccgttaaaaaacgaagagaaattgtttctggtcatgatgagtcatattttagaggctttaaaaatatacttgatattgtcatgtttctttgtgttatgtttagtcacctagtcccatcatttttgaacacaggtgtcataaaaggcaaaactgttataagttctttgtttcagttttctcagacttactccagaaggggtgtggaaaataatcaagaattttaaaatagctcaagccccaatatccttctcaaagccaactattgttattggcagtgcttgggggggaaatggttcagagttgctggagtggcaaaacactgttacaagccacaccttacatagggcagttgtctaaattaatagtgcaacatttggctagtgatgcaattatacacaatgaaactattttgaaatttggttgccactctcattccacaaagctacatattaattcacaccatcctgtgatcaggagggcaaaatctgaggtgccaacacactggaaatttcccttaaacttcgctaagttaggatgagtttgcctggagcctaaggaagatcactaaggcatcagaccacatctttaaaaagtgtgatagaccaggactcataggagcatatgacaccagccccttctctgcgaatcattcctgtcattaaaatcaatgcaacttaattaaagcaaattatagatagatacatctataaataagatattaaagtgtgctgctgaatatgataattgctgcatatttagcaatcagtgtgtgtgttctgcttttgccaggaggaattcctttcagtggaatcaatggagctttattaaaaaccatccaaattagagggagaaatgatgagtgttataataacacaaaatcactgtttcaactttcattgcaaagaaaagaaagcaaaatatggccatccctcttttttcactcaaggaaaatattagacatattttctttaagatgtggatgttttgaatttataaattttaatttttgtattctcttctcccaaaggaaggcagaaggaaaataatgatcataaataaaacaatttagcagtgagactggtaggaggaacaccccagtgcccagataagctgttttataccgtgatgacagaagacaaataatgaagttcatattctgtacagaacttgaagatggcttattttattctcctatccaccagattttcttgtatgtgaaaattttcatgggttaattcaaaataatgaatttggaaaataaaaatccattttcttacccctatacctttattcataacaattacacttgaggcaaagtatattttttcaggctaattttaaaatacaaattttaaaaagtttttttatcatcgagtttaaacatcagtaacaggaaacataagtgttcattaaataatgaaatcacccctgtgtaaccagaattattctcaaatttataaaaataaatactaaacttacaaaaagacatagattttaacattcaatggttttgggggttttttgtttgtttgtttgttttttgagacagggtcttgctttgtcacccaggctagagtgcaggggtgcaaacaggtcactgcagcctcaacctccggggctcaagcaatccttccacctcggcctcccaagtatctggaactacaggcccacgccaccacatggggctaatcgttcagtgttttaagagatgaagaaaatcactaggcagccagccacctctaatagagtctagtaaaagcatttacaaagacttcccattctgggttactctgtgcattaatgttttgtctttgagaaggaaaagagataaaagaaaaagtgaaaaagccaaaaaaaaaaaaaagggacaagaagagacatgcatgtttaggaaagtggtttataactattatttcacttgatcaaataaatgttgatttgttgaatattttcaagggactggtcctggtgctaggaaagaaaacaaagtccctgttctcatagagtttatgtttgtgaaaagagatagacaataaacaagtaaagagtaaatatcaggccatgataatgaccaggaagaaatatcaagctgggctaaggggctgggcaagcatgctgttttctacaaagtggtcggagaaggctaagggagcaagatgcttgggaagctggaggagcagagaggagagtgagtgagaaggagaatggacggaggccagagaggtgggaggatcagaactgtggagtcttatggagtccactttttttttttggagacagagtcttactgtgtcgcctaggctagagtgctaaagtgtagtggcatgatctcagctcactgcaacctccacctcctgggttcaagctattctcctgcctcagcctcccaagaaactgggattacaggtgcccgcaaccacacccggttaatttttgtattgttagcagaaacagggtttcaccatgttggccaagctggtcttgaactcctgacctcaagtgatccacccacgttggcctcccaaagtgctggaattacaggcttgagccactgcacccagcctaaccattcttacccatagtggttatttctaattttctaagatgcatagatgatgatacgtattcctcatgcttagaaaagagtaaaaacgattggcattggtctagcttgctatgtttttctcatggcctagctctagagagtgattttcaggagagatggccaattatttcattccagactgccaaaaccagaggctattatattcacaaatttgttcaaaatcgggacacatgagtttccagtctacagaggggtgtatacagagtaaaatggagttcttttttgcatctctcttagctctacatctactgtgtagacatattgcccccataatcaaatctgctctgcccctttctcatgtttccaccagaggataccatggcttattcccacctgcgaactctgcatgaatggaaagaggaagtaacaacagccactaatcatgtacatcacagacatctaagcccggtctttcctttaacacacactccgtccttgtgcagctgtgccttagagttggccccagtcaataggtagggagggagcagagtggtggtactcagactctttatttggttcctttctccatgccaaaagaagatgtcataggacatttcaaaactaaaccatccttagagatgtgtactaacagcagtttgcaactctgttatgggatacacaaaacagcagggccactgttcttcattgtaatctgcatgtgaatattctagttcaaactccacacagtaataataccattaatatgatatttgtttgtagcataagaaatatatttccttctgaaaatattgatgtaatgggtctctttaaatcacagtatttaaataatagcccacttaaagaacaaggtattggaagacattatccagtaaaaggtttctcttccctatgaggcagtgagttcattctgccacctttataatttcctcttcctgtgcaaagtggctctgtgctctctgctttgctgcaattcctcaggcaatagccaagctctcccattgtgagaatccctgatttcaataactcacagaaattagtaattagaaacacattaaagtgttggatcatttttcttaggggctttactagtagagaattgtaccccaaatttcatttcctggtgttttctcctttctggttataaacatgccaatggtgctgtattgcattcacctggggtaggattgagacgtaatcaaggtgagcctaataaaaatgtggcagcaggcctaatgaaaattggaatggatctaaaaaccttgaataagctcactctcttttcataggttcttgcagtttggttttcctgagtatctgagaaatggcagggagtggggtcctttacaggtattagctatgagcaggtatttgaattctgattgagaattgtgaggtggaacaagcgtgtggtgtctcttagctgagttgtgtgctattggaaatgatggaggctgaattgacttttgattttttaagaaatgattcgattaacttttgaaccacctgctcctgtgtccccaggaatatcgtgaaataggctctattcctgttctttccacagcattgcattctcctgctcccactcatttgagttttgccgctctgtgaattatggtatttgatctctgctcctaaggaaagatgattctacccactctttggatgggttgttccccacggttgaccctcaaattgaaagtgatgtttcccttgtgaatgttgtaaatttaaactcagggatcatcacctgatcagtaactcacttgtgggttgttagtgtaatttatgcactgttgcttgtctgcaaagtaaaagtgagtttctcatgacccttgaggaagatactcggagagacctgtccctaaactatattgggccaatgaacaaattcaggaatgtaactctctctacttccttccaagtgacttggattaatgttggtgctattttccataccaaaacccaattacaagatggaagattttcagtaattgggccctttggatctgaaacatctcaggtcagtgcccctggggatagccttcagtaggaagagttctggggcttcaaacagaaggtaaatctgatttatagatggacatggcattacatctgtcacaaatacattatgaattggcgttgtacattttctaacatataaatcaactccccctgggaaattatccttcatcctaatggattataccataagaagttctttgcaatattcatcctaaattttcacttttcttaatttcattacattgatgagtagagttccttatatattcttttgcctacctcttagggatgttaagagtattaggctaatgcttgtaaatcacctcacaattctccaactgagcccactaaagcaatgcaaaacagtactagataataaataggtgttgattctgctcaacattcatgctatactggggcataatgaatagacccttaagtaagtagataaacattcttctccttaaagatgggaaatcatataaatggcactcaaccagaatttcaattgcttagctgccaaagttgggatttggcttctttgcatagaaataatcatggcaagtgttggtttctttttctttttttctctggttctcctgtctgctgaccccttgctacatgatgcttccccttcagactctgtacctttgtttctctggaagaactgcacttaggtgagcatctctctgaacacagacactgaggatgctttcagacttgaaaacacaatgaaggggccttccaccagtcggcagggctaaatctgggagttgcactcatttaggaaaacccatcaatggaccgatagcaaaatggctgaggtcagtagttggagatggactcactctctacctgcgcacacaacctgttgtaccctgggaaggaagccagctgtcattctctcctcatccagtcactagaactacacacacatggtcctggcatttatatgtgatcccaaactgttcaataatgtaataaaatgcatatttcatatttgcactgttaaatgcctaaatcacaaatactgtttcttgatttcattcagtagaattaatgttgccacatgaattagagcattgcattcagttgctaatagcaccttgaggtaacccagctaggataatccaagtctgttttctgtgggtagttgaggattacgtgtttctctgcttgcctatgttatgtctctccttcaagattacttttttcatttagttgatgctttattcttttaatcatttattgagcatgtgttagataagaagtattacaaagatgaataaagcaggattatttgtcctcaaagcactgatgatccaacagagaaggaaaaacaaaaacacaaaccatctccttataacagtctaggtaagtattatttacaaagacatactgaaggctctcagaaaataaaaagagaatagttctgtctgacaggcttcccagaggacctggtgatggaagagagggggagaggaaaaagcttgaaccaacgtaaggaaatgtgagagtttacagggatgaaggatggtgatactgatgaggatgacaatgatgactgtagattgtgaaaggcttggatgccatgctcaagaattagacttctctaggcattgtttctgtaaacaacaataagatggtcacgtgtgtgtacacacacacacacacacacatgcatatcatccttctaaatgtgtcatattattccagccactcatcttgtatacatatagtgtaaaaaaagacactttcataagagaaagtaagagttctctctctataattccctctctttctgtctatctgtctctcctttctctctcgtcactctctttcccaataccgttttcggaatagtatcggtgaagaagcttccgttagctctgtaagccagatctgctcagggggctcatggaaatgaactctacagggcagggaagaaatcctctccaagtgtttttgtttttttattttgttttgttttttaaccaatagaaaggtcagattcaatgtaactgcaatagtaagaatgaatatttactgacatgtagtagactatgtgtgagatgtactatgtgatttatatgcatcatatcatttaatgctcataacagtcatctgagtgggtattactaatcgcatttacagatgagagaaatgaggctcaaaagttaacttacccaaaatcacaaagtcagtaagtggtagagccagaattcaaacccaaccactatggcacactgtgtgcaggcctgagaccactgcctctgggtgttcaattagagactcttcatgcagtttccagttagaattaattaatgctggaatcagacacgcattaggagtgatggtgcttttaggattgtctgacctaccctccctgccgtgtcattctctttgagtgaaatagtcttatgaggaattcacaacacctgcctttgtcctggtcagggtagtgttgcagattgagtcagatgatgtctgagaacatgctttgatcattgcaaaaccctgtatgaatatagtatctgacaatatatcactcatttaatatgtatgtaggaactagacagcaagcacattttaaaaacaggacaggtagtttgaaaatcggtttaaccttttaggtatcatcctctagagcaggtatgtgcacagcccctccaaggccgtggtcaggggcccatcagcatccaagcttcaaagccagccattgctggtcactctatcctttccccagtgcctgccagactgttcacgaagtagcagcccagctgtcacaactgatgaccagctgttttttattttaacaatggctactaaaacccacactgaagtatcctttgtattatttcctcagtagtttagatatccggttctgaagctttgatcagatcactgaacacagttctccagacccgaaccccacccctcccccaggtcattgcacagagcaaacgtgttctgctcaagtggcatcctcagatctccactaggtggacttcacagagcagccaagtacggttagatgtgactcaggtgaagttttttcaaagccctcttagccaaagaagtatgaggctttgatgtagcctttcactagttcgaaagtaactcaggaacagaggggaaaagactcagcagttctctcctaatatccaaactttcctcattttagtatcactactcagcttgcagggaagtctgggagagggttcctagaaacccaactaaccacggactctgtgtcctccacagcatgtgagttgtgcggcaccgtcatgctacatccatgtcttggctcatgtgagacacttgggctgattttttgttgttgttgttgttgcttgctgtatatttgcataattttatatcccgagcagagttcttgattttgcaagagcataataaaaaaaaaaaacactgtgaattggcaggtttgaggttatgatttgcagctggtctatcacttcctcttcctggaagctgcagcttaaagtattttacaattatcatatttcacgggacctgggcctatatttgcatctgctcatcttttggttttcttttttaaaaaatactctcttttcacattttttggtggcaaaattgtccaacacattcattttatgtatttttctcttctgggtataaattcatatggttcaatgctattgaaatcaaaacattcaatgcaatgagcccttcggacaggtttttgagactgaaaacaatgacaaagcaaattctacccagggttgcagtaatatttctaaccagcttcctttgtccattgtcattattttgattaaaaaggtgtgtagaagccacggtggattttcaggatgcaaaaatcattgcagaaacttcctctattagtgcaaattattagacgatggaaatggtacttgagcagcaagaatgacattaattatgcgaaaagcagtcatatctggcagttggcaagcatgcattattcttcaacaatcttccatgggtttgtgttcagccagcattagaaatctaaaagcttttaattttggcaaagttttcacaggacttgcacttccagcttctagataaaagataatttggaaggaaattatgttggtgaaattgaagaattcagtaatgagttctgtgtagatgaatcaatgctcaattaaatgattatatcaaatctacctttaaatgttgacttaaaataatcatattttaaagacattgaaagtaagatgctatatatacatgtaatcagaagagcaaagtctgtgttacccatgctggtagaggaatgaagtattctgattgatccatgaatttgattaatggaaagaaatttaggacaggaattacctgtacgctaagatttagagtagactgccataatctagcttgttttcatagtttccattctcttttgcagcttttctctgtttctctgggtttttttctctttccctgtctacacccctttttccaggctcccttctctgtttgagagttttaatgctcacagaaactttgttttttttttttttttttgagacagagtttcgctcttgttgcccaggctggaatgcaatggcgtgatcttggttcactaaaacctctacctcctggcttcaagcaattctcctgtctcagcctcccaagtagctggaattacaagcatgtaccaccacgcccagataatttttgtatttttagtagagacggggttttgccatgttggccaggctggtctcaaattcctggcctcaagtgattgcccgcctcagcctcccaaagtgctgggattacaggcgtgagccaccgtgcccggcctatttttttttatctactactttatccacctgtttttttcccttcgtggcaatgagtacagccaatcagagcaatattctttgtttcattcattcagtcaatcagcatttactaagcccctgccaagtttatggcactaacctgatgataggcagagctaccaaaactgaagaaacagatatcctgccataggcaaaaaagcacatgtttggctggccagacacggtggctcacacctgtaatcccagcactttgggaggccgaggtgggtggatcacttgagatcaggagttccaggccagcgtgaccaacatggtgaaacctcatctttactaaaaatataaaattagctaggcatgatggttcatgcctataatctcagctactcgggaagctgaggcaggagaatagcttgaacccaggaggcggaggttgcagtaagctgagatcacgccactgcactccagcctgggcaacaagagtgaaactccgtctccaaaaaaaaaaaaaaaaaaaaaaaaaaaaagtatatgtttgggatccataaaatttttaataagatcaataagatcattgagcatgcataagaaggacaagataaacctggaaagttaggttgctatgggttactaaaggccttgcataccagactaagaggctgagttttttttctctagttaacaggaaactattcagtagtttgtgtttgtgtgtgtgtgtgtgtgtgtgtgtgtgtatgtatgtatgtatgtgtgcttatttggtttggttttccaaaccaggttttgacataagaacatcagttttcagaaggttatcccttcagttcttcctttctcctcaacttcattcatcttcctagaacttgaactcagctgctgcagtcatcacaaaataacttggttaatataaatttgaggaaaatgcctgtctgattccagcatgaatggtaggacaggtctgataatgttgtgactccagtaaacactgcataatgacatagccattccatccaacagtagttgtgtgctcagtaattcatcttattgtatacggttcctctcctagtccactgttactctgagcttataggaatctttcctcacgctaagcagttacataatttagattccaaatggtttcgatttatactccagatctgagttcaaatctaaattgttagactatttatagtttattttttattttgtaaggaatatgaaaagccaggactgtgtaaacaaaagaaatgtggcagtcttaataaggcataaccataaaacagatgtcatgagggtaaagctccctttaaaacattttgatagtatgttttctctgatttaacaggtttggaccaaaaatctagcatggaatctgattcattctttctgttaacttccactgcgtagatgtctgagacatctatttcattggctcagtaaatattaatgaacggactgatacaaagatgatatgccaggccttgagaatgcaatggtgccaaaaggaggcattgtgttagcactcaggaagcttacaatctgagatcttaggtaaaccaaattaatagactgataccatgtatgaataactgaaaaaaaaactgtacataaaccaggctatttttataacacatatctccttattaggaaacacttttgctataccaaaaaattagaatatatacaaatattaatgcctccagctataagaaataaatattactaggcctttggagttcagtgatatggctaagaagaccacaaaccactgagaatacttgcagacagtcacagactattttacacgtcccatcgcatcaccaccatgggttcatttgaactttccagtccttcatctcagttcttcatttaggaaacagagtgacagtaattatgtgatcactgccaacatacgagcagcattgtcgggggagaaatgttgctttggggtcagacacatctcagttcaaatcctggctttgccactgtgtgacccttaggcaagtctcttgatgatctctgaactttcatttcctcatgtgtgaaatgaggcagagatggaaatggtagcacgattgcaactcatgatactgatagtggagtgttctagagagtcctttcttttggtaattgtaaatggaagtgaccagaacttgccaactggctgaaatagatacaaaatattcagcttttccaaatgtttcttttttctatgtttggtctttataaatggaagtatacctaaaatatgctagagagcttggtcaaggaatatgctttatagagtttatcagctaaaagggatagtataagaaataatatgaactagtatatcatttaagaattgaacatattttgagggttagcattgtctgttttggggtgagtgaataacactgtcacagagtgtacaataaaacaaaacagcaaggagtaaatgactcatggaatacatccatgaaacagaaactgaatttagtaagtactagatattagcatctagtgattgatgtcactaagattacatcaaattcctgtgtactctgctcctggagaatacaagacaggtgacagatttcttaggaaatgcttttcctaatgccttttttttttcttttcatcagacctttgtcttttttcaagtatgagtttactttttagccagtgttacaatatctctatttgtaggtagacagatgggggataggaaatgaggaatgatgtctggctctttaattaaagacacagagccagagtttgctcttcaagcttgttggcaaggcacatacgcacacgtgcacatacacacacatacacacacaaagtgcatctgatagatgaagccaaatttgtaaaattgtatccacaatcatagtttctatggtaactgtatcttaggcccagacacaaacagagctggcaggagatgtctgattttattttctgctaagacaatcataacagagacagttcaggttattaagatgccatagcccagtgtacatgcagctagtacttggatggtgctaccataagatttcatgcttaaatcccaataaatactttataatttcataatttgcaggttgcttttctctgtcattctgctataaaatcatcatgtgcctgcacacagttactatattaatgaggtgttagtggtcaacataaatgtggaaatgatgcaagataacttttataaatgtgcacaggttagaagggacttccaggatgtctgttttaaccctgacatgttgcaaggaaggaaaatgtaggcacagtgtggttaaaagacttatccaagagttccttttaaaatattttatttgctgtattttttaaactagcagatgttctagactagtctataagctgaatacccagttatttcacaaaattactgaaatcaaattgtggaaaacaaacacttcagaaacaatagtttgaatgagtgtgtgttctttcgcctctctggatggcatatttgtaaatacgtagctcaggcatattataccacatattgctgaagatgaataattaaacatcctattttgatgagtttcattttgtttaaatagagcatttcccttagttcccctagaaacatatagcattttagcaaaagtcttaatattagaagatgctgaaagccaagtttataacttttagaagtttttattgtgttgattcctttaaacatcttccagccaaatctgtaactaggtaagagcaatggaattagaagaaagcttttggaaatgtggaacacttctccaaaatatctgtcatgataccaacttgaaatgaaaggcacatttcctaaaatggcatctaaatttttatactttgcatcttaatcttatgatgtgtctggcagcatgaaactcatttttttgtaatggatctaagtaagacatatttgtaaatgaggatgttatatataggtgaataagccgtattgcaactttgcttggcctctccatcacagcagctttttaatttcctcaggaaaattggcttggaggacataaattacaagattggcaaaaaatgtgtcctaacctatagaaactggaaaacatgttaattttgaattgtttccgcttttcatcagcagacatttgcagaaaaatcttgtgtaatttattcttttattttcaatgaattgttaaaaaatgtttgaaaaggcattatatcttctcctctgccattaatctacaaatggggaatattgggaggttaaatggcctctttaggatattgctttatgaaactgctgattctagcaatgccaggctagaaatacatactaatttaaggaaccatgaatgtaagcagcaagctctttgcttttgtaaagaaaagactaatagctttattttaacaaggctcctaacaccccagccggcagcaggcattgagtgaatgaaactgggagaactcccatggactaaaagcaccttaattcaacattccttccaaacaccaagccctcctgataggcttgtcacaggctgtcataatccagccaaagagggtcaccacgtgcaaggcgcaccaaggtatgagcgctttaaattgttttgaataagctctctgaagtttcacttcctgagctatatcagtaaaggaaagataaatatgccccaaatccaggcgtaagttctaacgttacactgttgtgtaaaaggctagatttctgttatggcttaagtcaagattgtttctgtcagacatatatttaggtcactacattaaaaagaaaaaaaaaacctgcatgataccaagtaagataaagggatttaaaaaaaattaattggattgaagctgctgaccttatttttttgtgatgaggaaaattacctaataaggagttcttcaagcaggaatatttctgagccttgttgagcacagagaaaaatgagaagtgagcttataaatgcctgtgtctcttttctctccctcactccctcttcaagtcatcttacttcctaaggacttaaccacaacttcttaaaattggcttccctttagcaaccctctatctgcaatttcctatcctctatttgcagctcttgtaagaatatttgtacccaacacactaatctatattgccaccatttctaaccgagtattaaaaattgatcaaattataggagattacatgaattatgatttctccatataatgggatattatatagccattaaaaatcatgttttaaaatatatccaatagcatacaaaattgtcaataataaacagatgagaaaacagctctatatgccattaaaatatgtatgtgtttataaatgttaacagaggtcattttggggtggttttccacaataatcatttaatggagaaaaaaatgattaaatctgtttttttggataatggaacagaaatgtatccccaccattttcattaactaacattgtatccctgagggagaggactttttctcatctctatgtcttatggtacttcacatgttactctacctaggagacactaatacatgtttacatatttgaaagtattaatcccattccataagcatgacagcataagacagtacaatcagtgtttatttattagaaaactagaaaggttttcagcaccagagagtctggctttctctccccatcaatccaccgaaatcactctcaataaaccaccaatcaccatctcattgccgattccaaacaatatttttgcagactttatagtggtctctgttcagttgtagagagcaacatccactgtagcttaagaaagaataaatttattataccatagtaatgagcttatagaaccataagggatgttaaagaaaaaacttcttggataagctttcaggaatgatttttccaagccacactccagaactgagctactgggggagctgttgctatttctatgtaggaagttttagactgcagagccacacaatgctcatatcaggagccaccatgattaggaagatgccacaatcagaaagccacctctcctgccaccaattctaagaccaactataaaagttacatttcactccccaaactagcaatgttacagctgctaaagctgccacaggaaaaccaagcatacctctcatttagtcagtcttgccataataaacagcggaagtatggccactgcctcaattctattttccaaatgttatggcctaacttaaatcatgccagtacattggctgcaagggaatccagagaaaggtagtttttagctttccaggctctggaattgaaggtgacactctacaagaagggtggattggatgaagtgcactaacacacagtccctgtcttactgaagcttttcactgttttggcactgtggaacactcccttcatggaattcttttcttggtttctacaataaaacattttcctggttttcttctgaaccaactactttttctcagacttcctcctgggttcagtgtttttggcctgccctttaaatgatggtgttcctaagaatagtattagtgttcctctctcttctcatttgtcttttcttttatttggtccctacagactcttcctgggcattcttttccaagctttctggtaccatctgtatgctgaacgtttcccaatactacatctctagtccagacttctctaagttgcaaaccattatactcaacgatcagacatctccattgacatgtctcaagtcagtttaacatgtctagatattccctcctcccacctctactccaaaatctgtccttcatttattcctgttttggtgagtattaccaaaaccatgtagttgctgagctcagaaacttgggcattattctaaatacctcactccctttaatccacagtcaatcctattgctcttacctctttgaaatcctaatgacactctcttgtcttcatcctttgaaaaaccctcaggtttatgctcttacaatctctggctcagacctttgctgaactctccaagttatggtaagaataatcttaaaaactataaattcccaggagataaaatacaagaaaatctagatgacctagggtttgatggtgatttttttgatataagaccaaaggcatgatctgtgaaagataaaattaatacgttgaactttattaaaattaaaaaatgttgctctgtggaagacactgccaagagaatgaggagagaagctacagattgggagaaaaacgtttgcaaaacacacatctgataatgaagtatccaaaatacagaaagaaatcttaaaactcaacaagaaaacaacctaaataaaaaaatgggccaaagacctcaatggatccctcaccaaagaagcaaagaagatatacatatggcaaataagactgtgaaaagatgttctacatcacatgtcatcaaggaaatggcaaaacagcaatgagatatgactacacacctattagaatggctacaattgggaacactgaccacaccaaatgctgacaaggaagtggaacacggggaactctcattcaccaggaactctcatttgttgaattctggtgggaattcaaaatggtatcactactttagaagacaatttggtggtttcttgcgaaactaaacatagtctcaccatatgatccagcaatcgccttccttagtatttacccaaaggagttgaaaactgacatccacacaaaaacctgcacataaatgtttacgtctttattcataattgccaaaatttggaggcaactaagatgtattttagtaggtgaatgactaaataaactgtgctacatctggaccctggaatattacttagccttggaaagaaatgagctatcaagccatgaaaaagcatggagcaaacttaaatgcatatgaccaagtaaaagaagccaatctgaaaagactgcgtactgtgtgataccaactatatgacactctggaattgactatgaaaagagtaaaaagatcattggttaccaggacctgggggaaggagtgatgaataggcagagcacttaagatgtttagggccatgaaaattctctgtatggtacagaaatgatgaatacatgccattatacatttgtccaaacccatagaatgagtaacacctagagagagccctaatgtaaactatgggctatgagtgattataatgtgtcaatgtaagttaatgagttgtaacagttgtagcacactggtgggcatgcgggtaatgaaggaggttatgcatgtgtaggggtgggactatatggaaatctgtatgccgcctaaatttttttgtgaacctaaaactgctctaaaaactagtttctttttaaaaattgcagtggtggtggtaacagcaatagccacagtaggagcaacagtagtatagttgctagttagtagtattcttttcttcataccttgtttctacctttgcaaaatcttcaaattccctgaagacacagtgctttcgatatgcctccatggtttttcacttttgtgctctttacttgaatggcttatcctactactcctacacccttctgccccagaaaaactcctcctcatccatattcaggtttgagatgacgcttcaacacccgtatgacgctgtcttcaactctcccaggtggactttggaatttcttcctgcggactcccactgcctccttcctcagacttccacagtgatctcattgtaccacaattgtttgcaggcctgtttccatgaggagacccgctggatttcttcattgctttgaatacagtgaatgactgcattaatgatgttgcagtatcaatggagaaacatacaaagatatacacaattagtgaaggacagaataatttcttatgtgcaagcttgctgcctatcttttgaagactggcccaagttctggtacttccatgaagtttttcctgacacctccaggcctcacctgtgctactgctgataacatcctgaatggcacttgaaaatacattatcctatttcattctttggttatttcagtttgaatgctgttttcccaacaagacagaaaatcccttaagaataaggatcaccttacatttcatacaatcttatatgctgttgggtatatttcataggtgtgtgtatgtatactatatataaatacatatatgtatatacatgcaaatatacaaatatatgcatatttatatgtatatatgtatattttatgtatatttgaatattttatatgtatatttgtatgtatatatgtatatttgtatgtatatatacataatcatgttataaatacatataattatgtgtgtgtgtgtgtgtgtatatatatatgtgtatatatatatatatatatatacacacacacacacacacacacacacataatctgttcctcgaggcaccagaacagtaacaggcatgtggtctcctcaaggcaacagaatactgactgctattatcattatgccaggacagttctggataacggtgctgaaactattaacttggaattttatagctacaagaaaaagttcagttggaatatccagagctatactatggatacataagcatagtgattttccaacaatcacaattaataaccttcagcatagtattgatatttgcaggaattctctttccataagaaatagtttaaaaacacaagaaagcaaaccttaggtaggaatgggtgaggacaatgtttctgtccttcacttcttccttttcttttttttttttttatcccctgtctgtcaccatccttgcctctggttttggtagaaagttcagaaatttaaaccaaggcttttatcctactgcagagaattctcaatctctctgtctgtgattgctttaaagatgtgaagtcttcgtccctacctacgtagtagctcactggactcttgccctctcagataaccccagtgtctcctgttccacctattgatgaaatataaagaggttttataggacacactctaaaggtcctcccacaataattaaacaccaagaatagtctttcttaatctaagtgcaagtgtatacttgttttgcaacatctctccccatatccccaaccccatatacacagtctgcacaagctgggatggaatggtagttttatggagagccgggacttttggtaagaagaaaataacttccaggtggttgattaccgcctagaaaaattttccctactgaccttgacactgttagttccttcctgtgcttactggcaaaatctcttccttcccacctgatagtccaagttttctatttactccttccatgcccatgtgtgagggatatccaagagcaaaaggaagcacatgagtggtccatgtgataccaagtgcgttgaggtgaacaggtggggaatcaatcagtaatcaagtacttttaaatacgtgttacgtgttcatcctgtttttagttggcatgatagctacagaacaatgagatacaatatcttgtcattaagaaaccaacacacagtattgaaaacctactggggccagtcactgccctttaggatttcagaggctgatggaaaagactccaagagaggtaaacacaggacgtacagaggaagggacaaaaacagtaaagaccaacactagatagaaaacagttcatcacttatgggtggccattcgtaagagagagaactgaggttcagggtggtcggggggcatcatggatgctgtggagtagacagttgattgtcagcaacccttgttagtaaagaaaggttttatagaaaaggtgcttttatttatttgtttatttatttatttattttgagacaaagtctcactatgtcagccaaactggagtgcagtggcgtgatgtgggctcactgcaacctctgcctcccgggttcaagtgattctcctgcctcagcctcctgagtaactgggactacaggcgtgcaccaccacacccggctaatttttgtatcttcagcagagatggggtttcactatgttggccagtctggtctcagactccagacctcaggcaatccacccgcctcttgacctccgaacaaagtgctgggattgcaggcatgagccaccgaacccagccagaaacggtgcttttaaaaatatggtcttttcacagccaagaagagctataatggcgtgaaaactaaatgtaacatactggatgggatccagggacagaaaaatagcattagttaaaaatctaaataaactatagactttagttaacaataatgtatcaatatggattaattgtaagaaatgtgccatactaacgttagctagcgataagagggaaactgggtacaggatgtatgggaagtctctatactacctgttcaatgtttctgtaaacctaaaactattctaaaaactaaagtcggttttaaaaaaagaagaagaagaagaagaagaaaatagtctagcatcctacagaatattcctggcatggggacatgagggagtcagtttgacagtgacccttttttgaaagaagtgactttgttgttaaatgccatgtttgtggcttgatcatcaattcctatagcaatgtggagttcttgcttgcttttccatggttgatttttggcaggcagtaacagcatttgtgcactgattataatttcgagatgcattgtcagtaaccaaggtgtataatggatcttcatctctaattgcttttctctccacaggtgcctggaaggggtccagatgggaatgcacacaacctccgctttgaagggatggagaggcagtacgcatccttacccaggtagatcacggagaggtctcccatctccagctcacctacaaatgaagtctttagagaagtctacatgaaatagaaattctggctttgaaatagggaatatgttataattttgccttgctgccgtctgctgtagccctagttccatcttcacaaatgtgctaataattgaaacacttgtgggttatttttaaggggagaaaatagtatatcattgcaattgaacgtgtcagcaagaacattggatactaaatggaaatcctaagccattgctataaaactggtatcgaacatcccgcaccaagcttagagacaatcaaatagtaaatcctctgtcctaggagttacgcacgaggaatggcgggccagtcttaagcttggagtttcatgtgggtgttaagaagcaggaaagaaatgtgaacttaggaaggtgttctttgcctgatttagaatctgaccttgttctcaaggcaataagcaaatattgctgagaggcacagacccaacgggggaaagaaacaactgcatgggaaaagtttgctgggccaccctggcctgacatgatccactcatactgtaactcaacacccttgaaaatgagatacaattctcaaaacttgtgctgttattggtgagatgaagaggaattttagtttgctatcagtagcacatgacaaagaaacagcttttccaagagtacatgcagtccagctacgattggagttaggtgaggtgagagtatgagaattaatgcatccaaaagagaaacaaagtaaggttaatgccacgcagaaagttgcagtgttttcaaatattgccttttaaaggggtgggggaaagaccccaagcagagtttttttatcaaaactgagctgttaaagtgccaactcagagatggagtgactgtttgacattgtatgttgactgtacctctgtgtgattttacaaaacaaacaccctgaacattacaatgggcaaagccaaagtgaccatctgcttttataaatagtatgttattttcaaaagtaataaaatctgaaatctagcagagaagctgttttgtcctgattaggcaggacacccaaaatacaatattttaaaacttttataaagttatattttatttatcttcctgttttcttttctttaatagatgttgtctaataagtttttcttatttgtgattagcttcctgtttctattttccttggcttagtacaactggccctcagtatctatgggtttcacatccatggattcgatcaatctcagatcgaaaatatccaagaaaacaaagacagtcacaatggtactgattatgtacaaactttttttccatgtcattattccctaaacagcacagtataacaactatttgcatagtctttacattgtactcagtattataagtaatctagggatgatataacgtgtatgggaagatgtgcataggttatatactaatacgattccattttatatcaaggacttgagcatctgtggattctggtatctgaggtcgggggctggggtgcgggaggtgcagtcctggaaccattcccccaaggaatggggaatcatccccaagggacagttacattttgtttcattttaaaaatggaggcagtttccaaaaatttgttttacatataagatttccggctttcactgttgaagtatatggaaattgtggttaaggcagatggaaaatagaatgttcttatgagagggagtaaaaaaaggaaaactggaaacagtttaaaatcttcctgaccaatctgcactcagagtgcagaaatggagtgtttgggtacaattcagaggcacagaaatagcatttaaaattctataaatttcactcattcattcattcattcaccttgtatctggtgatcacctagtatgtaccaggccctgagaatatggaaactggaggcacagtcccagtccatcctcaggactctactgttagcaaaggagtcaagcaaatcagccttttacagtagtacaaccaatgcttctgtttgtaattattaaagtcttctgaatttccaactcttgtttattttcgctaatccccgaaatactcactcatggctgactctaaacaagtatattttaggattaaacactgtggtgggggttttctgtcaaagataatacatttatgctgtttatggctctttatgaatgtatgaattgacaaaatcccgccagccccagaataaaactgtagctgaaagggaagcatctcaaactggaaataattctggcaaaaagttcactcacccacgtacacaatggtaagagcaattagttgcatgtgcaaacagacctttgcagctacctggcaaccagaggcagccatggtggagaataaatagggctcagataaatgcaagggggacccctggcagtggcttttaaatggggatgctgcatcccaacatctaaagaggagatgcaaagctccctcccaggcattgcaccctggtccatgggtggggggctccaaattaaactaatgagatgcagaaagcagaggccagagacgtactgctggcttctgaaaaggtatgcagatgctgctctgagtgccagtgacatttaccctggttttcttgtctttccccctggagattttgctgtccacttaattgaatcacgccagctccaccgctgtctccttttgccaggagagtgaggcgagcacatctcggtaggcaccggatccctcttcatcacagaggccgggagctttgaaatatttatggagttaaatttttaattaaaaacaggaataaatccatctgtaggaagtcggtggccaaccttatggagaacttaatatgctactgactgattgggttcctatgttgtttgtgcaatgcttcacagtagtttttaggaacaattcaataacattgatttctatgccaaatttggagccatcgacacagagagaaaatgctccacagcacatggagtaggtgaggagctctggtcaagtgctttcatggaactcggtcatctttaaagcaggcccatgcagcccactgccaggctaaatgacatttcacgaaataaagccagagcgctggccagcacaggaaaaagacaattcccagcacttggtagttatgaggttgcctaaggctaagggctaagccatgttaagtgttattgttaagcaatgttaaatctcctgcctcctaagaaaaatgactttacttcttttctcctgagggtgctgttttggaaagcggagtgtggttgtaatacaacctcgttagtaaacaccagacctgtaccagggccaatgttttaccagcctcaacagcccccagttttcttggtagtaaacagaatgaaatcagcattcctttattcttgcctgacaccctaggtgagtagggaagtggctgtttcctaggctgctatgatgtgcgaacatcaacgtatgtgtttttgcaaacggctcctttttcactccagcctgccagccgctcgcaattctcccaggtcccattctgatttcgcaggcctccttgtggtcagtcccttcagcactgaactctccactcttcccatctcaagcctccatcattcccacctggcccatccctggccccatgggatcccattatccccctctctgcagatggctctgtgcatcggcgcatgatattgctcttccggacttagaatcaagtgtggagtcctagggagtgagcaaaaggcactgcagctcttctgtggtcctacatgcgtgggcggcaaaaggttgctggagagactcgtaaaactgcattcatgggttccactacaagattcacattatgcagcaccagctgggtcccttgctgccgtccagctttttttgtagtcatgttgtcaactcccctgactatcccacagtggccattccaaccctttctactcccgttaagttctacgaagatgactaaactccccaagcccagtctctggaggtgatctcacttcctttgctttatgaccttgaggcattcaacgttagcccctcaacttctgctcctgcagctcagagtcctgcatcttagctcacacacgcttcccaaggggatgcactgagggcctgagctcggagtcaggccatgattatagccccagtttcatcacttaccacctgtgtggccttgggcagtgatggaattgcttcaggctctgttttctaatctgcaaattggggatgatattagagcctcggtaatagtgccggtatgagtattaaatacaataatacaagcaaaaccctcagcgaagagcctgtgtagtgcattgaaggattttttattgttagctctttttttattttatctcaggggaagaaatgtgccttcctgtaatgaggcaaacccacacaccagagctcattttccctggcttcttggggaccttgagccaccaactaccctctctcggcagcatctttaatccttttggcgttgctttcctccccctgcctactatcatagatgcacaacttcaggggcacagtttgccaggatcccccactgtgtggagaagaggaagcagcacctgcatggggatatgctgggggaactcactgaagctgaaggattcgccgactcaggaaagaccagtggtctggatggtcaagtgcaagagaacatagcaatctactgtgatctgagtgataagctgagctaatggacatgatagtagacagcagtgctatggagagggggtttataacagatacagcatgctgacttggctctaggcaagaggccagggctcctgtccagcaagacttgggtgcaggagtaggcattgctccagtggtagaggccatacccagggcgagttaaccaggaaggtggagcatgatgctctagctcccagggcagacatggcatgacagcagcaccctattcgcaggtgggagagatccagagatactgctaagatactcctattatctcaggaccgggcagtgctgaacatgcaactaccagacttatacctgagcaggactcgtgtggcaggtctaccccattaaattgactcttgtatgtcagagaaaaacaaagacccttggctcaaccctccttttcccacatttcctaagaaaaagtgggctatacctgttggttctatttccactcaacccactcacactatagcctcttgccccaggcttctgcccacaccactgatacttccaccagactctgcttcccgccttttgctccacatggattctctctgtgccgtctcctccattcctgccaattcaatgcccgtctctatgatgattccaaaagtacctgcctaacattcatgtcccactcttgtgaccccgtttgatatactcctccttctgcctccaagacgcctccaagtccccctgccaaaacccatgccatcttcctttgctcttcttcttttaaacttccatagcatttacttagcaccttcccagtgccctaaaaacaccctgaattggattattctccactgcccctttccaccccattgaaatataaattccttgaaataagagactttgttttatacccatcatttgttacacccagaacctaacataaggccatgtatacagtagagtcttaatacattgctatacagatgagaatagtttttttggtttttgttttgtttcctctacccaggtggaggcctaagtatgggctccaccactggagcaatacctactcctgcacccaagtgttgctggatggtctgatctcatctgttgcccacgttggagtacagtggtacaatctcagctcactgcaacgtctgcctcccaggctcaagcattttccatcctcagcctccagagtagctgggactacaggcacgcaccacgatgcccagctaaattttgcatttttttgtaaagacaaggttttgccaagttgcccaggctggtctcgaactcctgagcttaaacaatcagcttgcctcagcctcccaaagtgccgggattataggcatgagccactatacctagccaagaatagattttctttatatacaaggaagttatgggaaagaaatcccccaaagcttttttgacagttggttttagattgctgttttgcaatataagaaatgatttttcatgaggatgtatcttttctctgaaatcaatagaagtccagacttttttttttttttttttttgagacagagtctcactctgttgcccaggctggagtgcagtggtgtgatctcggctcaccgcaacttccgcctcccaagttcaagcgattctcctgcctcagcctcccaagtagctaggattacaggcacgcaccaccatgcccggctaatttttgtatttttagtagagacgaggtttcaccatgttggccagggtggtcttgaacttctgacctcaagtgatccacccgtcttggcctcccaaagtgctaggattacaggcgtgagccaccgcacccagcccagatttctaaatagttcatccctagtgagcacttactatgtacaagacacagttctaaatgctttgcatctcctgactgacaatgctcacagcaaccctgtgactcagcagcaacctgataattatccccatttcatagggaaggtcacacgcagagagaggttaaataaacttgcccaagtccaacagctaaaatgtggcagagctgggtttttaacccaaacagtctggctgcgagtttgttcattttaaccaccttgactaaggttatgaagctcagagtttaatccatactctgcacctatcatattctgttatttgctcacctgtttgtatttcttactaaaatataagtgcctttaaggacagggactgtgtcttcttcatctttgtatatgacacagaacattcctaatatacaggttaagtaatgcctttcaaccgtctctgtaatgctgtcataaaaatcaattcttttttccgttcccttgggccctttgtttgaaatatgaacagtttagtgtgtaattgctagatgaacattaagcaatatactttgcctaccaaaaagagaatcctgttagaacactcctgagagttgaaaaaacagtgtctgcaaattggtactgtagttccttaagattagaaataatatctccctggaagaaaaaaggtgacagtaaatttcctggtggagtgctgcatgagcagtcctgtggagagaaagactccctttcctgaggctgatgagggacaaaggcctgcttgggccacgttcgcctccagtccttgatgtttctgtaatccatgttacataagttacttgggagaaaaaaaggtctctctgaatatctcaagcagctttcaacttggctgcgcaatgggaagcaatatactggagctgagtgtggatagaaagagcaactttagaaggagcaagcagctaatgcttgcttcctaggaacccataatgaatttgctttctaagtacattcccggtgtttccgcattgggtacgattgtgttcgtttcagaagaaatacgccataagagcatgcttccactttaatgtttcagttggttcattttattggtctcagtcttctcgtctacttatgcccatcaggaagagtccaatcacaagtgcgcaggtaactttgaaacttgcaacaagcatgctgtctactatctttggttatcccaaaagtattttgtctgggtgtcctcaacatccttttctgtcatttacctcacttcttaaagatgctctccctctcagatttctcttgttctcttctacaatgaacttctgcttcattcactgttactgaattttcctttgccggcattgcactattttattgtgctcactaagtcactggcggtgacattcaagttctgcagatttccagcaatgccacagtactgggcgttggctgaagctaatctagatagtaatccaaagagttcaatgaaaagttgagaatcagaacattaggtaaacaggtgtgtgagtgcttgtctgggtgtgggtagaggtttgactgtctgggtctgtaaaagctgacaaagtctccatgctgcccaacttctctgtacaacaagtacttctctgtgcgacaaggccagcttgtcaaataagatgcttcatgagcatatatgtactgctccccgcagtcatgccggcggttggaatgttctaccagagtttgagggtgtcacacttcatttattaatagacactgtgaatcatggccagtggctttgacacttccctggtggtgcaaccctatccgaagaaccttcctcactgtgaaaagctaccttgcagtgtttgtccctaagattgctgctctgactttgcaggaatactaagatgagctgaagaacttgtctaggtcatatcttccacatctgcatatgacggggtttactgccttttgaaaatcagtgaagctcttttaccccaccaaattaagctttttcatcctttctcttaaggttccctgtgctgaaaatctagtctctacttccccttcccagtaggatcagctgtctgtttgaatggccccctgataccacctcagtcttaaggccaaggacaaaatgatgaattagcagcgatttaattctttgtgagattaagatgtctccattgtcaactcaaacttcctgaaaatgcagaaagccccagcatgtaatatcactttaagatgccaaacagctgagatcagggggttaatgctactgccacctcatttttatgtcacttagttcctcagataaaagtccattttaatcaaacttttcatcatttcctcgtagccaatatatccttgatgccagttagaatatttgatattaattattcagtcaaaggcctccattatgagtttagttagaatattagtgatttaaaacatgttaagactcatacagtagtgatgtccccaaagtagttttaactgaatcttgatgaaccacatacattaaattctataggttttttactttttccctcattttccatagaaaattccaaactgctacacatttgttggctaagtactcttttgagaggaagagtatgtgcctgctctttcgagagtgccaaatctgacattaccttggacatgaaatctattaagcttggtaagctgacttgcatgttttccctcctgcacatattaaagggaattttagcatttatttcctacttctccagccaaaagaaaagaaggttgttttgtgcctaggcatctgcttagagtattgctctatatctcatttctcataatctttggtagttcttgatgttttcctatcttattgccattccaccatctgcctcctaatgctcattgccctggaattatggtggtgattttcttgataatgctgtaccgttttgcatgatgcacactgtctttctgcacctacctcctcctgtcttctctgactccagccatttgcactgtcccttgattcaagttcctgggtttgctgtgtataggtatcttagtatcaacctactatagacagagacattatgaataaatgaagtgtattaatttattataacatctgatttgtatgtttgtgaggcctgtgctttatgattatttaaaatgacattatatcactgaaatacataaccatcttggataaaaagttagtgcctcaccaaatgcatgaatacatgatattattcaacaggagtaattaacagtaaaatcactagtcttattttccatttttatataccaagatctgcatgcaaattgtttcaaagatgtcatgtttattcctaaactagttgattgtatttaaatagaaaataaaactaagaacaatcaaggcaagggagaggttgtaaaacctattgcgtgccttctatgtctgtacgttttgcatgccttgtctcattttatcctcactgtccagctggctaggagtcatatgatgctcctttaataaaagaaaaaaatgtatccttgaagtcacagaatcagaatcagaattcaaacccaggactctctggtttccaaggcctttttaatttcacttgaccccacatgactaacattggcaagtcaaggagaggttggaatgcttacatcatctgttttcataagtaatgtgagttcatgagatgggagatatcttagaccatatgaagaatagcccatgttcattgtgaacatcttttaaggttccagagaaaatagaaaatgtcaaaacctacgggttgtaaaaaaaaaaagtaataaaatacaagaaaatagtagggaatttatgggaaataaagaaaaacacttttgaatcacacactttttcttcttttatcactgtaagttttcccaaagtagaaacaagatacctgccttttccttacaattaccctgttcctgttgggaacatacacagagatgtgagtggcgccccctagggctgcacagaccatgtgcatggaccaggtccccagcccctagattgcactctgcaccactcctccacagaacactcagaacaaggcaaggggaaggagttaacatttgttgagcccgtattgtgctccaagaactctggcaagtactttaaatatgtcacctcatttatttcctgtaacaatcctgatataaatattatcatccctattttatggatgaagaaactgagactgggagatgcaaacaggtgtggctaagattgcacacagaactagtgacaggttttggagtcagttcagtattttctgcatctgaaatttctgggctttctgcagcatcaaggtgtctggtactaggctggttgtaaacaggtaggagagacacattacgtgaccatcctttcctgaggcagccctcactgctctgatcccaccctaaatcactgcagtgtatattaaaatgagcatttcaatggataaaccccttataggctttcagaatgactaagaacagcaaccactgaatcacagaactcctcttagcaaattcaaacacccacttccttccagccaaaatattttaaatggtgcttttttgcttaaagactgcctctgtgttatgctagtgagttaaatatatatacatataaaccagttggttccacttcagcaatttttgtagccaggaaactattgttggttctttcacagtgtagttctggcacatccttaggggacatggctgagacgcaaatgccagacaactgcggaagcatcgcttctactgactctgctgcttcaagtccagagaagagagctttggcagtcagttactatggtggtgccacccgagcccatctgtgccctggatctcatgtgacacaggccccacgacctcgatcattctgccaagaaacaccttggtccagctccattatttccagcaaaggcaaacatttgtggtacaaatgtgagaggggttggtacaaaaacagcagcctccagaacgtgttcctgcttctattccaagtctctcattaagcctagacagaagtgaccagggcttgtctcaccagagggttgccccactctgcaatcagaactgacccttatggccgaacatggaatgacatgttaaataggtaggaacctggcaattctcacgcgccattctccaccaacagtacactctgggacatcattagtaccctttcaacttggtcattgcttgaaagtgaagacagagtggtgactgcccagataagacttctgcccactaactgcttacatgtggctgaggcaaacacagacccttttccagaaatgatagtgtctgacagcccgggttttacaaggcactggaaagatctataattgttacagcagaggtttaagatggaaaataagcatgttgagctatttggagaaggaatttgccacagtgaagtttttttcctggaaacagtcatataaaatcaggatggagttggtatcaagcttcttggtcactttccattgatatgtcggtgcctttgacaatttatgttaaatgtgcaacaaacacccttttacagctttgtccaacatcaaaatcaggtccatatataagacagtttctagccagtgttttataggagtgatttctggatgtggtatctgtaatgtggccaagataatgtgaagactctgccttctgtgggtcggttatagacaagtcacttatgttaccatcttgtcaacaacttgaattcctcagtttgtcctttttctggttacttctttcttatccaattttttaaaaaatgaaacagttcagtcagagcaatgtgtgcaacttattagcctgaacagatgagctaggaaagtcatctactctccatattcctgcatttaacaactatttattcatgacctactaagtgcaatacactctgtaggccctgaggatagcgtgataagccccatagacacagtttctgtcctgtgaagtttatactctagtggagaagatagtaattcagcagtcacaaagaaaacataaaattgtaactctgcccattacaaaaaaaaaaaaaaaaaggagagatatgtgatccaagaaaatagaatgtgaaattgcaccaaatcaagaagggagggagacatgagttatgatctgaaggaggtttaagacaataaataaggaatattccagaaagagaacagcacacgcagaggccttgtgtaggagaacacgtaatgaacagactgaaagaaaggtgtgtgactggaacaaagactgtgggagttgagcaggaaagggaggtagcagtcagaccatgagtggtcaagtgaaggacatctgaacttactcaaagactagaaacctttgcggggttttaagcagaaagatgatatggttggatttgtgatccagaatgtttgtctagctgcaaggtagagaattgttaggagagatgctggagtgaagcagaccagttagaggattttgctgtcattccagggacagatgttgatagtatgtaccagggtgatggtgatgaaagcagaatcggagagaagtgggaggagctgatgaaccttgatgatggattgcatgtgggggtttgaagggtaagtgaagccaggtgttaagaatggatccacacacagcagcatgggtgctggtcccacttcccaggagacaaggcaaagagaggactaggtttggcagggagagatcatggttaagctttgggacatgttagatttgaggtacctttcagacttccaaaaggagaccactgaaatgtgccctagagatgtctcgacatggatgggaattgcaatggctgatccaggatattaagcaaatgtgtattcatgaaaactgagcaaaagaccccagggcatatcaggggtgatgatgtaataaaccacagagtcgcatactcagaaagtacaaataaaggcaggtcgacagtgcagactgcaaaaacctgggcatccttctgtggctgtgacatgccttcactgcttagatcgacagcaaaggcttatctatcactgtctttgtaatttcattctggaaataatatttttctcaagtaggaagaattggtgacttaatgtcatctggcattctgtgactaagcgtagctctgactccatgaagcataaggatgagggtaagaagaaacggtggaaactgttttgatatctgtactgagcttataaaacagaataaatttgttcagaaatatgcactaaaatattaaagggtaaagaggaacaagtatccaatttactctcaaatggctcaggaagtatcagtgtgtatatttaataatatgtatgtatgtatagagagagaaagagggaggatagagaggaagggaacagaatggaaaaaaataatgaatgggacaaaatgtaaagaattgatgaatttggataaagaatatagaacattccttgttttttttttttttttttttttttttttgagatggagtcttgctctgtcgcccaggatggagtgcagtggcacgatctcggctcactgcaagctccgcctcccaggttcacaccattctcctgcctcagcctcccaagtagctgggactacaggtgcctgccaccatgcccggttaattttttttttttttgtatttttagtggagacagggtttcaccatgttagccaggatggtctcgatctcctgacctcatgatccacccgcctcggcctcccaaagtgctgggattacaggcatgagccaccgcgcccggcctgtactagtgttgtactagcaataacagtaacaaggaatagtggacattctcataattttccagtatcaattcaaaagtttaaaaagtcctcattttggtgtcctaggcagggcttctccccacccccgagaagaagactctgagacagggatttgagagcaagtgattttatttgagaagcgatcccaggaagcattggaagcggagtgaggaaggaaaaggaagaaagccagtacagagcacattaatgaacagattaccactgcaggcaagagggaaggagggctggggtcttctggagatggtagggaagacactcacaccttgccccacctgggggcaagcatgttgaggtacttaacttttggtcccatttgtcattggttaagagttgttcctaagatatcaactccccagcacttcttcctgtccagtgcactggtaacagaagcctcaagccaggcagcacagatgcttggataaggaccgtagtggacagaagtgctgcagtgatgggggtgtgggggcagtctgctgccacaactaaggaagtgtgaaggctcagggttcaaagcagatcagttgtggttgcctttcgtgagagaaaacatatgagattagtaagatgccccagacaatcctgatgccttcactttattattggagtaggtgctctgtgaattggtcatgtcttgtacggaacacagtgaatgccaatagcaccaacagagcaacccaagagaataactctagaagaagatacttccagtttctctttgtttcactcaaatatgcaatacatcaaaatgatgtaaggtctttgacaagttcattttctgtcaagcccatgctcagaacatcactgaaatacagcagcacctctgggacactcctgggattaggaaagcctctggaaaaattaaacttggtactgagttgcctgactcaaaaatgcccattaatgaacaatgatggtttgagtgtgtgctgtggctttacctaggatcgtggctatacacacaggcgaggtaaagttctacatggatttcaacatgtcatctttgcttcaattatgaacaataaaaacttggccaaactcagggattcgtcagatggccctggtcgtgtgtcttccatggtctccacagtctcaccttagcctcaggccttcatgctaagacactagcgctgtatctatgaagcctgtaaaactggatcagtcacatccagttcaattaagatgcttaggctcaccttcttagaacaaaaagtatgtgtcataagtcaaacaggctacaggataaattcctagcatgtaattaccaggtcaaagaatgtgaatatttttaaagtttctgatgtatattgccagattgacctccaaaaaggttgtaccaatttacacccccaccagcactgactataaatcatttttgaaaacctatgtcaatttaataggttaaaaagtaacgattatgatcacaaactgttttaatttgtaattcgtttactctcagcgaggtttaatttttctcatgtttattagaatcctttttttttttagtttgttgtagcttatctgtttgcatgtcatttctgtctaggtgtttatctctgtcttcttgatttcctagagcccttcatatattaagggcattaacactttgacatatttaaaattattttagtttaacttaagctatctttatggtaatataaatctataatttttatatgttaaatctttcatcttttgccttataattttttgcttttatatgcaaaaggttatctctcattatgaaatatccatactttcttctaattatttgattattttggcacttctacagcaggaatgctttgaacatccatgtcattttaagtagtaatgtgattttgtaatatagtttcaagcaatatcaactgactgtgatattgttataactaaaaaacacatggtggtctagacacccatgctgaatggctttagacaaatattgtggaagatgtctgtgtagttcattggcacatgtcaaccagaatcaatttacatcttgctctcactgatattatgccctatgtcaggatactaagtgtcctgaagcattctgacctgtgttcttggaatgtgatacaacaccaggtattcagtgttctgggaatagtcaagatcatccaattgggcttttttctcaaaatggtacttcttcttgcaaaatatatgctcttctccttgatgctctgccagctgctggaagcctctgccgtgttagcaaggcatgcctgttgaactgacacacacacccctcatctcctagagcatgccttcctgtgttcctcagatctaggtgatcagaactctaagcatgctcctcagagaaaccatgtataacattgggagttgccttttaatttctatgataaaaagatgcagttttgctggaaggagacttgtcctgagattgtgtgtcaatttggctaagccgaaaggaactatgagaggagcggttcttaatctgggatctgtgcatatctaaattgacagtgattagtttcaagggaccctcaaattctctgaagttacatgccagtttatgaataatattttgtacatattcctgggggaaagggtgagtgagaattttgtaacccaataaaatgaaaactgactgaattaagggattcactgtaaacccttcttaaaggggtcattttttaaatcctcacattatagttcctatgtgactggtattttcttcacagaatagcaatgccttcacagagattatttcattcgtaaaaacttatgagaagaaaatacccatacagtagtttattgtgtgaagggtatcttcaatatcagagtgaatttaatagttttcgcaagaaaccttattatggtctaactttcagctccacacagcacagtgtgtatatatatttccattctggatgctgccttttggtctgcttttaaagagaacaaaaccttcccagcatagaaatcccacaaagcaggttgaatggcatcaaactcatcctcctcgctcccacccattgcaccacaatgtgaaatacagaacctggttaagctttagagaccagacgtatgtgttcacccgtgctacctaaagaaggatttacacattctgctatcttcccagctttggaaaaataacatcctgttctcatccgcagaaagtagagagggagaggaggcactcgtgagaataagcagacaacaaccttcatcacagccaaaagtactatgctgatcccaccataaattatagcagcataaaaccacaggaaatccaaaggaagtaaaatattaatattaaaccatagccactccaccatatataatttagataaataatccattttctatatgtaggatattggaatatagctgttcgtctgccactagcaacagttgatatttgaaaagcatagagactttagctgctggtggagggcaaatgtgttttattcattcttattcttaacagccaaatgtcctcaaataaaatactgatcaatggctaaaaatttaaaggccgctatatctttgtctcataatatggatttgtggcctaatctagccctttcttgacctttttgcctaatggtgggatattaataagcgaaagatggttacataaaacatcctctgcatgtgaaattttttttacatatgagtaacttcaggtggctgaagatggaatgagctaacctgaaagtaacaagctgctcactgtcttggccaaattaggcttaatgctgaaaggcattcttacttaagaagtcaagaaggccgggggtcaagccgtcaggccacggagtgcagctgttggaccaccttttgcagtctccaagggagcaagcaaagaaaatccagcaaagaaaatatctcaaagaatcaacagggagagtaaaacaaaaataaccagatgtcccagaagactctgttggtattatgaagaaggctagagcaggactaacagggtttggcttttatcaaccttactaataaaagtcacttggctctccatcgagaagagcagttggtacaatatggaaaggttttaaagaccattaatttcttgaaatgaaacagctggccttattggctattaaataatgagccagattctccccagtgcctaagtcactctctggcagtaaattaggcatttagggaggcacattaactctttaagaagattagagttcgatttagtgcactttatgcataggaagaaagttacagggaatctggctgaagctgggcagagaaaagatggagacaaggtagactcagatgaaagaaactaaacacatgatttgtgttaactgggcagctcaggtgagcatgggaaattggagcagtcgagctgtggagttattttgtttattgttctgaagttctatgagcatgaaggtagagagttgagtcttcatttattgattcattcattcagtaaacttttacataaatactactatatagccagcactgaggaagtattcttccataaaacacagttcttatctctagggattttcagtctctggtaccttgggaagagagtagaagaatgacaaattatagattatttcagtcaagtagaataagtgctaaaattttatatgcataaatggaatttgaagaagtggcaagatgtgtagcactttatacaacacgctagggactttgactctacccagaaggcctcaggcccttgaaggtgtttaaagaaagaaatggtttaatcagatttgcactgtagagaaagccccttgataatttcatggaaaataaattggagagacaggccgggtgcggtggtgcacgcctgtaatcccagcactttgggaggccaaggcaggcggattgcctgagctcaggagtttgagaccaccccaaacaacatggtgaaacctcatctctactaaaatacaaaaaattagccgggcatagtggtgggcacctgtagtcccagttactcgggaggctgagggaggagaattgcttgaacccagaaggtggaggttgcagtgagctgagatcatgccattgcactccagcctggacaacagagggagaaccccatctcctaaataaataaattggagagacaagactacaatcaggaagggcattgtgaaactgtttatgtggtccctacaaaagatgctgaaagcctgaaatgaggacataagtgggtgtattagtccattttcatgctgctaataaaataatacccaagactgggtaatttataaaggaaagaggtttaattgactcacagttcagcatggctagggaggcctcaggaaacttacagtcatggtagaggggaagcaaacagatccttcttcacatggcagcagcaagaagtgaagagcgaagcaggagaaaagccccttataaaaccatcagatctcatgagaactcactcactatcacaagaacagcacggaggtaaccacccccatgattcgactacctcccaccggttccctaccatgacgtggggattatggaaactatagttcaagatgagatttgggtggggacatacaaccaagccatatcagtggggaagggcaggaagggaagagaggcctgtgaaggagctgagctgacctgtttgatgcctgattagatgtgggcatcaagagaaagactggtgccagagaaaactctggagccaggctggaacaactgggtggctggaggtgccattctcctcatagatgaggaaggatgggtgtaaggctgggtggaaaggcagagtggtgacaattctgggctccagagcatggttccaatggatggcacatagagaactcaaagtcatccatggcaaccacctcatgagatttgaaaagtatgtatgaaaaggaaactgagattttaagactacataattcctagaatttaaactgaatccttggaagagtattttgctttgtttgatttttgtgccaaaggaaaagatttcaaagatgcaggtgcctccaaactgaggttctatcattgatcaccatcaagagtattaaattgatgggaaacaaactggaaatagtcatctctttaaaaagccaacttttttttacaaggaatatctatagttaataaaacatcgatcattgatatgaatatcaggaaatttatactctttgtgagaagtagaaaactgcacaggttgcagactagacaagttaacagttctttctctgtcggcacttaaaatccataccgtggcttctctctatggtatggagtgaaacgtgccaacaaattgacttagatgatgtcagtatctgaaaatatggaagaaattatatattggaggaaaaagaagaaatccttatatattaaaaggtgttgacagcttcaccgcagaatagcaaaaatgtccttaaagataaaacacttatttcaaaattttagaaaccacaattacagttttatatactatgtgcagcaaaagtcatttttagaaagaacattgaaatcaaagtttactaaaccagtaaccttgtggcaacttcctggtgagaacctcattcttcaggaatgtgaaaagcataaaattaaaagagtcgaaagtttgtagattgcctaaacataatttaccacaggcagacaacgaacaagacaaaacatgtcacttaatattatttgcaagtcaagatgtcatcctggtgccagttgcatcatggtttcaggaagagatttccaggtagatggccatgaactatgccatctatgctacgccatctgtgtggctatgcccatgtaagcattgttatccacgggctgcagctggacgtgtttgttaacaggtttccaccatacaccatagtgacaatggctcctctagaataattccggaaagatctataccaacagcgcttgtttgtgtcatttctagcagtaaaacccccgttttctagcatttacaggaatcaataaagactcactgacttagcactccagtgggggggcaacttcacttcattgtaacatgctgcctgaacatttagcaggagacaaagcccttcccttcacagttaaagagttcaaaaatgagaattcctgggctaagatgcatgtgagaatatcttattcttttctgtgttgacaaggagatggggaaagaaggtaaggagacatggggacttatagaagctgcaatggggaagtcactgaggagtaaaaaaaaaaaaaaaaaagaaagaaagaaagaagtcataccaaagacagaatttacagactagaagcctacaagctgtggcttcatctgtcctccacagaaaggttcatcgtatcctttgtcagggacccatctcataagctcccttactggatgaggagagaaagccattgctctagcaaagcaaggcatgatccacatcaaaatacattatatacacatttaaatagacacacacacacacacacacacacacacacgcgtacactatatataaaaatatattttcatgtaaggtatatatatattatacacacacatatatatcatatatatacaatatagatagatacacatacacactgtttttagtgcagtttcaggttcacaccaaattttagaggaaggtacacagatttctcataaacctgccacctcaacacatgcgtaacttccctcattaccaacattcccaactgcagtggtaaaactgttacatctgatgaccctgcattgacacatcataatcacccaaagcccatagtttacattagcgctctctcggtgttgttcattctgtgggtttggacaagtgtataatgacatgtatgtatcattatagtatcatgcaaagtgtttttactgccctaaaaatcttaagtgctcttcctagtcataccccactccacaccattacccctagctactattgatctttttgctgtcttcatagttctaacttttagtatgtcatatgcttggaatcacacagtatgtagccttttcagattggcttctttcactttataatatgcatttaagtttcctccatgctttttcatggcttgatagctcatttctttctaaggctgaataatattccagtgtttggttgtggcacagttgattcattcacttactaaaggacatcttggttgcctccaggttttgaccattatgaataaagatgctgtaaacgtgtatgggcaggttttcttgtggacataagttttcagctcttttgggtaaataccaaggaacatgactgctggatcaagtggcgagacaatgtttagttttgcaggaaagcaccaaactatcttccaaagtggctgtaccattttgaattcccacaagcaatgagtgagagttcctgttgctccacatccttgtcagcatttggtgttgtcagtatttctaattgtggccatcctaataggtatgtagtagtatttcattgttgttttaatttgcatttccttgatgacgtatgatgcagagtatcttttcatatactgatttgccatgtgtatatcttctttgatgaggtgtctgttaaggtctttggcccattttgtaattgagtttgttttcttactgttgagttttcacattctatgtatattttgataacagtcctttaacagatgtgtcttttgcaaatattttctgccaattggtggcttttttttttttcatggattgtgactttgatgtatctaaaaagtcatcaccatgcccaaggtcatctaggttttctcctattttatcttctaggagttttatggtttcacattttaaatttagatctgtgagtcattttgagttaatttttgtgaagggcataaggtctgtgtctagattcattttttgcatgtggatgtccagttgttccagcatcctttgttgaaaagacgatctcttctccattgtattgcctttggtgctttgtcaaaggtcagttgactatgctaaaatgggtctacttccggacttcctattctgttccattgatctctttgtctattctttcaccaataccacagtgtcatgattagtgtagctttatagtaaatcttaaagttggctattatcggttctctaagtttattcttctccttcaatatttggtttactcttcttggtcttttccctctgcatataaactttagcatcagtttgtaaatatccaaaaaagactttctctgtttttgattgggattgcattgaatctgtagatcaagttgggaagaactgacatcttgagagtattgagtcttccatccataaacatggaatgtctctccatttatttaggtcttctttgatttctttcatcagaatttcgtaattttccttagatgttataaatattttgttagctttatacctaagtatttcatttttgaggggggcttatataaatggtattgtgtttctaattttaattgcacttgttcattaccagtgtatacgaaaatgattgacttttgtatattaattttgtcttctgcaaccttgctataattgcttattaattccaggagggttttttgtgtgtgtgtcagttctttcagattttctacctagatgatcatgtcacctgcaaatgaagacagtttttttttctttccaatctgtataccttctatttctttttcttgtcttagtgcattaactaggacttgagtatattttttagtatcctgtttgctgtttcaaaaaccaaccaaatgaaaacaatgtccatcagggccaagagaagcaagtgcttgaggaaaatattttccttcattttttaaccttaaaagtgtggtaggaaatgggaaaatactttaaataattcagaggatttgatgcactgcgggtgataggtgaattataaaagagaaagcaaatgtacatggattttatattcaaatcccatatgggccaaactacagaacaaaaaataaaaagcaaagactgaaagagtacatgggtaacatgtatttaactatttctcaaggatagcttaaaaatgaattacgcttggcaatgtttttttcttttcctgtgatgacaaagacagtaggaatatttttttaaagggatcttcacttaggttaacagtgtctccaagagtgttcaagtctccctgctctcatcagatggttcaatgcagttggtttttaaagctaccaaagtaacttcctgagtatttggcctgtcttgtggattgattcagaactacccattgctttccaaagaaagttgtttccgtattttatgaactcttctataacatttatttctggaacattgataagaatactgctgatggaaagcagtttaggctgcaggcatatacctaatttttctgctttgttggagtaaatatggagctcgcctcactggattggctctgtatcagtgtgtatccactctttagctacttgtagcctgtctctcaccagggatattcacaagggccctgctcattggcccctgagcaactactcttccactgataagctgcaacatctgccccaggaattgatttccccacagactccactcctctcactatcctctctttacattgacagtgttacgagtgcattagatcaggtaagcttctgtgtgtcaattccaaataacaatgtggtaactagagtttcattaatatcatgtcatccaaagcaagaggtttatatcccttgtcaataccatgaccatgcacatttaaagaacaagatcccccccaaaaaagaaagaccgttctcttgcacatgtttgtgacatttaagaagttacgacagacacatctataaccctacaatcaccttggcacctgtacagaaagctatagttaaattattggcgaagtacacaagcaaatgaaggtatatctactatgaaacataaataaaacatgtatccttacaagataaagtaatataagccagaatcataagaatgaatgataaaaatagaatcatgagaaaaaatggtatcaaggtattggtggtgtcaaaatggactggcccaaagccaacctttcaagctgaccatgatatatccagattttgctatcacataataattagtgatttaactgtatgaagtcaaaatctatgtcattattatatagattcttgcactgacacatcacgtcaaattatcttactttttctgttttttaaatgaattttaaactcatcttcccaatcagaaaaaaataagcttttcccaaccagaaagaataaggtaagggccgtctcttaaccttttctgcattctgcattctctgcagtacctagctagatagtaggtatttggtaaatatttgctttcaaaaaatgattataatgagctgttttaataaagtgtatccattgtaagaacacacgtaacataatgaacaaataattagcaaaacgtaaaaatgtaaatattcccataaaacagctttttgaagctgtaagaaaatatatttctcttcctagccttctaattgtttatttttgtgggccctgaagtctcttttcaaaaaagaaatgagaacggttgagcatctggattttgggaatcaaaatggtcgggggtggaggtgaggaatgtccgagttaaagaattaatagaaaaccctgagtggcccatttaaggaagaaaaaaggctattgtggcatcatcagcttttcctggctctctcatcctcatcctcatcctcagagatgaggtctcccctgtgacccagaggtacctttccagtatcagtttgagaattctaataaacaagctgaaggagcagagtccccaaaggggtgtctgtgccgacagggaaggcagctgcggttatgaaccagcacacaccagaggccggcaagctattgggactttgtgtgagtgggtgacagttttaatttcactccccagcagacgtggtatccagccagcagtacttcaaaccaattttgcaaatcacattttgtggctgaaaattggtttactgcactcgtcccattttggaggccaaccttgcctgatttaaggtggcgcctttgttgaggggggacagttaaaggattcccttttctctaattgaaacgacagcatattctttcacagattaatttcaactacctatgtttatatcctttaatcaggattataaaaacagcacagataattttctgcactattcttttttaatttttgagggagtaataatagccagttggctcttgacacgtattgccttatatagcagttttattccaagcaccctaccttggactgtgtatcattgtattcttaattatttttaaacttgattttttctcatatttaagtaacgggggaataaagtctaagtcatagatttcactgacattccttctgtgaacttaaagatgatacttgcataaagagatttgtcccttggattatatctcacactgaaataagggccttcttactggaagaaatatttcttaaaaatgagtacttgcaagaagtgttcatctgtgaacttttaccaattagaaatggctccatacttaagactctttaataatgtctcttaagcagcattttagctcatttttataacacattcaggtttggtgatttatattaaacattaaatgtaataaatttaggtcttttttcaagtatgacgcacagcatctctgaatcacccatttcagcagagggcccctggaaggtccaatctctcgctatcattcatgcttataataaaacgggcttctccggtctcttccttgacatcggtaataatgggaatgacatgtgagtggtgacactgttacaggagggcatgttgatattgcttcatggctgggactgagtgtccatgaccggagggtgggctgagaacacacatcaacaacttgctgtctcaaatctgcaccaaaagctatactaatgcctattttttaactatacaaaaattcaaggagtaagtttcagtgccttaaaaaaggtggctttgtatgtcttactctatatgactgcaggttttaaaagaattaatcacgaagaattgaacttggaaacatgaatggatctcttaatgatagtcatataagagagattttaaatcttcctctgtttcaaccattctaccaatggttgctgcattcttcacttggtgagtcatgagaaggcacgagacactaaaatgccttggaaaaaaagctgctctccttgatgaaacaataattagaatagccttctttagaactatcatgagaaatttcactataaattattctatttcatagtgacagtgacttacaatataaagtaagttttgactgcaatctgagtataaaataccaggatacttttgggaatatgtatctttaattcagaaaatgctcacatttcaagtatttgaataagattaagcattaactaatgctttcattaagatacctaagcatttatacccaaaagaaagggaattggtatatcaaagagatatctgccctcccacgtttattccagcactgttcacaatagccaagatttggaatctacctaagtgtctatcaacaaataaatggataaagagaatgtggggtggggagatatatatagatatatatagatatatatagatatagatagatagatatagatatatagatagatatagatagatagatagatcctgtcatttatatccctgtcatatacgtgtgtgtgtgtacgtgtgtgtacgtgtgtatgtatgtatatataaatatatataaatatatatataagtatatataaatatataaatatatataaatatatataaatatatatgacaggatcttattctttttatggctgaatattccacatggtgcacaaggatgcagaaacatagaataaataagatctagtatgtgacagcacaacagggtaactacagccaataatttagtatatatttttaaataactaaaacagtggaatcggaatgttcctaacacaaaggaatgataaatgcttgaggtggtggatacctcaattaccctgatacgatcattacacattgtatgtctgtatccaaacatcacatgtaccctataaatagatacatctactagtaaaaactaaaaatcaaaatttttaaaaagatacctaaatcatctaaaaactgtaattattttcttagaataaaaagatggtggaagtaggcataactccaattttcaggcacatgaaggttattgcctctgtggcaacgtttgtggatgggtttggagatggtccacagagcctggcagcagcttggttcccttggttcccagatggggagcctggtcctgctgtcttcatttctggttgacacttggaaatgactagatgaggagtcatgcattagccaacccaaatccatccctcatgcaatcagtcctcaatctcaaatgggcagtttctactggcctagaacttggggtacctttcctgtagaaatgatgcactatgcagtgagcaggttgcaaggcttgcacaaatctacttagctcatgtaagtgaagtaccgtccatgtgaaaatcatcttaaaaatatggttgctgtgggacatcggctaacacacctgccctggtgtgggcattctctacagttaatagactctggataattcctatcgtcttgcctttacgtactagagtctcataaaaaatgagaaataacgaacggaaacagaatgaagaaacattgcttttaagaataccattacaatgctggtaattaaagcagaaaaaaataaaattaagtaatcatgtttcatctattttaataattgtgcttgagaaaaagcaggttcaatcagagaaggatgaggaagtagctggaagctgtgtttgaggttctcaaggaggcatctggccactctccatgttgatgactttgattcctttgggaattttttttaaattctctagactagattattgccttttcctcaaatatttttggcagtgaaacacagaacaaatggaaccaagagcaacaaggaaggttattgttttttttttttttcctacgtgtctagggaagagtgagagaggcagggaaaggagattgggagctagtaaaggaagtggcattgcctccgataaaagtaactgaggagtttattagtgacacttatagggaagtggcctgctcaattcccttgccaactgatgcaggtgagggaaaaaaaagaagggatgaggaagagatatctgagcctacagttccctgtgacagctggggaaaagggcaccgaattcaggacagctcggtcattgaactggccattctcagagtagcagggaatgggtgcttatggcaggtggggggaagggtgtaaatatataacctaattgtatagaaatataagttaattgttacaaaagtgtatggaattggttgttcttgatttagggagattcaggttgttcttgatccaggacagaaaatgtgcaatatatgctctccgtggattcttttgtgaaatgaaaattagagcatagcaagtggttttgagtcttcatttaacaagtacgcaggcactgcctgtgttatcagcttgaaagtctgctaagaatggatgggagaaacagagcagttcacatttgctctttgaactcagagaactgatctgagtgcatggcaatgatgatggaaggaattaggaaacgctggaaatcatatgcaaagaaattagtcatctctctcctcctaagctctgtgtgtgtgtgtgtgtgtgtgtgcgcgcgcacgcgcgtgtgagagagagagagagagatgcacatactactctggattgccttgagaatagacatcatgatggtggtggtggtgatgaagaggatgaaagcagctgatagtcattgactgctcattgtgtgctaggcgctgttctaagcatgttatgtgtattcactcatttaatcctcaccacatccctattatgttggttccattatttatctatttcacagttgaagagtttcttaccaaattttaatccaatagtcccaaatgcaaccaaaatgaatcataccttttgtaaaatgatcttaaaaccatactcatttggacgaattggaacaaccattttgatacatagcaaaagatgctacggaggtctgccacaatctttaatctatttccttttcctgtcttacatccccctcttccacctcacctccagttctactggcctatcttctaactctgtctacacaacctgtgcctgtcacttccaaactgcccctcataaattgtaaaacagaaaggaaggggaggattttacacattctccttcattttgctgggaatttataaagagccatgttacccatgataactctaagacactacagggcattttcaaatattttatcttggaaacttgattttcgaagtatttaggaaaatgcttcaaagtcaaaaattacaagcagttaatcacaattggaaataattctttgtagatctgcactccaatatggtagccgcaacaacatggggctatcagacatttaaatgtgtctgaattatgatgtgctttaaatgtaaaatgcacaccaggtcccaagacttaatgccaaaagcaaaagaatattaaatataaattatttttatatggattacttgttgacattatcatactttggatatattgggttaagtaaaataaattattaaaattagttttacttttgaatgtggatacaagaaagttttaaattatgtatgcgaggccggacacgatagctcatgcttacaatcccagcactttaggaggccgaggcaggccgatcacctgacgtcaggagttcgagaccaggctggccaacatagcgaaaccccatccctactaaaaatacaaaaattagccgggtgtggtggcgggtgcctgtaatcccagctactcgggaggctgaggcaggagaatcgcttgaacccgggaggcagaggttgcagtgagccaagattgcaccactgcactgtagcctgggcaacagagcaaaactccatctcaaaaataaataaataaaaataaataaataaatgatatatgtggcttgcattattttctcctggggcagcaatgctgtagactgtcaaagaggctccatctataaatggtgatggtagcttctgttgaaccaccctgctgaaagtttgaagagctcatgttcagcctgagccttcttttttggaaaacacttttttccccttagattgtacataataccaggcacacctggatttctggataattgcacccacaagtggctacatgcagacacaattaggtgcttgcaacttgttgaaggcacaggtgtctaattgcgcccacaaatgaccgtttgacaggcaccactcattgtgcacacccgctgattatgggcagaaaatggcaccaaccaaaatggaggcctggatagtggaggcgtgaaaatagatccttcgtaaccccacagccttggaatgattgctcactcctttctggcttagtcttttttgtggaatgcctgcctaggtgtttatggcaagaggcatatttggaatgcacaggctgggagatgaaaatgtgtatgccctatcccacaaagtaaatgctgtcttgggcttttaagtgaattggggctaacaaaatccacactgtcaacctgagtagccttagagtggattccaccctgctggggctggctgtttataatggctaaaaatgatggagtgtgagagaatccccagggaccctttggtaaatagtagtttttaaagggttaatccaacctaatgaatcatttaatggggatgagaaggccaggatggtagcctccggaagaatcggcaggcatttatttaaatgggatcagttagggagggagcaggccagctgtgtggcagggactgttggtgcaggtcacttctccaggcagggagtaattgatatccccagctctcctaacagctgaaacaacaaagcgggacatggaaacatgttcacttacacagatttcaatgtccaaaggaaatgtgggggacacttaggccctgcctcttcaggttttagggctttgaaggtggggaatcaggagtcagctgtttctcccccaccacatttcaggaagggctttgaactggatttcggtagctttgtgggctcttgcagaaagaaagccttgtcagcactgtggatgataagtatccaccctccggccacagcaggtctggtggtcacgggaacccacatcttacattcaacagagcagcctacgtccacaataaaccaacagtccaggcattggtttctgagctttcagaaggccaatgtgaggaaattcaaaacacaacagcttgacttggtttttccagggcagaaaaaagattttctcctaatgagggatggctttcatagtgtgtatttatttgcaatataagtaagttcatgatttacccatcttgacaaattctctgtcttggatcttcacatccctttgtgtccgctctttatttatgatgatagccgcctattcttgaatggcaatgctgttgtaataaatctccataaaaagccaattctcagttcaagttactgcaggctgaatatgaggaagacagtcagaaaacacatattgattgtcctcttttagagactccgtgacaggctcagctcagaacttctttcattttgactggactgcagctcaacctaatgtcaacttaccataattcttttatgtggaaggctattattccattatgattttctctcttgtcacctagtatccagaaagggttctgttgggaagagattactggagaatattcttcatctcagatatttcgttccttatggtctggcctgacctttccttgtttattttagaaaggcagtggaaaatgttctgtctcctgtttttagccatctttatacatagccttaagatatacaaaattatatacatattagatatatttttatatacatatatataatttctttgggagtttggcataaggataaaattatttggatttcataatttcatacattctaagtcacaattttcctatacttgacacattgcctagtatttgatgccctgttattggagacaatttagcactgacacagactagcatggcgtaatagttttcttttgtacaaaggccattgcaaaatttcagtctggggccaaacatccctgtagttattttttttaatgtttcataagttgtaaacgttgataccaagtatgtggtgggtgttataaggctttgccctttgtccatttcaaatttttcgtaacaacctgcacggtgaatttctcgagtctttcttccaagagcaaagagtctccatgccaacacatccactttcatcctttggccttaacaagtaagcttcacattggcgtgtgttaagaatcacattgataaccacagttgaccagaagacctacattactatcaggtaccttgaggagtctagtctctgatgctaatatagaaatcataggtctcaaagagctaatgcggtatttgaatgagtcattgcatcttgaaaaatcacagaagtcactggtcatgaggcaaattgtttccatttcttcgtaagccacaattatatttgcggtgtagattcggttttgcttcttagcatttttatgaagaagctacttaatggaaaaggattcagaaggcctattcttaaaactcttaatgaccacaatcagcagtagaatatatcagatttatatctgatggttgactattgtactatccatatttagtaaatcactgctctaatgttctcaataataataccgtggccatcagaaatagtttatactcttttccaaattcctgacatgtaagaaacgcagtaatactaaaagcttctggtacctcattgtgttggcattgaccttaccttctctctgtggctttccctttccctaatgtaggtagagctgctgtatttcaggcaagcactcaggtattgggctattttagttgggtttttgctttttattgatttggagttttaaaatcttcttctaccacgaactctacccctgacaaacggtgagaaaataaatagaattgctagtcttcatcacacggaaaagagctagtgagctatttcgtttcctccctttttctgcccccttctcttttcccagcttcccatttatagccctgctttgcagagacagcaacagatactctagaagcaggatgaacatgagagtggatttacaacatggaaagcaaaggccatgcattcctaaagggcagggaaggccttaagggcagggctttgacttttcaccactgcctcctctgcctagcacctgcatgcagtgggcattcaactaatatttaaggcagaacaggaaggaaaggcaaaaacttgggaagaaatatacaactgaggagaaaatttccagacatttcactgtgaaggtgtcagaaaagacagttctctattttcagccatactaagtggacattctacttgtattattctgtgaattttctaattgagtcatgaaaattctttcattgaaagcacattcttttttagtactttgtatttttcctcataaaaaagatttcctctaacataaatgcataaagcaatagaaaatcatgattgagatgacatggcatgttttccacatttcaattttcaatactttgtatctatcccagagaattctttccacagcacacttttcttatttttgttattcatccagacctgaattttttaatacattcagcaatttttatcaaacatgagtgattggagtttttccagacaagtaatgtttttttttcaagtgtgagattttgtgtgcgtgcatgtgtgtgtgcgtgtgcatatcttctgtagagttatagaaagctcagttttaaaaggtggccaaaaaaatgaatcaatgaataaagtggaattaagagtcacccgtaaccttgatgctagtggtggtacagatgtgtacatttgtaaaacctcatggaactgaacagttaaaattgatacatttattgtatatacattatacttcaataaaatttttaattaaagaaaataaaagctcatcttcatctgggctttacttgctagtccatgtcatggcggagcttcagttcttaggaaatcttccattgctatggcccttgctgttccctggcaaactccaactctcagggatctctacaatgccctggctttcaaaagcacaggagagaacccaagcaagcctggctgctttgtgctgctccttagaaacgaatttccatgttcttgggccacagaatagtctgccattcaaataagcatctctggctgggcatggtggctcatgcccataatcccagcacaccaggaggctgaggcaggtggatcctttgaatccaggagtttcagaccagtctgggtaacatggcaaaaccccatttctacaaaaaatacagatattaactgagcatattggtgcatgtctgtggtctcagctactcaggaggctgagataggaggatctcttgagcccgggaggtcgaggcagctgtagtaagctgtgatcgcaccactgccctgcagcctgggtggtgaagcgagaccctgtctcaatcaatcaatcaatcaatcaaatcctgagccatatcactctttttatcaaatcactatgccacaggatgagattaaatctcaccacaggatctcaccaaaatcaggctctccaaacctctgttcccacggcaactccagatccagtcccatctcaaatgctgtctctaaacagagagatgcagacagagatgaggaactaatcaaggtgcatgtttctgtgtctggaagtaggagcaggctggaagagatgggcacagtggaagtcattttggtaccttcctttttatttactcccttgggtctgagcaggcaagacttgtcttggcatgttttctatttatataactaattgcaaattaattgcaccctcacattgttgtctctattggagaattgctagaggactcgagttagggatgattcactttctcagaagtagactaacataattgcatatgtagttactaaagttagttataggcacagatatctgagcctaaaggaagtttgtcaggaaccaaaaatctatcagacaccctcctacactccatgcctctcctatttccctgtccactaacatctttagcacagctgaaagagggagttcttctaggtcttttgcttttcattttctctaccctggaaatgttgaaagctgtatcaagctgaagaagcataagctgcaacaaagcttttctcccccaaggtggtttccaaagtgaatgaccactggctctttctaagtattttatcctctagtacttacattcatacctattggtatgaatataccaacacatgaatgtacacatggacaataggtaaacattattgttctctctacatattattccgatgctttatttatccaatacaggaaaagaaatctattggtagatgtaactgaattgaaaagtccaaggacagacttatcttcaggttcagctacccaagatctcataaaaggctgtcagcacttggcttctttctccccatctctcgactgttttcttcattgttggctttgctctcaggcacgctcttccaccatggtggcaagatggctgcccacagcatcaggcttacttccccctcttctcagctactccacaaaagagggatcctctcattttaacattttccacagaagtcctaggatcatctcaggttgcttttatcgcggtatgtttttaaccatacacaatcactgtgcccgaggggatggaacgttctgatgatccaggcctgggtcacatgcccctctggagtccagagtggagtcattccacctgaaccacatggactgagagtgggcatggaatgattcccaaaagaacagaaggctgtcaccaggataaagtaggacagatgctagactggcaaaagcagcaactttcttccactgtctcaactcggatcacaagggaagaaggaaagataggatcaaggatgaaggagaaaagtagaagctgttgccacatattcacaagaagtaggatgagtaccaaatccctaaaaaatgttctgtcaaaccagtacaccaaaccctctctgcttccggtctgcttgtcatttgacccacaggcttcaagaatacttcctcaagtaaatatagtccagtgattcatccatcagataatcccatataaaggaaaaagacaagagagacaagaattatgtctgttttgagaccaggatggtctcttggctgttgcccaacttcctttgggtttggctgcatctgtccctcactttagagctccacgtgtcattgtgtttgtctttccctgagaatgtgaataatcccaagtctaagtcatccagcatttctcagagaggtgacatcaatgtagacccaccaaggagtagcagttagacatctagaatataactaggacaagacaaaaaactgtttagagagagtgtacattttagtgtattttgtataagttttttcaatgaacatagtccatacattttgggaaagtggtaataacttgcttcatttccatctggaggaagcagatttttggaggagaaataagcctctaaacatatttgaatatttgaaagactgagaaaagcacatgagaagttatggaatcaagaataaataaaaagttggggcaggaataataataactgcctaccattatcagtcacttaccacacccatgcaccatgctgagtgctttacagactttctcatttaaccctcctagctactcagtggaagcaaataaccattactatcccaatttgacagaggaagaaacagactgtcttacagaggaaacattcgttcattggaaacccagaactgttgttcctaacctccctgatgtctcatattttgatgctcattgcaagatctgtgttgatggacaggattgctgagctcaaggttggctggaacctaaacacagacatacaaggagggaatcaggagggaccccagtcagatgagataaaaagagaaggtctggtggttcaggtcactgaagaaaaggaagctgtccggtttggataaaaattcaatgtcctcacaggcagaggagagcaaagcctgagaaagaatctcataaaagacaaaggcaaaggttctgttggcatcaggatggtccagcagggaacgaagacacccaggcatggacattaagattcaaggctaggatctcatttaatggtcacacctagacaaagtggaaggataatcctaccagtgatgatgtcttacagtgtgtaactgggctttgtcagttacacagtgctttttcatacttccctaattttatcttctcccagcaggcctaggagcttgcttagtatcataattcccacttccgagtgaagaaaataaacacagagaagtttctcattcaaagccaatggcagagctggaacttgaacccaggtgttttgcctcagagcccagtgctcttgtttactatagtgggctgagcgtaacatcaaggttgacttgttcattggaattgctgtacgccttgggagcttggtcattaggcaacaagcaagatgccagtcactgggagagaaagggatgaggctgaaactcaaatgagtacccatttaaagaaaagaaaaccccttctttcccacaacaggaatctccagcgaacatccactaataaactttatattgggtgcctaccatgagccaggcactggagagtgaacggtgaactcggtaatagtccttaccatcacagagctcacagttcgttggagacaccagaaaacaggtgattaaatacaatggttattgattccatagaggcagaatgtttcccatacaactataatgcctgcgttatatttaaggtttttcatgatcttatatatcttaccatataaatctaaatcaatcataacgtatatttctgagatgattactcagttagctcataggaggggcatctgattcagaagtaaaggatcaggaagaagcggcatctggaacaagtacagatggccaaatcaagaacctttctcttggcctctgagctacttgcccaaaccgaactctgtcttcaaggttcccttaatgcagtccccttgtcagaagccacacctgcagcagatgccccatggcactgactcagccttgagcagaagcactgtgttttgtctttcatctcattgcccagctaggtgcaacctggatagacattgtggcccataccttttttatatactttatatttgggtttttaattgttgtcaccatcaccaaccaaggagtaagatggccctctgggtcagagtaacattagaagttttgtccatccagttttagaactacagaggaaagaggagagcattatttttttaagagtaagcatttgatttctgaaagcaattctgattgcctatccctgacaaatgaattgttccccagaagccatttctttctaccagaaaaaatactagagaacaacaagtaaatttaaatttagttatttttccccaccttgattgtccatgttattattgtttaaatggtggtgatgaaggtaattaactttttaattcattttttggttgtagttgatgcattttttaaaaccccaactgagtgagtgccacaattacaaatggctctaagactgctaaaatttcaatgggtatttttcagcttctggttttgccaaattttagttcactaaaccacacttaaattaatttgctaagtagaaaattccccaatgggatgttagtgaaggataagtatgttgtaaataaaacaattaaagggctagttcacacctcatcaaattgcttaacaacctgataccagttaactacatacattcctcataaactgcatggaacatggaacaaggaggtaaattagagtcccccttttctgaagtgggacgcaattacccttaaactgaggtccagtattacggtggcgagaggtggggtagaaatgccacagtatgaccttgttggctgtggaaatatctgcataatgctgtcaatagggattgcaaattctgatccagaaatcccgttaggcagagcaagttccccttcctaattgtagcctcatagacacaagagtaatataagatcatggattcattttatcccaacattcctccaatgtgctgtcacccatatcatttcatccactcttatgagaagaaaagcacatattactttacagatggagaaaccaatgcacagataagtgaagaggcccagtcagggtcacacttgcagagggcaggctgaagggcagcaacgtgagctgagttcatcttggcctggagcctgtgtggtttctggcagggccatgaaattataacccctgtcaactcattggaggccacctacacaaatgccttcattttacagagttgaagataaggcctgagaaagtaaagtgacttgtctgaaacttcctgggatatgacccagtgtccggagctcctatccgaggtcccttctcacttctgcagcagtcgcttgcctggagttatttagggataatttattttttaagatgtaaatgtgaaccaggtaaggtgatggaaattttagtctgcctctcaggacacttcccctctttaaagtggggaattgggatggcacacacctattagcagaggatgcaaactgaacacaatgatgtggaaatctagagagcaagatttattcacatgggtcagggaccatgtgaataaacccaaatagctataggggcacatgggaaatgtcagtgagagaagcaggtgggagcagagcctaaagaggacaaagtcccttcctcaagagcatagcttcacttgaccatgacctccaaggaaggcaagtcctgagattaaagaaaagcaggaaaactgaatttttatgtgaaagcccttgactttgaagtgtcagcaactggctgaaaattttttaaacagtgtgttggggatgggagtgtataaaaatgagcctacagattgcaacctctgttagaggatttcctaccctgacatatcagtgtagagtaggacatttagggtccataccactcagccataaagtttggatttgtttacaaatgtatttgcttgttcattcaaggtctttggacaatcaccttatactccacatagaagatccaattttatttttattttttaaagactgagtgtgacttcgaactcagaaaatattgagggcctcagtatgattggtccttttgtttgtttattcacttttaaaattcagtttccatcacaaccctgcaaggggaggaaaggcagtcccaatattcccattttacacatgaggttattgaggctcaggaagggtattttcatgaagtgcctcgcacaattcaagcccagtcttcacctctgagttgcacactctctcccagtgcactgatgcacccagagatccctcagaactgaaaactgtgggagcacctgcccaccatagaggacaaatgaacctagttccagaacaggtgggcaggttttgaagcctcaggtccataaagcaaaggcagagcctggaattccatctctctgaagttcaaaaaccagctggcatggggcaaacggtaaataacattttattgggtaatggctctttagttttaaatcacttcagcatttacttttaattaatttctttaaattagacgactcatacttgtaaatatttgcttttctatgataagcttttatttaaattattaaagctgcagcttcgtgactgattttaagaattgaggttgccgctatactaatgatagaaggcatgtgattaaaaacaaggaaaccatttcacattggtatataaaccaacaccaaatatggctggagcaaagcagcactcaaacaaatagaagagagggtgaacttacagttttctttgatttgttcaaggaataaatcaataaatcagggagttagagaacaatgtaggatgaaataacatctaaaggagctcactcacaataaaaccttgtcttgctctctcttttctaaaagcactcatcaatggccctggacccacatactagtttgctaaaaggagtgagagtaggtcatgggaggggggttatggagaggctcaggacagtgagtaactgtacaagaacatttgagacaaaaaaaaaagaagaagtaatgatgagagcagagtaattgcatagccctcatcagtttgggttattataagccttgatgtgctagctgctccattttaccagcatcaaaggcaagtatggaacccacagaaggtaggctgacaggctggattacagcaaaaggagaaatgacaaaggatactctaatttcaataaaagaagatttgaatgtaaaaggtttgtaattacattaataaccagtctttaccaaccatgtaatgatcagccagagtaagaagagaccaaggcaggatgggggaaattcaccacaagtcatcaatacctaagaacctgttaataacttttattatttgttgaaaatcatcttgacaacacagttcagtaacctttgtgctataaatccatttcatctgcaaaaatgaaagctgaatagaatgtgatattatatagaatctctcatgctgatgctatctccaaagtgctctgccaaataatgagctggattctggatgggagggctgtggggggccaacagcagatacttgtgtatgcctaccaggcccagcttggggctttggaaccagcttagcatagactgaaatgaaggctgaaagttacccttcaccctttactgaaaattatcatggggtgcttagattctacatcaaaattaatagagagaagccaaaagcacttccatttattatctggtggaaactggggaatggatcccattgctttggtgctgggtatgggggagaatgttagaataatcatccccaaaatgtatgtaatcatgtttgtggccaaatagggtaccgtaatccaaataaaccccaggtggcactctgggaccaagctatgcctccttcctgccctccctgcaattgagaggggtaccaaaaagcccagggcactattgagagaaggatgagggaagcccttttcacaggaagctgacatggagatgagatagtcagaattgggaggtactaatgtcaaatccttcctacccagaagcaaactcggcactcctcatttttacattggtccctgatccatttatcttttgactaccttatcccaattaaactactaatgtgctcatttctttttttttttaatttttattataggttcagggagtacatgggtaagttggttacctacgtgtattacataatgctgaggcttggattacaaatgaatgtgtcttccaaatagcgagcataaataggtggtttttcagccctcactctctactcttgtagtccccagagcctattgttctcatctttgtttgtgtgtactcaatgtttagctcccacttaaaaatgaaaacaagtgacatttggttttctatctctacattagttcacttagggcactggcctctggctgcatccatgttgcttcaaaggacatgatttagttctttttttatggctgcatgatattccatggtgtatatgtaccacattttctttatccagtccagagttgatgggcacctgggttgattctatgtctttgctattgtgaatagcattgtaataaacaaagaggtacgtgtgtctttttggttgaatgatttatttacctttgggtatacactcagtagtggaattgctggattgaatggtagttcagtcttctttgagaaatctccagattgctctccacagtggctggattaacttacattcccaccagcagtgtatgagtattcccctttctctgcagcctcaccagcatctgtcgtttttagactttataacaaaagccattctgactgtgtgagttaagggacaggtcacttgccttgaagggaaaccccataaggctagtagcggactttcagcacaaaccttaaaaaccagaagagactgggggcttgtttacagcatccttaaagaaaagaaattccaaccaagaatttcgtatcctgccaaactaagcttctaactgatggagaaataaaatccttttcagccagagaaatgcaaagggaccactagacctgccttaaaaagggaatgttaaacatggaaacaaaagaatgatgcctgccaccacaaaaacacacttaagtacgtggcccacagaccctttaaagcaactacacaatcaagtccacataacaattagctaacgccacaatgacaagatcaaatcctcacatatcaatattaaccttgaatttaaatgggctaaacactcccgtttaaaaggcagagagtgataagttagataaagaaacaagactcagctgtctgctgtcttcaagggaccccctcttacacacaacaacacctataggttcaaagtaaaggaatggcgaaagatgtatcttgcaaatggaaaacagaaaggagcaggggttgctaatcttctatcagataaaacagactttgaatgaacaaccatcagaaaggacaaaaaaaaaaagcattccataatgataaaaggttcaatacaacaagaacacttaactatcttaaatacatatactcccaacattggagcactcagattcataaaaataaattcttagagacctacaaagaaacttagccacacaataatagtgggagacttcaacaccccactcacagcattagttgtttgctattgaggcagaaaactaggaaagatattctggacttaaactccatacttgacctattggacctaataggcatctacaaaatactttacccaacaaccacagaatatgcattcttctcatctgcacagggaacatacctaagatcggccacgtgcttggccataaagcaaatctgaatacatttttaaaaatctaaacatgccaactgcactcttggaccacactgcaataaaaacagaaatcaataccaagaggatctgtcaaaaccacacaattacatggaaattaaacaacttgctcctgaatgacttttaggtaaagaatgaaattaaggcagaaatcaaaaaattctttgaaactaatgagaacagagacacaagataccagaatctttgagataaagctaaagcagtgttaagaggaaagtttgtagcactaaatgcctacatcaagaagttagaaagatctcaaattaacaacctaatatcacacctacaggaattagaaaaacaagaacaaaaccaaccccaaagctagcagaagaaaagaaataaccaaaattagagcagaactgaaccaaatggagacatgctcatttctttcaacagaaagtgaacccagaggttcatgaatatgttatataaacctcacttagtattataaatttagggggaatagattaccagatgtaaaaattttttaaaggctcatggtagatcttacattgaggcacatgcaaaaagctcttaccaattaggttatcagtatttaaatttcatagcactacatctaaaaagtctaatgttcacacagttcccaaaagactgaattcacctgtctccagaagttgtattatcatgccagtggtctcactgcctgatgagtatagaagccaataacatggcaccaacatttgagaaaaggaagtctttattgcaagaccagacagcaaggaaaaaggagttgggctcaaatctgcatccccagtttgctgtctggggcaagttttgaggtgtcagagggcaagggaaaagatttaggaatgttggttttgtagagtctcattggagagcttcaatttcgaccatttacattaaggtatgttgaggcagattttagccctggatttttcaggccaacagactcttcacttctgaaagagtttctgcattcaggttccagtcacgtatgaatcttcttggttctgtagggaggaatcgttggttctgggtgttgttagaggtcaaagctttctctcttgcacatgcctgggctgcccgacttacagttttggctctattttacctacatggtaactttattctgttatcaacagagtaggcccagtttgggctggtcctatggttacagtattaccatgctttcatccgagagtgtgatgtcctcaaaatttcttcaaagttggtaagcaactggctatagaattcagctgtccttcagagtcacatgcactgatgctacagttctgcactgctgacctgcccttctctgaagctgaaccacaacttttcctgcctgtctttgaatcctaatatactattactattggaatggtccattggaaaagggatttgagcctaaatcaagactgcagcatgaaagtggacagccatgaatagctaagagaatatttgctagaacccgatgtatgactggagcagggatgagagagaagtctagatttctagtgggctaactgcacgaatcatgacattctccaaagagaccgttggaggagcagcaggtttagggagaggtgattggtttaattttgtactcataaggttgaggtgcctagggaacctccaagtagagctttcccacaggtaatccacatcacccccatgttcctaatcctactgaataaaaatcacactctttgttgttggtggtgttgttgttaactcagttggttttcttttctcaggtttagtcttttaagttctaggatacatgtgcaggacgtgcaagtttgtaacacaggtaaacgtgtgctatggtgggttgctgtgcctatcaacccatcacctcggtattaacccctgcatgcattagctgtttatcctgatgctgcccctcccactgccaccccgacaggtcccagtgtgtgttgttcccctctctgtatccatgtgttctcattgttcagttcttacctgtaagtgagaatatacggtgtttggttttctgttcctgcatcagtttgccgaggctaatggcttccagctccatccacgtccctgcaaaggacatgatctcattcctttttatggctgcatagtattccatggtgtatatgtaccacattttctttatccagtctgtcattgatgggcatttgagttgattccatgtctttgcaattgtgaatagtgctgcagtgaacatacatgtgcatatatcttcatgagagaatgatttatattcctttgggtatatacccaataatgagattgctgggtcaaatggtatttctggttgtgggtctttgaggaattgccactgtcttctacaatggttaaactaatttagattgccaacaacagtgtgaaaacgttgctttttctccacagcctcgctggcatctgttgtttcttgactttttaataatcaccattctgactggcataagatggtatctcattgtggttttgatttgtatttctctaacaatcaatgacgttgaccttttttctcatatgtttattgaccacataaatgtcttgttttgagaagtgtctgttcatgtccttcccccactttttaatgggattttttttcctgtaaatttatttaagttccttatagattctggatattagacctttgtcagatgaatagactgcaaaatttttctcccattctgtaggctgtctgctcattctgatgatagtttcttttgctgtggagaagctctttagtttaattagatcccatttgccaatttttgcttttgtggcaattgctttcgatgttttcatcatgaaatctttgcctgtgcctatgtcctgagtggtgttgcctagattttcttctagggtttttatagttttgggttttacatttaggtctttaatccatcttgagttaatttttatgtaaggtataaggaaggggtccagtttaaattttctgcatatggctagccagttttcccagcacatttattaaataggtttctagtaggctaattgcatgaatcttctagatggggtcttctagatatagaatcatgtcatctgcaaacagagacagtctgacttcctttctcctatttaaataccctttatttctttctcttgcctcattgccctggccagaacatccaatactgtgttgaataggagtggtgagagggggcatccttgtcttgtgccagttttcaaggggaatgcttccagcttttccccattcagtatgatattggctgtgggtttgtgatatatggcttttattattttgaggtatgttccattaatacttagtttattgagagttttgaacatgaaagaatgttgaattttatcaaaggccttttctgcatctattgagataatcatgtgatttttgtcttcagttctatttgtgtgatgaattacatttattgatttgcatatgttgaaccagccttacatccccgggataaagctgacttgattgtggtgcataagctttttgatgtgtcgctggatttggtttgccagtattttaatgaggatttttgcattgacgttcatcagggatattggcctgaagtttcctctttttgttgcatctctggcaggttttgatattaggatgatgctagcctcataaaattagttagggagaagtcccttcttttcaattgtttgaagtagttttagaaaaaatggtatcagctcctctttgtacctgtggtagaattcagctataaatccatttggtcctgggccttttttggttggtaggctatttattactgcctcaatttcagagcccattggtctattcagggattcaccttcctgattcagtcttgggagggttatgtgtccaggaatttatccatttcttctaaattttctagtttatttgcatagagctgtttatagcattctgatggttgtttgtatttctgtggggtcagtggtgttatcccctttatcattttatattgtttctatttgagtcttcttttcttctttattagtctagctagtggtctattttaataattttttcaataaaccagctcttggattcattgattttttttgaaaggtttttcatgtctctatttccttcagttctggtcagatcttcattatttcttgccttcttctagctttgggcttgtttgctcttagttctccagttcttttaattgtgatgttagggtgtcaatttgagatctttctagctttttggtgtgggcattagtgctataaatttccctcttaacactgctttatctgcatcccagaaattctgctgtgttatctctttgttctcagaggtttcaaagaacttcttgatttctgccttaatttcattatttacgcaggagttattcaggagcaggttgttcaatttccatgcagttgtgtggttttgaatgagtttcttaatcttgagttctaagttggttgtgctgtggtctctgttatgatttcaattcttttgcatttgctgaggcatgtcttacttccagttatgtgatcaattttagagtaagtgccatgtgtcaccaaaaagaatgtatattctgttgttttggggtggagagttctgtagatatctatcagatacacttgatccagatccaagttcgagtcctgaatatccttgttaattttctgtctccatgatctgtctaatattgacaatgggttgttaaagtctcctactattatcatgtgggagtccaagtctctttgtaggtctctaagaacctgttttatgaatctgggtgctcctgtattgggtgcatatatatttaagatagttagctcttcttgttgaatcgatccctttaccattatgtaatactcttctttgtcttttttatctttcttggcttaaagtctgttttgtcagaaaccagaattgcaacccctgcttttttctgctttctatttgcctggtaaattttcctccatccctttattttgagcctgtgtgtgtccttgtgcatgagatgggtcttttgaatacagaatacaatgggtcttgactctatgctgcttgccattctgtgtcttttaattggggcatttagcccattttcagttaaggttaatattgttatgtgtgaatttgatcctatcatcatgatgctagctggttattttgcagacctgttgatgcagttgcttcacagtgtcattggtctgtgtatttcagtgtgcttttgcagtggctggtaccagtttttcctttccatatttagtgcttccttcaggagctcttgcaaggcaggcttgctggtgacaaattccctcagcatttgcttgtctggaaaggattttatttctcctttgcttatgaagcttagtttagctggatattatatcctgggttggaaattcttttcttttagaatattgaatattggcccccagtctcctctggcttgtagggtgtattagtccattttcacactgctgttaaagacatacccaagactgggcaatttacaaaagaaagaagtttaatggacttacagttccatgtggctagggaagcctcacaatcgtggtgggaggcaaggaggagcaagtcatgtcttacatagatggcagcaggcaaagagagagagcttatgcggaaactcccattattaaaaccatcatatctgatgagacttattcactatcatgagaacagcatgggaaagacttgcccccattattcaattacctcctactgggtccctcgcacaacacttgggaattcaagatgagatttgggtggggacacagccaaaccatatcatagggtttctgctgacaagtctgctcttagtctgagaggcgttcttttgtaggtgacctggcccttctctctggctgctcttaacattttttccttcattttgactttggagaatctgatgattatgtgtcttggggttgatcttctcagggagtatcttaccggtgttctctggatttcctgaatttaagtgttgtcctgtcttgttaggttggggaagttctcctggatgatgtcctgaagtatgttttccaacgtggttctgttttcgctgtctctttcaggtaccctaattagtcataggttcagtcttttcacataatcccatagttctcagggaatttgttcattccttttcattctgttttctctaatattgtctgcctgtcttatttcagcaagatagtcttcaagctctgaaattccttcctcctcttggtcaattgagctattgatacttgtggttgcactgtgaagttcttgtgatgtgtttttcagctccatcgggcatttttgttcatctctaaactggttattctggttaacagctcttgggattttttatcatggttcttagcttctttgcattgggttagaacatgcttctttagctcagtgaagtttgttattacccaccttctgaagcctacttctatcaattcatccatcccagcctctgcccagttctgtgctcttgctggagaggtgttacaatcgtttggaggaaaagaggcactctggctttttaagttttcatcgtctttttgttgttgttgttgattctcatcttcatgagtttatctagcttcgatctttgaggctgctggcctttggatggggtttttatggggttttttgttggtagtggtggtggtgctattgttgttgcttccttttagttgtgtgtgtgtgttttgttttgttgttttttgtttgtttgtttgttttaacagtcaggcccctcttctgtaggggtcctctccagaccctattcacctgggtttctcctgcacctggaagtatcaccagtggaggctaccgaatagcaaagatggctgcctgctccctcctgtaggatctctgtcccagaggggcatcgacctgatgccagcaggaatgctcctgtataaggtgtttgggaacctctgttggagggtctcacccagtcaggaggcacgggaactgggacctgcttaatgaagtgctctggctgccccttggcgaagggagtgtgctgcactgggaggaatcccacttgtccagactgcccggattcctcagagccagcagcaggaagactacatctgctgatccatggagatcacagccgcccctcctctcaggagctcagtcccagcgagatcagagttctgtccctaaaatcctggctggagttgcttaaattcctgcagggaagacccagttggtgaggagggatggatcagggtccagcctaaagaggcagtctggccacgatccgccacagctgctgtgctgcactgtggggaattcctcctgggtccaaaccatctagtctccctggcgccagcaggggaaaaatggcagactggagccacagtgatgacagccacccctccccacaggaactcagtaatcttaagcagtctgcagccaagtggccaccaagaatctacacagctctgttcttgggacccagggctctgatggcatgggctcacgagtgggatctcctgatccatgggttacacggaaccatgggaaaagcatggtttcccagatgaagtagcacagtcactcactgcctcccttggctggaggtgggagcttcccttgccccatgtggctcccaggtgggctgtcacaccaccctgcttttccttgctctccatgggtcatgccacccacctagtcagtcccaatgaaagaacctggatacctcagtagctggtgcagaattcacttgccatttttttcttctcagtgggagcctccgaccacagctgtttctagttggccatcttggcccctccccaccaaaatcacactctttaatccttcctatgctgcccctggtatttaagacccttcatgatcaggctccagataccctctctagaccaaccttctgcttcttacttgcctgctcttgacaagccagcatcagaggaatgtctctgtttccagaacactttccaaggctgttagctctgtatctttcctcctgttgtttatctcttcagatgctcaggataactgacttatatttatattccaggttatttgcagagcaggtaacacgtcttacaaacccccatagccacagggattccttaaagctgggtgccagctccacctgcatcagaatcacctgggcccttgagagaaatgtaggctcccagacccctttcagaccttttcctggggttgcaaccccagaatctgtgttattcaataaagactcaattgattcttagtgatgccaacgttcaaggtactagacctggaacacagggtcttccaaacggaaccgcacaaatatctgtttgattttcataaagggcaccaagaaactttgctttccttaagaaaggcacctcaaggtctctgaatgaaacttcccacatggaatgttgtttgtgctctttctgcaagcaccatcagcagtttcagcttcttgggccgctaacagccaaagtacccattggaaaaaaaaaaaaagaagtctctttttagtgcattagatcctgttttttagaaatgtgtttccaaatataaaccaatttctttcacccggtgccagcaggcaccatgtgagcagatgagaagcaagtgaggtcagagactgcatggtctaacttagtggtcaggcatgcagcctctgggtctgtctgtctgcctgggcttgaactgggctctgccactaccagtgtgactttgatcacattatttaacctctctgcttctcggtttcctcatctgaaagccagggataataataatgcctacctggtaacattgttatgaggaataaatccgtcaaatggaggaaacatttaggatggaaactaacttgctgtaggcacttgggaacatgctgctgtgctcagcaggcttatgaatctttgcaattctaaacccaatgtttgaagctggttactgagcccatcaagtagagtggcactcttccctgcacttacatttctgcttctgaatttcagagtaagacaattgccgtggcaggattctcctgtgtcttaatgaaatcatgacatggaggccctctcccccaacacccatacacacacacacacacacacacacacacacacacacacacacacacacagaggcatgaagatggaagtgtttaagtctccttcgttgtactccttgcccttggtgaagagggattctaataatctaatgatcataggtagtttacatcaaaatcttcctattgcacaggctttagaaattaatgggaggggaaaggggtcaggtaaagatgtggccatgatgcataaatatctactgcaaaaattgcatgtgctactctaacatatatatgtaatctaaaatagttagggaaaagcagacttcaggaacagtatattttgcccctagagtgttctgtctccaggtagcaccttgggcaggtaactgtgtagtggtttttcctaaggggcaggaggaaatcaggaccttacactgttgaacctgttagcccccaaagtctgaccttggaattgaaccattgtctgctacatgattatcagacgaaatccacagtgtttagatactgaaattctaggaccacagttacaatagaaagagagagagatgatttaaggggcctatcaagttaggatgatttgttcctttggttgccattctctttaaacaaagcctgttctgtggataaacagaccatggggtaatgatatgcaggtatcgttcaaatggattgcatgactgttttttgtggccgcgcaggatagcttctgccttccccaagatttccctctctatgttgttctcagttatcttttctaattgttctcagcacccactttaaaaacctctcatcccctcataaaggaaattattttagcaggaccatttttaggaccatctgataggatgaaacactcttaaggaccattttccagataatgtctgctgaactgtcatacagaatccaaaactcattgcacacgcagtttgttaataactcaattcttgtatttgtggtcattgtttaaaaaaaaagaaggaattaaatatgagcaaccaaaattatacttgtttaaactgtttgagaaatgtctttgagcactcagtcactatcctttctccttcattttctgtacaaacatttccttggtgtgtatgagggccacaagcatctgctgctgcacactccacccattccagttctttggaaagaacaagacccccctcttctcataacacaatgggaaatgtgagtgatgaaagcggatttttttccataatcatttctataatataggccatcaaatgatcattatattttatgattccgtaaaatctgccgaaatcaaagctatgtaatatacgttgcagagggctctgctaatccttgccaaccacattcgtgcctggaccgaggaggaaggtctggtaactggaaacctgacactaaaggaattctaagcacagactaaaagcatctctgtgcacatagcatgggcgactcaagtatattagtttgtgctgattttttttaaagctttgcagtatttgtagaagaaccagagaagaaagcaccgaccccagctcagccactaaataatctatgtgtggcatgctcaagaatagcatggctctgccagatgtcgactttctgccaacgggtacaggcacctctcttagacagctcacaggagttttacatcatgttacttcctgccgttcaaaccccaaatttggccacagtcaattattaccaaaaaaggaaacccataaaggctactttggaagttaaaaaattagctttgttttggctgctaatcacacacatagtattttatagaaattaagaacaagattctaccctttggaaggttttctgtaagtgaaaaacccaatgcatatgcctaagccggacattcacacctctgctcataaattcttcatggtttttatactttctgctgcatatcttatttcttcacatactaaactcaccccctttcaaaacaaactatcttctagttgctgatgtgtctccaacttagttgtttttcccctctgtgactcttcaacttcatctatccttccacatcctaaaaggagctcatcagatgagatactgtaggagttcttacactctgccttgagacatgtagaggaagtgtgctcagttctgtattgcaagaatctgtcactgatatttgaagacaggattacaaatgatttcttttaataaattatagcagactcaagttttccccttcaataatgtcactcccactcatttgaattcccttgttctttcctggatggaaggaaagggtgttgagttacagcaggtggcagagaagtttgcataattctggattctgcctctcctgggtatgagtagcttatatgaaaatcatccatcacgtctgttctcagggagaaaagcttgggaggcactgggacagagggaacaggacaccaccttgacctcgggttcgtgttcatcagccctcaagcccaggtaccacacttgtaactatggtcatcacacctgggtttgacattgtctccctaagaccctgtgtttgaaatcctgtgtactgtactttgaaatacataaagatgttcctagattattgcatttatgacagagacaaagaaaatttctttgctgtaccatcataaaaatagtagttaactgacccttgaataaatacgcttagcctgtacctagtaagcccagtttccagttaatcttgagtcaagagagctctcaatttcctcagcaccagttagtcatgctgagctcactgggaagtcagagaaattgaatcccagtgtaagatttattgagcacctattgtatttcaagtactctgtagggcaacagagataagacagtataatcttgttcttggcaaacaagacaaataaaataacctctaccctgataaaatttacagtcattctgtgttggacccaatacaaccctttattcagcccaccatccctcctacttccttccttcttcagaatttagaaatcagtctcacctcaaccaccatcaatccctggctcccaaagaaagcccactttctcctcttttcccctaccttcctccagcccctacccacattcaaccttttatagttactgtatgtgtgtgggttttctctttactttaaactctcttgaacaaattcaacatacatttgtagagcacctgtgatgtgcaaagccctgtgttaagctcgaagggagatagttagatatgtaagactcagttccttccttcaagatgcttgtactccatgcagtatacaaccagccacaaggcagggtgaaagacagatgaggtgagaatgaccagctgtggcagagacagaggagagagattttctttgcaattgagggtggtggtgtagacataggaggattcaaaattgctcatgccccttcatctgttccagtaagtacagccacctcattcctagcaagaggtttgctattaattttgtccttccagtattgagccctttccctatacagaattgttttagcaaatgtaggaagatgtctttcatccttgcgtaaactgaaggtagtcagcacccagagctggctatctgaccagcttagtctctgatttccagccccccttttgcttaatgaaaaatactgacatactgacatggcaaaaagaagaaatccttatgtaaacaaagtgatgcttattgcttctttacatgtaaataacatatatctttgtcgtgttcagacttaatggttaactttctttattgcgtgcatctatgtgattgaaaactgcatgcctgagatagttcctatcagttttccaagcaaaatctgaatccttctggcctctggaaatgagcctaatccgaaataaaataagcaataatttcaaaatataggtattttcatgacagccccctctacgagttgtaaagaaaacaaatatgggcttgtttctctttccttaagtaaatatggtttctgagtaaaatttttaaattgaaagtttttaaagaaaaacagtaacatatacaaacaaaactcaagaagtcacatgaaaaatgaaaggtcttaaaatactgatacatttgttatgcggattcttgttttaatcagaatctcctaaggaagctgcccctggattcctcagggttggctcaaagcacacagcatccgacaccgtgatgagcattgctggggccccagaatggattggttttgggctttcctacaaacactaaatttcacacaaataaagagactatgaaaagagaaactcacgattaacaaaactaaaattttagctgccttttcttcctctaagttctgtagttgatgaggaggggcttattttccctgtttcaaaattcttcttgagacagagtctctttctgttgcacaagatggagtgtagcggcacaatctcagctcactgcaacctctgcctaccaggttcaagcaattctcctgccttagcctcccgagtagctgggattataggcatgcaccaccacgcccagctaacttttgtaattttagtagacagggtttcaccaggctggtctcaaactcctgacctcaagtgatccacccaccttggcctcctaaagtgctggaattacaggcatgagccaccgcccccggccaaaattagtttttttaataatttaaaataatacacacataatagtcagaagaacttagaagttgttctgacaaaagtctgtaggaaattctgttatgaacaaaatgttgttataaacaacagctacacaccatcccccaaaataaagaaaaattcttctagcactctttgaaccttaaacagtgttttagtaggccaactcattgtttttcttctctctgaaaaattaaaaatgctaactgttatgatgagttccacagaaaaagacaatttccatgacttcatttcttgacaaagaacagctacctctcttgctttctgccacatacaagcaaactcccagacataaaacctcccctcagaggaagcaatatgggaccacaaaagtatcttgaggtctgccctatctgcccacgggaagcctccccctcactgtgagctgtgagcactggctgcctgggaggagcaaggtgtgggagaagagatagcgactgtccccccatgtgctcgccgactgtactgtcacaacctctcagggtggcttctgccctgtcaccacttgatctggattctctctccaaaaatttaaaaaaacaaggcgtgcctgtcttttataatgctctgttttaagagagagaaatctccagggagagaacaggaccctaaaagtccaaggcctggaattcttcctttctctctttccattttaaacaggaagcattcatgctaagagagtccggagggagggctggttgtatgttcatttgaaggcaaataatgtttgtgtgttgcaaatgtcagtgatttatcctaagggcttaaaatgagtgcagaaaaaccacatgtttcacttcatgcagagaaatatcttcagtggattttgagagaaagtacaggttaagaaaaattttttgagtgtatcggatatctccaacatgaaccaaaaggaaatgaaaatgagcatggtgaggtggaggagagagacttaaagaattcttatgataaaagatataccgaaggctggaagttttctaaatcaaaaatgaaattctaaagaaagggaaaggtgaaatccagagcctttatttcccatggctagagtgacagattatccatttgtgctccatttgtcatgggcgatttaaaatacagcaaagcaaactgcactgaataatagcagctgatgctataataacttgtacacaaacaatttaattttttatctgaaaactctaactaaattaccccaagctcaaggatctttcattattatacatagccaaattaagacaaaaaagtagagagaattctattgttcatccttatagatttgttcacaagctgctttctacatgcaccgagctgggagcttgtcaaatcttcattgatttgagcaacttacagagctgttttaacatccacctccacagattacagggtgattctgaccctcattgacagtgcttgattaaccacagacactgtattctcacagccctgtcatttctttcaagtgtcctagcagtgtgtctgacattggggagctttcccttaattattgttgttgtttttcttttttaaaaattataaaagggggagtggcaaaaaaatgggaaggatctggggatggtggtggtggtgaatgtgtgcacagaaggtttatgagattttaagagctgcaaacagaactcatctgtttaaccccaggctagataaaatgcagtcatctgcacattgtttagaggcacactgcttctgttatggcaaacggatcagaagatgcttgttttctttagtgagagatccagacagggccactttctgttagtgtctattcttaccctggatgtttctgtgtgccttacccattacaaggtacaacttacagctggtttggcatttccctattctgctactggactggtgctacttcctggctttgtggtagagttgattactttatatcaaagctttaggtgtgggctgggtgcagtggctcacgcctgtaatctcagtactttgggatgccgagccaggcagatcacctaaggtcaggagattgagaccagcctggccaacataatgaaacccatctctacaaaaaaaaatacaaaacttagtcaggtgtagtggtgggcacctgtagttccatctactcggtaggctgaggtgggagaatcgcttgaacccaggaggcagaggttgcagtgagctgagatcgcaccattgcactccagcctgggtgacagaatgagactccctctcaaaaaaaaaattaaaaaaaaaaaaagagctctaggtgctctggcttgggactttttctaaggactgtagagcatttagggaggggagggacatatgaatccacaccaagatgtaacagcagccaaccagagttagaccaagatgacagcccgtttaaaagagcacctcacagatttagaaaagcgagtgcagtccatggaaactttatgactccaaataacctgaacatttctatcaccatgcctaggacagacttcagcccagcctgtcctggatatggtggtagaaaaggggagggaactaatgaccccatccttaagagaggcaaactcactgccttgtttaggaaactagtttggttactataataaaggccaacagaaaagggtataaaccagattgaagtgtattttcctctcatgcaccaatgtgaatggaagcaatcctgattgacatggtggctccatggcaacggggacccaggctctcaccttcttgttgctctgcctcccatagcacgtggttttcaccttgtggcctaagatggtttttctgctggccaacaggaaggagagaagggaagaagttcccttctcttctttttaagggcacgtatcacttctgctcccatcccattggccagacctatgcggtggccacaccaaactgcacaggaggctgaggaacatgttctccagccggacggccagcttaggagctgctaacatgtgtctcttcttctctttccaggggaggacccgcagatcctgtagactatctgccagcagcacctcgggggctctacaaggaaagggagcttccctattatccaggggctcatcctatgcaccctcccaaagggagctatccccgccccacagagctcagggtggcagatctccggtatcctcagcactacccacccccgccagctccccagcacaaaggaccctttcgacaagacgttccgccttcccctccccagcaccaaagaatgccagcctatcaggaaacaggcagaccagggccccgtgggggcagcccagaccagtacccttaccgaacccaggattcccggcagaagaaccccatgactgcagccgtatag

SEQ ID NO: 1372 - DNA, 1070022 bp, Homo sapiens; identical to SEQ ID NO: 1371

SEQ ID NO: 1373 - DNA, 1070022 bp, Homo sapiens; identical to SEQ ID NO: 1371

SEQ ID NO: 1374 - DNA, 294817 bp, Homo sapiens
tctgacctgagagaattctttttattacgagtgaacagatgaactaaggtaagcgggtctcagccttccgctggtgcagcatctccacgcagggcctcagccccgtcctggccttgcctgaggactgcaccatgggtgttccttgggcatggaggaggcagcaggaaggggtgacaggagcaggagcaggtgcagggcacctcacaccacaggcctcccccacctctgagctgccaacagccaagactcctggcgaggccgggagaggaggggtgagagggaaggagggtctctgtgaaagcaagccccacccccagagcagagcagagacccaggtctgcaaatcacaccctccccccacgagttcctcctttgaggccagcagcacccgagggagggcaggggctgcacggagaccagagaaaggaaaaccccacagaagaaaactcaaagcatcagtcccatgcgtgtctgctgaacgagtgaatgggcccaaaggctcttctctacaaacggcacgcatccatccgacagggggccacaggacacggccggggccgtctgcgtctgtgcctgtgcagcccacaccagtgcagcccggggccctctcagacctcaccacacgcgtgcccagcacatgtgtgcacacgcagatgcaggagagaacacacaccaccgtctctttgcacacgtgtgcccctgtccggcccggggggctcatctctccttcacgtggttctgtgctcccgggcccccgctgccggccccatccccactgcccccactgtggaccccgccggccccgctgcatagcacctcggtgaggtcgtccatgatggcggtctctttggggtccagcaggttgaactcccgagcaaagaggatgaagtggacgtagagcgtgttcaagtgtccgtgcagctccagggccagcgtctccttgaagtgggcccagtagatgtgtgccagcacgtggaacaggtgtctgcagatcttcctcaccagggactcaaaggagctggggaattctctgcctggggaaggccaccgtgtcacaagctgcagacatcccttggccccaacagaggccaggcccctggcacccagcctggtgggtctggtacctgccacccacaccttgaccctgccaccctcagggcctacaaagccccagcagcaacagcttctgcccatcagcaggcaccacagggacttgccaaccccgggtctgggctgctgagacctccctgcgtgctcaggctccggaggctgcacctgccctgagggctgggagctcgttgggccatcctggccacctcctcaggaaggggcctgtgatcgggcactcgggcccccgtggtgtctccctgatggacacttggggccatctcccgggccaggacggaggtggcgatggtggcacaggcctctcctgttgtcccctgccgtccctctggcagcacgggagtggcgtggagccccaccacatcccaccaaaatctggacacaggcttggcggctgatacccagcccaagtgcccacaagctggacggtgagagcagcatgagcggcagaaaccaagaggggcccagtgcagccgcatggcccagagggccagggagatggcccttggccctggctgggctgacccctgcccaagggctccggcctcaccccacagcccaggtggctccatgctaagcagggactggggtggtgcagctgccgccctccgtgcctctgcccctcccggcacaggagcttggtcacttgcagacacgtcctgaatgctccctgccccactgtgaggatgaccgcccagtgctgggggagacgaaccgtattttgtggggaacacgtcctcatccgtcaccagcttctgcacggagctcatgacgaagtcaacgtactgtggggccgtgcacttgaccttcttcccccgctcgtcataccagtagtactgtctgtggagacagagacacggtcagggcatgcgcccgctgcacacccacccagccactgggtcccacccgctcaggtcatctgcgggcagaggtggcgccagcagcggaggtgtggcagacccaggtgtctccctccctggacatgcacactgtccccacacactgtctgcggggaccacactgcactctatggaggggtctgcctgcgctgacttagaactacgccaggatcacgctggggagcctgccagccacatggctgtacaggtgtgtgattaaatgaaggggtcatcttcgttttctccgcttctacatggcttcagttgtattcgtttacacaagtgcgtgctgctgtttttctgttgtattttgaaagcacacagaggctccttctcttcccaggaagctgtgctgtggctcgccggccaggccccaccctttgggagagccctgctctgactgctagaagccaagcccctctccggggaaagcagaggagggcggtggtctctgtgggtacctgcggctaacagcctggccaggacagggacctggccccctcttgcccctgtacacaagggcggccagtcctcatgtgagactcgtggccccagagcaggctggagcatcctagggacatggacaccctgggtttgcctcttactgttgggtccagccatgacaagggtgtgctctagttcatgttaatataaggtgacccccagcccctaacacccctcctcccccagcacaacaccaaaacccagggcacccacctggcagccaccacccctctccccctgccacggtgctgggtctcagtcctccaaggccatgcccacagcggccgcccccgcaggcctgaaccagggcatgctggggccgatgccgcagccccacccacaggcagtggagagtgctgtggtgggagtgctcacacctgagacacagccaacactatgggtcgggatttcctccctgagagccagctcccagctcaccacaggtgggaatgggccacacagcacagagcagtactggccactgagcaaacgccccctccacaccatggccacaaccaccatcgcctccactgccccagctagaccaacaggcagtctgccagtaccaggctccacatgaaccgctcccaccctcctcatccagtcacggttcctcttggaatggccctgggtggggcagtgctgaaaaggatggacccaggctccactctggaggccactcttctcttggccagctccaagcatcgtgccctgggttccagagcccaccaaggcacctggggagacgccccaagggctgagacagggccacggggggctcgcccacttcctgcgcagccagagaagccatcctcccagctgggcacagggcctccagtgtctccgggcacagggcctccagcgtctccgggcacagggcctccagcatctctgggcacagggcctccagcgtctctgggcacccctctgctgtgtccaagaagcccctcagcctgtgcactgcagatcccggggggagtcaccagagttaccaagaagctagaggatgacactgcaagccctgcatgctggcaccctgccctctgcaacagaaacagccatcaggccacctcccagcaccaccagggccctaggacaaccccctcccagcacccacctccagaatgcaaaccaggagctctcatgtgtgccctgtgcggggctgactcagcccacccgaaggggaagtgcagccccaaaatggacaggccatgaggacggggatgcagtgcccacacctgcctctcaggtgctgtcctccccctgggacagctctgcatgaccttcacgcccaccttcccaggctgcaggcctcaccgtgggcatcgccaccaggctgtcagaccctctgagaatgcagagacaacagtcctttcagcatctgctcctcgagaatgatgtagaggacgcacgtatccccactgtcctggggttcccagatggtgtaggggaggcccagcccctaagggccaggctgaggcccatgtttccagggcgaggacccagccaggatggctcagcactctgcaggagtcagacactggctccaggtaccctgacactgcaagctgacatctgatgcacctggccacaggtgtgcgacaggtctcaaaacagtggaggttagagacggaaacccttttccacaatgcaaacccagagaaagcagtaactcagggacactgtggattgtcccatctgttctgaaagatggaacaccactgtttcctgtacttcttcaattatcagtaaaccgtttctggtatatagttctaagatttttatccacatgtggactcacgcattcataaccacaatcaggacacgcggcggcttacgtggcccctcacacccgtgctgctgtgcccccagcaccccggggatggctcctcagggatgggccgcgggaaggaatcgcaccgcgcggatcctcccgatctgggcccctcttgcacggaggcccctgggatgcagtcacgtggcagacgtgtcggaagtccacggctcctcactgcccagacactgcccctgcagagatggacatggcgtgctcatctattcacctgtgtccctgccagcagaacagagtcccaggtggccacatcctggccagcaccagtgtcccgaccggcatgtgggcaggtggacatgggtctgcccatggtttcggcttgcctttctctaattgctaacaacacaggatagccccagctgccatccttacaccctctttggcaaactgtctgctcatttcttttgctgacagttaactggactgttttgttttcttactgctgagttgtgtatgttctttatgtattctggatatcagtcctttgtgggatgtgtgatttgcaaatgttttctctcccagcctggagtttgtcttctttctcttaaaagtgtcttgaagcaaaagttctgaattttgctgcctagtgtcaggtcataaggatttcctatggtttcttccaaaagctttggagttttagatgtttgcacgaggcatgagggataggtcagcgtttggtttttgacacaaatgactgcttttcccagcagcatttttgaacagactaccctttctcccttgaatttattttgctctttgtcaaaactctgatggccccgtttgtgtgggtctatctccggactctccatccacacgtttgtgtggggctgtctccggactctccatccacacgtttgtgtgggtctatctccggactctccatccacacgtttgtgtggggctgtctccggactctccgtccacacgtttgtgtggggctatctctggactctactgtgttccatggagctctgtatccattccttcaacactgcacactgtcttaattactagagtttcacagtaagtctcaaaagtgtgagattcctcttattttttcaaaatcattgtagctatttcagttaatttgtccctccatataaattttagaactaactggtctatacttgaactctgctgggatttggattgagactgcactaaatcaacagatcagtttgggggagaatttgtgtttggagtcatcttccaggtgataaacgcagtgcgtctctccatttatgtagaccttcgattttctgtaacagcatttcgtagtttccagggtgcagatcctgggaatgtcttgttaagtttataactaaggatcgcattatttttggagctattataaatggcatgttaaatattaatttcagttttaaatttcacattgctaatatacagacctatgactgatttgtgcgtgttgacctcactaaatttatattattatttgctacaatccttgaggttttcccaatcacacgtgtgcacagggatacagcaatcccccccatccacaggggatgcactgcaagacccccaggggatgcctgaagccacagagagcaccaaaccctatatatgctgcgctttctcctatacatacattactaaaataaagacaggcagacttgattgattgactgagatagggtctcgctgtgttgctaagttagtctcgaactcctgaagtgatccaccgcctcagcctcctgagtagccaggattacaggtgtgagccaccacacccagtgtaattcataaactgaggacaatcagttgcagtgagtggctggggtcgcatatcagggggtcccttgctggcctcctgcaggctcaatggcaacacgctgctgctcccatcctctcacctcctccacccacagatccaagtactcaacacgcactgtggctgtcacttttgcaatttcagatgtaacagcgaaattaaagggactttttttccctttttcacaatttcataaagaagagatttgttcttaccttagatcttagcaacctcacacacaatctgtttctttctagtcaggaactttcaccttttcatctttaggtcaaggaagtgctttctgtcttctctttggcatatctgaattgccagcatcacgctcttgcgctttgggccgcctcatgtcacataagagcaacctgagcacgagcaccctggcactgcggcagtggatccacacgggggccgaggcacagctgggccgagggaggaggaggcacacctggagcaggacggtggagaccgcatcacactgctcagaacagcatgcagttgaaaacttattaactgtttatttcgggaattttccattaactattttcagaccatagttgactgtgggtaacggaaactgtagataaggggggcttattgttttatttcttttccaatttggatgccttttattctttcttcttaccttatggcactgcctatcttaggcgagttctgatatactgcgctttccaaagagttggtccatttaacccaagccatagaattcatgtgcacagagggtttttttccaatacttccttattatccttttaacatccactgggtctacagtgatactcctctttacatccacagggtttagtgacactcactcctttttattgatcattgcatcttctctcttatctttgtacctactaaaggcttaccaatttattacctttcaaagtcatcacattttgatttcactcatttcccctattgttttaaaaatcaatctcagtgctttctgttcttatttactttcttgtccttgattttgacttattttgctctttttctagtttaagttggaaacgtagattactgaaagtcatcttctttttctaagaaagcattaatcctataaatcccctctaggcactgcttgagttatgtctcacaaattctgacatgctgtattttcctgtgtacagtttgttaaagtttttttgttgaggcatcctctcggacccatggactactcagaattgtattagtctgcaagtgtttggagactttcctgttctctgttactgatttctaatttaaccccaccatggtcagaaaacttacttcgtatggttttgattttttaaaatttgttaagggctcttttgtgacaggtatgctccatcttggtggctaatctttgtgaagttgaaaagatgggtgttctgctgttgaggctgcagtgcatgtgtcatttcaatccaacccacgggtggggtcatcgggctccgtgctctcgctgactgtctatgaggctccatcactgaggagagggctgcaatccccggcgatcatgtgatttctacacaggccgtccgtttgctttgtgtggaaagccctgttgtctggcgcacacacatttatggcaggatttcttcaagagctgctccttttctaattagataaccttcttattcctggtcacttccttcctcggagtctcctttggcactgacatagccacttccgcttccttctgatgggtgttttctcagcacatcttgtcctcttacttctcacccgcctgcaccacagcacctagagtggtgtgacacacagggtgcttatgccccacattcctatgttgaaagcttaaccccagacgcaagggtatctggagatggggcctttgggaggcgatgaggttgcaagggtagaacgctcatgaacagaactggtggctccgtcgccctgccttccttccagcaagaaggtgctgtctgtggaccaggaaagggaccctcaccagacactgaatctggctaatcagatccagtgacgtggtcagtgcccccttcctggtccacagtggatcttcaccttggactttcagcttccagaaccgcaagaaataagattctgttgttcacaagccacctagcctatcatgtttcgtgacagcatcccgaatgaaatacaacaaatgagcttcttgtaaacaccagagagttggttattttaaaaatacattctcataagctgcccagtcccgtctgttcatctgttagcatttaggttttccactatttgctgtttgttgcctctgtttctcattccttatggtatttcttctttcctgctttctcttgggccactgaaatgtttttgtatttcatttaaatttacctattctgattctgactgcgtctcttcacataagctctgcaaggcctgctcaaagggctgtaacacgcaactcaaccccacatgctctccatggcacccacacatgtgcttccactggagcatagcagctctcttgcccacagccccaccgccgccaggccccacagccgccacagccccaccgccaccacaggccccacggccgccctggaaatggcactgcacaggccccacggccgccctgggaacggcactgcacaggcactgccggacactactcttgtcttcttgcaccatcactggcgtctccacaaacactcagtgggaggaggccctcctgttgggagaactctgcagggagcctctggaacaggtctgctggctgtgagggctcttggttttgagtgactttggacactgactggatgtggaattctgggatgacctttcttttctcccagcactggaagatgtgtggggcttccttcttccttctggcctcctgggtttctaaaagtgccacggtcattcactgcggcatctgttgtcagtaccaggccaccgccgtctgactgctgacagaggatggctgccaagggctttttctttgcccccagttctcagcatttggttgcatgcatctgcacgtgtctgtgagccttatttggggtttgcttagcttcttaagtctgcaggtttgtgtctttgtgggaagttctcagccattattgctgcaatgtgtttccggccccgccccctttctcgtctccctaggagtcagacatcagcctttttgggactgtcctacaggccctagcagggaggagacgcgcctcaatcccagagccctcacacgacccaggcagacttgctggtcttttgggtggcaagtggccctgaggccctctgagaagtctccatgtttctcttagtttgagtggatttctgtcccttggtttgaaaggattcctggaaaggcattacatgcaattaattcacacacatctactaccaccatgatgccagctccagatgagaaggaccaagaggcaaatctgggtggcctaggccctccaaggggacataggtctgcccaacaccacatcctacactcctccaaggaccccttttccaaaccaacccagtaccacagaacatgcaggagcagagcctctgggaagggtgccaggccccgtctgcccaggagcagaggcgctgagccagcacttggccacaggtggctccagagccacagtggacacaaggctctcgagtagctctcgggtgctgccctgccacctcaggacccatctccatgcctgatccatggaggccaccgccgtctcacattgagcttgctcccctcaaagccataagcactgtccccatcttcctgggccatgcctggctgtgacacctcattttcctggggaattaagacagtgaagccagctgttgtctgtacctgccccggtgtcacccataaccaaaccaagctgtgacccatcatggccatgagggcagggcccagcaggactgaagccaaggggacgcctgccagctgcctgtgcagaagctccccttggcttcttgaaggcagaactcagctttgtctggggaccacgtctccctgtgccagggccaggaaagccatgtctgtgggcaggatgactttcaggacgcactcacaggcacacattctgtccctgacctgtgtgcactgacaacaacgggacatcagggaaaagcttccgccctcctcagccgcacatgtcccaggctaagcccagcagacccagcctcctcctgcctgcagcctccaaggctgctttcagcaacccaggcctggcggcgctccttcccatgctacgcaagtgaggtgctcagggccactaacggacacccatttactgaggaaatcagggtgcagtgcttccaggagagagctaccagcaccaggcatgttggatggtcacggagaaggtaactgagcccccatgaaatgaatggccgagcaaggacctgtggcctgcccagcccagccctcactgtcccatccagagctgtcacgggagccagcggagaagggctctctgcaatcttagggcattccttctggaaacgtctctgtccctagaaacatagcccatcaacccccaccagctcctgcaccttctgggccccactggggacctgggtagctgggccactggcccagcctgtggcctttccacaggaaggtggatgttgtggaaggcctgtgccaagacttctcagggtctccaggtgagaacggaatctgagaggacaggagcctggggcagcgggggctcagagccccaccgagtctcccaagagaaagtgggctgtagccaggcagcactcacgtgttgcacacggccatcgtctgacacgtctctcctgtgcagaactcggagatggtgctatactgcaggttgatgtggtggaaaaacgtcgtggctggaagagaagagaaggagccagatgtgaaaaacgccagagctgagccgccccgtccacccctgcttccagcaacaggtgcaggagctcggctgggtgagctctgcccgtccacgggccacattctcccctcgcggcagggggctgctgagcaccagccgtgggggtcccccttgaggaggggcttcgaggaggagcagggaggagggagggggcccgcccccaggcccccgcgcactgttgctggccagccactcgttaaggtcaatctcgcggggcagcaccaccagctccttgaactggaagtcggtgatcctggccttggtgtgctcaggctccaggtaggccttcctctcctccgcagcgggcttcttgccattaggcttggctttggacttcctgccaagagaggagacgcggtgtggtcactacacgcccatcagacccagggtctgcccggggggtcagttgtggccagcgcaggtgtagagggagctgcccgagcccatcggggcgacactgcctccctgccaggctcaaaggacaccaacgggacaccaacggtgaggctgctccgcagaggggccagtggagctgccttgcgtggcacctcctgggaagaagggctggcgctcccacttgccacacgggcccctgcacggagggcatcctcacccctcaccaagtcctccaaccagggaggggcccagggtttagggcccccagcgcccaccttccagttttccagtgctcttggaaggaaaggagaagcaaaccctctcactcctggcttcttttgagttggccagcctgtccctgcccctgccgctggtggccccggtgaaaacataccacaggccttgtgcagggcacctgccttcctggccagcctgagagcacggggcccctggcatcaggcggcagcctggcctgcagctccagtatccctgttgtccaccaggcctggggaggccacagggtgatgaggatgggggccaaaggtctttgtggcaacctgaccctgtccttattttttttctttcttgttttgaaaagttgctaatggtttatttaagagaaagagaaaggaaaaatgctccctgaatgccagggaaatgtttccctttcagcttctcacagcagatcttcgccttaaaaggagaccagcgcaggcctctgggggcagtgctgggagtagccagagccaggcagggagcaggggcaggagcaggggcaggggcaggggcaggggcagggaggggcaggggcaggggcagggaggggcaggggcagggcccctgggccctggcactcccactctgccatctctccagagcacagggcgtggggtctgaggaagaggaagcacaggtgtggatgggccacatgcagcgtgggcacttggggtcctcacagtacaggggtgggacagacagggtgagcttccgtgtagcctgcagcccctcgccccagcacagcgaggcacccagactccacaccagcctgtgccaggccatgcccagcgtgtccaccacagggaaggctctccccatgacgctgggcctggccctgaccaccggcaggtgggcctgcacctccctgccctgtgctctcacagcacagcacaccacaccccacccgggcagctacagcctgggctcggccttcccatttggaggggtgggttgcagtggcccaggctgccaagcgggctacaagccgtctccctgctctgtgtcttaggagctgtgtcaactggcaagctccaggtggcagttacctggtggtcggtcacgcagggctgccagcaggagcagctgtcagcgcgctcactctcagggtgtgccccagggcccactcagggaggctgccctactggcagttcctgcccccttgccagccttccaggctggggctaccttccacctccggtcctcagagagggctgggcaggggcagaacctggagacctggcttccctctcccaggctctggctgtggtcaggaggtagtgagcagccgccactccggcactggcacctcagcctccctgcctcttcccgtccacacctgctctcctagaacacagaagaaaagtacgcacgaggccctccaggctgggcctccccgagctgctcccccagtctcaccctgtccccagcacccagggctggccgggccccggagcttagtgcactgtgagacaagcctcctgcaagcctaccttctttggaccgggtcactcattcccatggggcaggtggacgggcactggcccaaaggtagtaggaccaaggggacgcgcaggacatggcctctgctccaggaacggctgtgcgggcaccaacagagggacttccatgggaaagccccgaacgcctggcagcacccacgtctccctgacctcaagtgccctccttcccagaagggcaggctctcagcgaaggcccaggcctgggcaggaagcagtcactctgaggcagcccattgctcggtccaagccagcggcagctaccgaggaggcctcagagcacacgacacctccatggcactcttctcgtccttagtcattcttggctttgcccagtggagaaaacacctctgcggcgccccccgcaggctcacaggctctgaaacaggctctgtgccgtccaggcccagaggtctgcccagtcactgcctcagtggcccagctgcccctcacccagggaagtgccgaggccctgcgccctgctcccagctccccctgtgctgctggctaggagccccggggcacagaaagaccaagtccttcgatgtggagggaggactgtgggagcaggccccggccgcaggcaggacagagatggcgctgaagggactggggagtggaccctggacctcagcccacccacagggcttccgtgaccacttggaagaagcagaagggcagatgctgtgtgcacagcccccaaaacaaagtccctcacactattccaacaggtgggctctgagcctgggtcctgcctggcaggcaccatgcacttaggagggccgggccagatggaaccacctccttcctgcctcccacacactcaccagcctcacctccctcctccctgctctagatgacctgtcctgcctgccacaggggtctgcaccctgtttgtgggcaccagctgctgctctgccaacttgcccatcttacaccaggcctagcaaacttctcctggtcctttaagagcctgtcaaatgccaccctccccattctcgccagtggtacccatgacgtgccagtcggcctccttggcacccagcacgtaactgatccctactgggaagtgaggcaatccctgctagacacaaatttggtgggcaagggaaggggcacagggaggcatcagagctgctgggctcccgtggaaaacttagacaaccacacagtcaacacacagggggtctcaccctgcccacagcaggtgcacactgcttcacaggcagggggagctggggagtgggctgggagccgcccactcctcatccgccctgagggacgaggacagcacaaccgagtgccctgcacctttgccacgagtgtcaacttcattatcacagggatggaatcctggccaggccccacggcccacaggaatggggtgctccaggctcagagacccccactcgcccagagcacgcttgctatggaagtcgagcctgtagaccctgaggtgagtgggcagcagcaggaggtggccctcatctggcacttcccaccacaggtcaacgccaaggggtggggcaggcacgaggggcccagaaatacaagtccccaagcccaggcctggaaaatacggtgaccaggcagcgtgtggggtgcaggagaaaggcccgcaggtgacgcctctgaggagggcatggtccttggaccccactcagccatctgcaccgggcccctcatgctccttggttcgggtgaatgtcagtgctggttggtccacccagagcctgaaagtcaaggctcccagtgaccccttcccccaagacccggccaggcagagcccccagtagccacccggtacagagcctgggtctcagcacaccttgctgcccagggtgcacgccacgggcacctcctgtcaccccaacatgcagggagggcaccacatgctggggtgcttggcgccacccccacccctacatttctgatgtggccttctgggtgttgagggggggcctgaaaactgcatttctaacaccgtgttctaacccgagttctccctgggtgctgatcccacttctgtcacacggcctcaggctgaggggtgggaaggcctccggagcccctgtccatctctcagcacagcctgcactgcccacaggcttcagccagctggaagctgtggagtgtggcttcttttcttctgagtttaattgtctgcccccccaaacaggtcagcagccccagacaaagcgagcttttaccagcctactgtgccctctgcagaggcccattgagaaggaaaaagccaagatggcacaaggaacgcccgcagacatcccagaccaaacgtccaaacaggcaggtgctgctgctgtcctagaacctcagccccacgtggccaccatgctccactgcgcctcggcccctccatgcatccagctcccagccaaggtggcttcctcatcgcttcctttgaaaccttcctgagccccagggaagggactccgcccgtcttccttagggcctggctgggctccaggcctgcctctgtgtctcctgtggagctgccttcggcatttggcctcagacacacaagcacacactggcacaggcacacacacacacacgccagtcccctcacaccactgatgtcaggcaccattcctgatttgaactcacgagtactgccaacttgcccacacatttccaaaacctcacagtttcaccttaagataggacatcctaggcagggtcaccggccggcactcttgtgtctacttgtggagccctccctgttgaatgcacaggtgatcgggagatagggaaggagcctatgaagagaaagatggagccgggtgcccagggacaggcagaggcacggagatgcacacgggtgccgcagcccccggcccttggagggcacgtccagcaggccacgctcgcctcacacccccaccaggcaaccccacccgggaggacacactcactgctgcagctggctgtgcctgccccactcccccggcccctcatgcccacacacgggtgcacactcccacacacacgggtgcacgctcccacacacttgggcgcacactcccacacacgcccctgcacacaccgagctgagtggtgtgggcagggaggcacccccgcagcaggtcagagaaagtacaggtgagaaaaatgtcaaaaatggattttccggcaacatccctatggcagccagcacaaaaataggcacccgggaaccccatgccacttctctggacaaggccacacaaggacagactccgggtcacctctgcctgggtggctgaagcccctgcccagggcacaaacagccgcacgctgggacaaagacaggcacacctgctggcggctgaggaaccacaccctgtgggttgcgggaggacaaggcaggctcctgtgccggcaaggtggggtcaaccccgaaggtcgaggacaccaagacccgctcctctcccacagagcaacaggaagtgcaggcggctaaggaaagccccactgggcagggctccagagcaaacccgccaggctggcccgggactgcacagccgcctctgccctggacagcttgcgtgtggcccagcacagctcgctgcacagccgccggccacactgggagggcagccacggacacagtccgccgcctccccaccctgacctccttcctgggggcaagaacagggcagacagatgtgctacacacccctcccccagccaggctggcaggtgttacctgagcactttgctgacagcctgaagcaccattttgcagcagagtccactttgcagggactggccgggccgggcttggtcttcagggagactgcagtggtctcccagcatgagtgggcgacgggaaggtggggaggagaagcggggcggggtgccggctggccagcactcgcaaatgcctgctgccgggccctccagcctcactccctggccaatgggacgcctggcagagacaaacagctgccccctttccagaggcaagggctggccaaggctggtgaaacgagggagcgtctgaattggccttttccaagtggcatggctgccagaagaggcggtgggggtgggaccagaagggaggggacagggccgtccttggcctgcaagaagggtccatcagaaaggtcctgggctccacctcaggctgccagaagaggcggtgggggtgggaccagaagggaggggacagggccgtccttggcctgcaagaaggatccatcagaaaggtcctgggctccacctcaggctgccagaagaggcggtgggggtgggaccagaagggaggggacagggccgtccttggcctgcaagaaggatccatcagaaaggtcctgggctccacctcaaggtcctctgctgccaagcccccaggaaaggccttctgaacacaggcagcaactctgctgacgagctccaggtcgatggcactcccctctcccttgtccggcccagcctagcccagtcagtgctcgggccagggacggacagacggacagacagatgggccgccctgccctgcagtgtgtacgcagctggaggcactcaaagtggctttcctgctggatggccctggagagagaaggggccgaccagcttctgcggtgcctggacggtgctgggctgaggctgctgccagccaggaccacagggcacccagcccaacagaaatgcccacagcagctccccatgggggcgcacagagcggcacggccccggccttccttctggctggtctgcacacaggagaccaccacatcctgaaaatgcaaacacctgagagggcaatgctctctcctcatcctgagtcagcgtggaccccactggcagtgacagccccctgacaacacggggtcatcaggagcatcccccacccgcatgggagccatacttcctgtgcttcctgccaatcaagagaccccagcatctccagccactgcccctcagaagctgtcccagcacctctgtcggtgtgaagccctgtaggagtcaggacacagcctgaggtaccagctgctgcggggagcacagagccatcaggaaagcagccagggtaggctcacccccatcaataccagcccccatgggagttgtggtgtctggactgcacgcacacacacagcctgggcgcacggggagacagcacaccaacccagcacagacacactctccaggagccacagcagaggatggccccaggccggcccccgcctccctaagcagcagcagcagcaggcccaacaggctgcagtttcattttccccactaggccagtccctaagccatgctctgagcagtgcgtaactggtctctacagaacaaacagcccggtgaggctcaggacgtccatgcgcccacaggccttcctctgccttggcaaggccatcccacagccctgtggtgccacacgcacctaggcaccgtgctcacggctgccggtctgccctcgggggctccaccaacagcagggacacaggtgctggcaggtcacccaagtggcaaagggagccacaggaagagcgggctccaggcctggggaggcccccgtgagtagcagggctgggaccaggaggtgcatgacgcagacctgcccactctcgggaggcatggcctggacagagaaggccgtgcagaggcccatgacagggagaatgagctgctgggggttggagggcagagcataaaggaagctggggatggtggaggcttcgggcacaagaagccaggcaaccaggcaaggcaatggtgagggtggcacgggggcgggggaacagtcaggacaaggtgccgggtagggtggggggagcacaccaagcgtgcctagtctggtccaggcaaggcagtggtgagggtggcacgggggcgggggaacagtcaagacaaggtgcccggtagggtgggggagcacaccaagtgtgcccagtgggtctggtcagcacacggcagctctgtggcttatgccactgtcccgagagggctgggctggcgccagaggaacgtccacattcatctgtgtttgttcactgggggacacgtgcagggagcaggtattcctattgatcaaaacttaggtagtggggcaggagtggggtagggtgaggggcagctggaacccacagacactgagcgacagacactgcactgggaagaggagcagacctggagcaggctctgcagactccacgaggagctgccacagaggcccgcaggccagtgacgggtgccagtgtggcctggccccgccaccccagaaaaggaagagcaaaagcaccttctgggcacagccagggccaggagctggccaggaacagagagcacaggagcggggcagaggcaccacgcaggggggaacggtcgcaaccaaggcgggacggggcagggggcacgggccatgtgtctgtgtcagaggttattttacctttaataagcttttagttttagaaaagtgttagatttacaaagaactgcaaacacagaatccccatggccccccactcactcttcctattgctaacccttacactaggatggtctgtttgttaacaatgaacaaatccacattgatgcagcaaggtccaaacttgactcagacgtctggatccatccattgctctcctcacgacgaggctgggctgtgggtgtgggtaggaagagcacagagggaaatgtccccctcgtcgccccgtgcccacggcccgtcctgtcagcacggctcatcgcgggaggtgctcccgatctcctggctgaggctgtgactgccaggcctccccacgcaaagacgctctcgtcttccccgccccgcaccgcgctctcgaacgaagctgctgcacgcagaccacactgaaggggtggggaccaccccttaccaccctgacggaggagtagctacgggaattactggaagttcggcaccagagagcggcctcttcttggtcactcatttatatattcagccatttgtttatattgggatgaagtcctggctattgaggctgcactccgagctagaacacaacactactttgttttgtgaatcacactgtccgtccttggccctggggagctcctgccatcagctgctgggtcccctgatgcacccccatcaacagacttttcattttggggcatgtcctgatttcctggcactgcagggtgctccaggctccccctgcattcccagccccagcccgggaatcagccccttctccaaggagccctggttcttttcattagaaaatattaaaaactggccaggcagccgggcgtggtggctcacgcctgtaatcccagcactttgggaggccaagacgggcctcccacaaggtcaggatcacaaggtcaggagatcgagaccatccgagctaacacagtgaaactctgtctctactaaaaatacaaaaaaatcagccgggtgtggtggcaggcgcctgtagtcccagctactcgggaggcggaagcaggagaatggcgtgaacccgagaggcagagcttgcagtgagctgagatcgcaccactgcactccagcctgggcgacagagcaagactccgtctcaaaaaaaaaaaaaaaaaaaaaaatggccaggcatggtggctcatgcctgtaatcccagtattttgggaggccaagaagggaccatcacttgagcccaagagtttgagaccagcctgggcaataaagggagaccccatctctacaaaaaatgtaaaaattagccaggcatagtggtgtgtgtctgtgttcccagctacatgggaggctgaggcaggaggatcacttgagcccaagagattgaggctgctgtgacccataatcacaccactgcactccagcctgggtgacggagcgagaccctgccccaaaacagtaatgaatgaattcaaaactgagacctggtcaggcacgttgattcacatctggaatctcaagagcactttgagaggcccaggtaagtgaatcgcttgaggccaggagtttcagatcagcctgggcaacacagcaagacccccatttctaaaacaattttttttttttaattatctgggcatagtggcatgtgcctgtggtttcaacaactgaggagctgaagtgagaggatcacttgagcccaggaggttggtggctgcagtgaaccatgactacaccacctcactccagcctgggtctacacaaacgagaaacgaaaacactaagatcagagcactgggtgggctcgttgctagtgggtgtcactgcttccaggccctctcagctggaagaacacggaggcacatgtgtatacacacatgcactcatacgcctcaatctccacccacatgtcgacatttgtatctatactaagctaagcaggggttcccctgaggtctccagcccacccctgcagccatcactgcctggaccacactggcccctccacttgctcgtctgtagcctcccctccaacaaggagactcgtggagagcttcgtgtttttaatcactttgtgaaaacaacagaagaaggagctcaaaagctacggaagcagcaaaacaatgcccccggcaccctcacaaaggcacagggaaagtggggtcacttaaaagcaagcaggaaagtttcacagttgagtccaatgaaaatcaagaagaatagaggagagtaacactctcccactgacaattaaaacatcccagaaagacacacacataacacagacgaaatcacacaacacagatgaagacacacaacacagacgaagacatacacataacacaggcagagacacacaacacagacgaagacatacatataacacaggcggagacacacaacacagacaaagacacacaacacagacgaagatatacaacacagccgaagacacacacataacacaggtgaagacacacaacacagacgaagacacacaacacagacgaagacacaacacagatgaagacacacacattaacacaggtgaagacacacaacacaggtgaagacatacaacagatgaagacgcacaacacagacgaagacacgcgcataacagatgaagacacacaaagacacacaacacagacgaagacacacaacacagatgacacagaacacagatgaagacacacaacaaagatgaagacacaacacagatgaagacacataacacagatgaagactacaacccaataagacaatcagggaaacaatgcaatttaagaaaatatttgaggccaggtgcagtggctcatgcctgtaatcccagcactttgggaggctgaggcaggtggatcacctgaggtcaggagttcaagaccagcctggccaacaaggtgaaactctgtctctactaaaaatacaaaaattagctgggcgtggtggcaggcgcttgtaatcccagctacttgggaggctgaggcagaagaatcgcttgaacccaggagatggacgttgcagtgagccgagattgcaccattgcgctccagcctgggggagaagagcgagactttgtctcaaaaaagaaaagaaaaaagaaaaagaaaatatttgaaaaaagaggcaaaataagaatcaggaatgagaggataaaccatttttgaaatgaagtctaaattagaatacaaaaaccaccatgatgtccaagtagaagatgggaaggaagaatttcttaaaataataaaggaaagaagagatttctgcttccactcatgacagagtaactgacactggacctcacctccactgtcaacaactacaaactgggtagaatatatgaagtgcttggcttcagacccaggataccgccgtgcaggacggtggcccctgcgcacaggcgatgactgggagcctctcaggctgcaggtggggatggtgaaaccacatggggcctgcagtctggagaagctgaggtggcagggatggaagtctcaagccgctgagctgttgaaatttgcaggatgaggaggcagtcaggacagagctgcacagagaagggactctaaaaacatcaacagggatccaaggaagcttctggacaaatagctgagggtgtcagagagaacatctgcaagacctggcagagaacagctctgggaagcgtgaggaagagaggttctggaggccacacggggcaggagacagacgtgttcccacacccagactggagacaccttgggcgaatagatttaacagagattccacaatggctgtgccatggggactgggctacaatagcccagagtgagggggttctctggacctggcataataaagcttaaaaacaagcctcaaacggatcctagctaaccaagagcaaattaactgccttccagaacaaaccacactactctttaagggaggaaaacagaactgagactttcaacaacattgctaccacaatacctagtgtacaaaaaaattactagacaggtgaagcagaaaaatgtaactcataaccaggaaaaataagtcaacagaaacaggcctagagataacaaagataatgaaagtaacaaacaaagactttaaaagaatgaaataaatatattcaacgatttatttatttatttagacagtgtcctctattgcccgggctggagtgcagtggcacaatctcggctcactgcaacctctgtctcccaagtgattctcctgcctcagcctccagagcagctgggattacaggcgaacgccaccaagcacagctaatttttgtatttttgtagagatgaggtttcaccatgttggctacgctggtctcaaactcctcacctaaagtaatctgtccgccttggcctcccaaaagtgctgggattactggcatgagacattgtgcccggccaatatatccaaagatttagaggaaaggttggacataatcaacaaagcaattagggctctgaaaaaatcggaaactccacaaaataataaacaaaaattcctggaactgaagaatacatcgaaaatgaaatttttgagatgaaatgaacatcagattaaacagtgctaaagagaagattacaataaaaacatcacttataaaaatgtgtagaatgcagctaaagctcagctgaggaagaaatttataaatgttcatattaggagagaaggcttaaaatgagtgattcatacatccaccttcagaagccagaaaaaggaagtgcatattaaatgcaaagtggaaggaaataacagaaatctatgaaatgaaaaatagacaaataatgaagaattaaacacaaagttagcctggaaaacttaaaaaaaaaaaaagatcaatttcccaagcagactaagcagaaaagagacagagagccaagagaggaagagggcataaattaccgatatcagaaatgaaagggacattcctacagatcctacagatattaagcgggtaacaaagcactataaggaactgaatgccaagagaaaatgtagatgaaacagacaaatttttcacaaacacaagctaccaaaactgacatacaaagaagtagaaaatctgaatttataattaaaaatctttctacaaggaaatggtgggtgcaggtggcttacggatgaactctacacacgatataagtaagaaataatacaaaccatacacatactctttcagaaaacagaggaggaggaccagcataatgctgctgccaaagtgagacaacagcattcctagaaaagggaaattacagcccaatatccttcatgaatgtggatgcaaaactctgtaataaaatagtaacaaactaattcaacaacgtattgaaaggataatacagcatagccaagagagattcacccagtaatgtaagcttagctaacacctgaaaatcaatgtcattcaccacattaatgaaaggagaaaaaaatatggccatctcaattagatgcagacacagcacatggcaaaacgtgtatgcaaactctcagcaaaccaggaacagaagggaccatcctcagctgagaaaggacacctataaaaaatctgaagctaacatcaaatgctgctgatggagtaaagattttccccctaaaatcagaaacaaggaaggggctctgagcacttctcactctcaccactcttattcggtgtcactcttataccagcggcacaatgaggccactgtaatgaggcaagacaaaggtatacaaggcataaatactggaaaggaaaaggtcgtcttgtttggcaggtaacatggttatgtaaacagaaaagtctaaggaaactggggcaagtctgctagaactaataagtaaatttagtggcatcacagggcacaaggtcagtaaagaaaattaattttattcctatataatagcaacaaataaatggaaaatacaattataaaactgctatttacaatataatttttaaatttaggaataatcttaacacaaatgtacaaagcctctcactgaaaagcacaaaacaatgctgagaaaaattaaagacctaaacacataaaaaaatttgccatggccatggattagaagactcaatattgttaagatgtcaattttcttaattaaatacaatcctatcaaaatcccgggataatttcttatttttaaaagaaattaacaagaagattcttggttttttgtttgttttttgtttgtttgttttgagacggagtttcactcttcttacccaggctagagtgcaatggcacaatctcagctcactgcaacctctgcctcccgggttcaagtgattctcctgtctcagcctcctcagtagctgggattacaggcacccgccaccatacccagctaatttttggtatttttagtagagacggggtttcaccatgttggccaggctggtctcgaactcctgacctcaggtgatctgcccacctcagcctcgcaaagtgccgggattacaagcatgagccaccacgcccggcctaacaagaggattcttaaatccacgtggaaatgcaaaaggactttgaaggatccaaccattcttgcaaaagaagacccaagtagcaggactcacacgaatttcaagacttaccttaaagctacagtattaaacaccgaaataaacataaataaaacagaataatgttcagaactagacctacacttacatggtcaactagacttcaataaaagtgtgaaatcaatctaagggggaaaggaaaatgttttaaataaatagtttggagaaaactgagtatctctgaagaaaaagaaaccttcaatccctacctcacaccaagacggatcagaaactcagacataaaagcaaaactacaatgcttctacaataaaacacggacagtatctgtgccaagctcaaagtaggcaaagatttcctagaatgtaaaaagcactaaccaaaaagtgacaaaatacatttcatcaaaatttaatcatacacacacttctattcaatatactgttaagaaaaatgaataggcaagccacggatggcatatatccaacaaaagacttctagctaaactatagaaagcaggtctacagttcaacaataaaagagacaactcaacatttaaaaagggcaaaagactggaacagacattttacataagaagacaaataatggccgataagtacaagagcaagtgccacgccttccagaatggctaaacctgcacagactgagaacacccaaggtgtggaggaggcaggaaccaggagactgatgcgctacaggcagggcgaggaactactgaggaaaaagccacaactactgaggaaaagggctggcagtttcttggaaagttaaatatgcatgtaggattccataattccatggctaagtactgacccaaaagaaacaaaaacatacatccacataaaggctcctacaagaacgttcacagcagcagtgttcacaatagccagaaactggaaacaacccaaagtccatgaacagaagaacagctcaacaaacgacagtatattcatacaacaaaacaccactcagcaacccaaagcataaaaccaccaccaagatgcaatgcacagctaagccccacagatgtgatgtcagtgggaaaacgccagagacaagagcggggaccatcagactccatgtatctgatgtttagaaaaggcccaattagtccttgatgaaaataaatcagacagtggctgcctgttgggaggggaggtggcaggcaaacagggctgactggtaaggcatgtggtggtgttttccgggaagacggaaacattttgcatcttgacaggggtgtgggctacaggggaattcatattcatcaaaactcacttaactgaatacttgagatccgtgcatttcattgtttgtaaattatatgtcaacttctgaaaaactaaaagtttctacaaaggaggaaagagagaaagcatttaagagaaaatggcagacaaaattaaagggaaaaaacacttgcaactacatatggaaaaggcacatgtcacctcagaccaactcacaccaaggcgttctagtaatattactagacttatgacgaacagaaagtcctttgataaaaggtaagtttgcatacaaaggaaagaaaattgtatttccattagacaccagtaacactttaaatcaaaaggctattgtcatggatggaattcccacgaattcacaggttgaagcccgtacccccagtgttgtgatgctatttggagatggcaccactggaggtaatcagggttagatgaagtcatgaaatagggtggggccccccagataggattactggccttatactgagaggaaggttctaggcagaggtcagcagtagctgcaaacaacacaaaaagacaacgagatattatgcacctcctgtggtggaacacagccaccagcggagccaactggcctccaaagaagaatgagaatgcgatcaaggtctaaatctagctgccaatttacaggaaataaaaagaatgttctaaacaataccacagcatgcaattagcaaaattcagaccctgggagacatcacaggaagagcaggcaggctccactaacaaagtaagtggatgggaaaaaaaacaaacaggaagggtggagtggatccagagacatggggcggagcctgcagcctggtcaccactcggcacctgtgcccatcacctctggtccaatgtcgcgctccagtgtgtaaggtgctgtccctgtaggggctagctgagggtggccctggaatttgtgctatttttgcaacttcttatgaatttataatgatttcaaaatagaaagttaaagagtttcaaaatctgtcatccaagtgcaacgcatggaccttatttgaatccacattcaacactctaaaaacaagtcatgagacaccagacaaacataaaggcttgatactcaatgttatgaagaaatcactacttttggtatgataatgaaacatcttatgtttaaggaaaagaatccctctcctttacagacatacagaatagtcacggatgaaacatgttcagaatttccttcaaaatcatctgggtgatgcgggaaaattacagctgaggtgggtgtggctttgaacacacgtacccaccaaaatcactcacccttcttttaaaatcagttcatgaatccaatctctatcaaagacatgcacagaatttctccagagagaagctgccccgtgaacactccaactagtcttttccctaacaacagctttccatcggttctcccggctcctcggaacagcagagctacctgagcttagcgatttatactccatcgcagcgtcgcagccgtggtgggggcatcatggggccacaacggaagagctctacggtcaggtgtggctcgaggatgtgagctcttctcagcaagggtgcatgcacagcactgctggctcacaaaactcatgtgcatgtgtgcatgtgtgtgtgtatgcatgtgcacgtgtgcctgtgtgtgcatcagcacaaagccaagaggtcacagtgttttgcttgtaatcaaagatcaccacgtgttcaaggaagaaaggaaaataatcccttcctaggagtcaaatcgatccacaggaaaagtcccataaatggccgaatggcagaattagtagatgacattttaagtcaggctacctgtatcccacccatccagaaagccagaagaaacatgagacgtggtaaacagagataaagaagatttttcttaaaatccaaactggacttccagatgtgggcatgaagatgtctgagatgagcaccatgggggccgctgcagagccaaggtggctgaactcaaagacacagcagcggcaactctgcagaggaaaccagagcagaaaaggactgaaaatgaacagcccatgcctgagctcaggccacctaacaaggacaagccacaggctggaaaacattttttcaacacacagatctgataaaggacttctatctaaaacagataatgacctcttacaactcaataacaagaaggcaagtcacccaataaaaaatgggcaaaagactgaacagaaacttcaccaaagaagagagatgattagccgaatgaagcacatgaagagatgctcaacatcactggccatcagcagaacgccaaacacgagcacaggatgctgcagccacgcaagggatagctgcaaccacaggacggccaggccatgtgcctgcaggatgaccacagatgagcatgccacatgcctgcgggacgaccacgggatggccacaccacgtgcctgtgggatgaccacaggatgaacatgccacatgcctgcaggatgaccacaggacggccaggccacgtgcccacgggatgaccacggatgagcttgccacatgcctgcgggatgaccacgggacggccaggccacgtgcccatgggatgaccacggatgagcttgccacatgcctgcgggatgaccacaggacggccaggccacgtgcccacgggatgaccacagatgagcttgccacatgcctgcgggatgaccatgggacagccaaaccacgtgcctgcaggatgaccacggatgagcatgccacatgcctgtgggatgaccatgggatgagcatgccacatgcctgccacgtgcccaccactgtgccgagaagcagggccctgaggctgctggtggggatgcaaaatggtggaactggaactgctttagaatgcaattgggcagcttctacaagcgttaagcctatatccacctacggtctgagcactgcactctcagctacttcatggaaagcacacatttctactgagactcgcacacgaatgttcacggcagctgcaagtgtgctggtcagaaaggagagaacctgcacacccaccatggggaggtgacacagtgcggcctcagcatccacggaccgcgcctcagccacagacaggagtggcctgggagacacgcggaacacggaagactcctacagcaagtgtgctgagtgacggaggccaggtgaacatcaggttcacactgtgattccgttcacgggaaattccaggaaacataaaggtgtgaccacaatgacagaagcttgtcagtggttgggagcgaggaagtgggggagagaagtgtcacagaaaggcaggagtaaactggaaccccagggtgatgggtgtgttcctctccctggctgtggctgtggcttcagggatacacatgcatatgtccacacttgtcaagctgcaccctttaaacacaggcggttcacggtatgtcaagcagactgcagtaaaggtttaaaagaaaagcaactcctctctgggctcctggcccagtgcctgcccattgtccccattagactaatgggcatctcagacttgaggcattccttccagaactggctcctcgggtgtcctctgcaactccagagacacttgctccatcctcccactgcctcagaggaatgtgggagtcctccctggacccctctcagaccccacatccatccatcagcaggtcctcacggctctacccacaaaacacgccggggggtgtctcttccccctacgtccctcacccacacacccctgcgggcctcctgtgccactaccatggtctcaggcaggcccccttgtgcccccaccctccaatccactctccacatgactgggagtgtgatcctggcaagtcagctctgatcccaccccctgctgctcaaagcccctcacgactcctgcgccatgcagcgaatgagcctgagtgctccccacgccgcctttgtgccctccccacttcccctcgctctggtccctcgagtctcctctgtggcctgggcacccagcacattggcaccgcggggctggccacctgtcctttgctgtggctggagcgctcctcctcagacatcccattttccggtcggccactcatttcttccgtctctggctgccctacctggcgctcctcagcctgcgacagacaggcacatctgtccagcactcctgttacaatgtaaggcctcttgtgtccactatattcccggcacccggaacaggagggcaggggtcttgtgtccactatattcccggcacccggaacagggggacagcaggcagtcaatatttgctaaatgaacggaagaaatgccaagtcagcatcagagcaagaaagcagctctcaaagcagagaggtgctgggtgagtggagggcaagcgaatgaaacctgtctccccttctcacccatgttctcagtccatgcccgtgccctgcagttgcacagtgacatccagggcaatgctaacacccagggtgccaggggatcctcaggggggctgaacctctccagccaggtgtgatgtctgcacgaaacactctgccccggtgcttaccagggctcagtcacccacactagggcggacgccagcactaaatgcgcactcaactagaagggaaccacagccccggcactggccatggtggcatctgggggaagcagacctcgggacttgtggcacctgtgccaagggaagggactgggggagagccaaccacgtgccctgtctgttgaacgtgggatctggcccagttgaaaagggcctgcggcagggtggccagctaggcagtgagcgtcgggtctgcggctcttcccgtccctccaggcttgcctcccgccccgccaccccgcaagtgcacatctgcacacacaaccacctcctgtggctgcactgctacctctcatctgcttctacctcctttgatttgcctccaaccccactgcgcctgccatggagatgggaggccaggggacgaatcctgcacccctccacacccagccagaaccaccaccgtctctctgtgcctacagtcaaccctcagcccagccatctgttcatacttgcggccttcctcgtgcctgatcctgcactggacgattccggtgacactgagcattcatcactagctgcaattgtgttaagggacagagatgagggtgccggacaactgtacatgagggggctgctctggagatcccccaggcctgctgccagacgctgaagccccagccctacccagtgcacagatacacagctccacacatcgctgggctggggtcccatcaaacctcagctaggaaggcctgttccatggattacccacgtcctcctccagcccacccaggccaggggcctcaggtgccaccagagggaggaaggcctgatggtcagccccggggtcagcccaaggtgaagatgtggcctcataggtccacaggccctcgaactgcagtgtcctgcctggtgctgtagggagacggccctgctttttgtccccaggcctgggcccccatgactcccaccaggcacgacctactggctcctgggcacctgactttgaaaagccagcatctgacaccctgctctcctgcagatccttctatgagcagatggatacctgctccaggcagtaccacgcggccaggcgaggacaccctggcagcccccagcgccctgagggagaaaatgtggcaccacaggacatcctgggttccatcccagctcccccacagcccaggtggggccatcaggccagagtgctgctcctggggagctccaggcacagcgtgccgggggcgctccgggcaggctcccctctgagctcaggtcacacgccctctgctcacggcgagcccaccacagcccggacctgtggccagtaagcccagggtctcagcatttgaatgtccaaaccgataggctgcgggaagaggcgaccagggaaggggaagggcgtgggatgagggaggcctcaggggtgaggggctcaggcgacaaagaggaggagggctctggatggctggagagaggcatgtgcagaagagagctggggaggaggctttaaatccacccaccaaaagcacagtgaggcggggtgcggaaagtgtgtgaggttcggctctggactctggccaaggcacagaaagctgaggctgcccagcctgcagagcctgtggagaagggatggggaggggaaggctggcagcccagaggaggcagacggagaagtggacagatccagacagccctgggccgcagccagacatgggcgcgaggctcgtctaacagggctggagccaggccctggccctgacccggacatcctggatgccacaccacgcacactgtcacctcaggtggcactgctcatccccatgtagaagtatggaatccctacctaggccctgtcccaccctggagacagaaatgaggcagccccaggtcaaccgagagacacccccaaacagctccttcctctggctccagactgggccctgtccaggtgaccgcacacatggtctgtagtgccggacacaagggcagatggccaagaccacagaggccacaggagcccacagagccggctgccgcactgcacagctactaccgtgggtccccagaacagcgggcaccccaaagcagggcccctgcgtgggcacaggtgtcccccacacactctcatacattgatgtctacaaacggccacatctggggcaacttcacaattggatcgggttcctggggcaagatccacttgtcaggaaagcacagacaatggcaaagcggcttctcagtgcctgtcacgagtgagcatggccagcacgctctccagagcacatgggagagtctggtgaggggcccttggtctccaaggtcacatggcacccgctggccctgtgggctcctggacttcactggaagtgacagaggtggctggcaggcgctggccaagggcgcacccggctggggtgtgggagccactcctcgcaagccgcatgcccgggagagcactctcaggaagaggtccagaatgagcggcagccttctgattgccaagagaaagcgccacccgctcagccctggctggggcagctcgttcctgccttccagtcaccagaagcccacagctgagagcctgcagaaaaggagatgcccccaggcagaaggaggccagagagcccaggggatgcagagagggtgactgcctggcccgcccacccatgatgggagcagagtgctcctagaacggagaggagactggcaggggcaaggaggtgggagggagcagccttcagctgcactccagatagcatccgctgccctttctcagcagcttacgcaatttatagctgagaaatggcccatgaggtcgaaaatcacaatgacagctgcaccaagggggatgtcagccctgggagggcgagaagaagggaggtctggactcaggaggcagttttctggggccgccagggccttgtccatggaagggctcacagcacctgcccactgggcagcccacatggctggcggctcctggcacccacgctatgctctcagctgccccagaagctaagactgttaaacaaggggcactgaaaaaccccaggtgacaggagagccccatgtgtgaattcttccccacagctcccttcagagtagactcagccagctagagaactcaaggtggaggctgcagcgagcggggagaaacccacgctgtgtctgcactcacgcgagtccaagacagccagggcagggcactctcgggactcccagaagacccccagggcttccgcagcagctgtgtcacgagacatctgcggcacagagtgcctaggctaggccggggacctgctctcctgaccacacaccaagcccggcagccacccgagggtgaactgaggggaaggggaccgcactggggcacggacgccaggcacagacaccgaatggctggctttgtcagaagactctaggcaaaccgtggaataaaacgcgagggaagggaaagagactcgttcacagagaaccttctaagtgccaggcctcgcatgacattggcgtgtgcttcccaggcatcccccgacttcagccaacaggccgctgcagggcagacctgaacagacgtgcacagcctcaccggaccctccgctaccaaggaggcctttgattggaactcaaggctgcctccctctaaagcacggtcctgttgcagaaaaaacaaatttagccaccccagcccaacactttgggaggcctaggtgagaggatcacttgaggtcagaagtttgagaccagcctgggcaacataaggagacccccccaccccatctcaaagaaatcttcaaaattatctgggcgtggtggtgtacctgtggccccaactacttgagaggctgaggtgggagaactgcttggggccgggagttcaaggcgacggagctatggttgcgccaccgcactccagcctgggtgacagtgcgagaccctgactctctaaataaatcaatgatagttaaaggaaacacaaatgtgcgttttaggaaccaaacacactgcctttgaacttggttccaggacccccaaaaatggcttttgaagcaagtaagccccgaggtagggatcggcaacactacccagaaaggaaccacgcccacatcaagctaaaggttgacctgaaggggcgctcttacagggcctgcccaaagaagggagtagctggattctgagaacagccagtccaagagcagcgctccagccagctctgaataaccaggcttcagaacccctcgacttcctcaactggcacccccgagacctgtccctgcccattttactgataaggaagcaagctcaacaggatattcatacagggtcctggcatccgctgatggcgttttcggatctagaaaagagaccctgtacaaacactgaaaagtaccactggaggttccaagcctccctagagtcctggaataccacctctgtagcggcaggggcagagaaggttttaaaaaaaaaagccgggcgcggtggctcacacctgtaatcccagcactttgggaggccaagcagggcggatcacaaggtcaggagatcgagaccatcctggctaacatggtgaaaccccgtctctactaaaaatacaaaaaattagccgggcgtgctggtgggcgcctgtagtcccagctacttgggaggctgaggcaggagaattgcttaaacctgggtggcagaggttgcagtgagtcgagattgcgccactgcactccagcctgggtgacagagcgagacgccgtctcaaaacaaaacaaaacaaaacaaaacaaaaacaaagaaacgtctcaggagccacctgagaaaagctgctctatgacttcggacagtcaggagcactgcatggagccttggacgtccacgtggagcctccatactgtgcatcagaggcagggaaaactggagttgccaagcaagtaaaaccccggctggagtcggggagagaccactcaggacacacatgtccatcggcaacacaaatcaaaaggagaccacagaccatgaggaagacgcagtctggactaggaggggatgggcagatggggcaggtttctgcagggagagccactggtgcaggggtgaacatggccccctaagccccgcacttcccctcacacagcagccaaggctatttctgtgctgacccccgtgctggcagcctggctctagccttcacacgtgactgtcccccaagaggggacagcagcatgtggaaggggaaagagcttattcctacatgcccggcccagagcgcagcacaagcccatcctgccctggctcacctcctgttcccaggggggcactgccctcctagttcccacagcccagtcagcagaggaggaggcagaggaggagaaaatgccatcaagtctaccccaaacccacccctgctcctagcaagctggccaacaagcctcacaccaaacaggaaagcacccgaaacacaacagctttcttccacgccaccctagtaggagacagtgatagcctctcctcctagtgcaaggggcctctctgccacagctgacctggaggtgccaacgtccatggggcctggacaggctgtggcgctgccagcatgcagagaaggactgaagcaagccagggccatcgtagccctgaaagaagtcccaggcagtgccacagggctcgtaccctcagacagtatgccttccaagcacagcacagcccgtgggccaggggacatccaggaaggaagacaaggggggccaggctgggggtcaagggtcctcctggggtaagggtgatcagagactgccaggaggccaagagccaggtggaggccatgcagaaggagccacctggagccatcggcggtggggctgggggccgagatttcggtataaatttagaaggcagagtaatgcaccaccgcacctccaaaactgtccatttcaagctcaagtcaagccaaactctgaacaattaaagtggctactggagcctgcctagtcattctcccggcccccagccaccactgactgcgggagggcaggggcctccagggatctctgacccctctccctcctgatgcctgcatttcgctcatccaggaaaacccctgggctggggggcaggtaggacttaagagcccccatctatcatgctgctgaaaaaagtggaggagcccccacactcacctgctcacagcaaggcggtggggcgtggactgatggttaaaacaaacaagagcgctcacgatccctcaggagctcacaggctcagaaaagccaggggataggtgagaccctgcctctctgtcactctgcgctctccccacccccagcttcacagagcccagcagggcccaggccgcctaagaacagggtggtggagccctgccaggccacgctgcccttctctggctggtataaaaaccttggctgcaaaatttagtccaggctgagtccctgagtcccacaggaaggaagctgggagccccacaagggaggaggagtggcctgcgagagcacaacccccaccccacggccccctggagctggcgagaagtcagcccgaagcgcccactcgccggctcctgaggacgcctggctgtggggaccctcttggtcacgggcctgaccccgggtgctgccatggccacctggcctgcaggggctcaaacagaaaaactggaaatcaatgtttttgtcagtatttttttccccaaaaaatattgagatcagtcgagaaacagcttttccttagaaaaatgccagagagaaatggaaacgtgccctggcgctctggaatggggtggggcggtccagagaagggcacaaccccgagagacgcatggaggtgactggtgccctgccctcccccctgcgctctggaacagtgcggggggggggggggcgcctccagagacggacccaaccccgagagacgcatggaggtgactgtgccctgcccgcccctctgcgctctggaacggtgggtgggggtccccagagacggacacaaccccgagatatgcatggaggtgactggtgccctgccctccccctcacagccctcagcaaagccacccgccataggcctgcgggagaacgggcactcctgatgtgcacgcaggcagctctgggtgggcagggcagcttcctgggcacacaccagctacactgcaaagggtgtggtcaaacgtcactgcacagacccccttgaggtgacagttcgaacaaacaccatcctccctgtcctgctgtggacgctggtgtggggtgcgcctgggacagggctctggcccgaggtgtctggtaaagcgggtaacagggtggactccagaaggctgggaggaaggcaactgaagacccggaagcccactcccaggggaaaaggacaccgggcgggcaggggctgctcctgcaggggcacattcccctctaataggaaacgctgtttttgtctgtgaaactggagaaaatgcgtcacatgcgggagaaccccacattccaaggcaagaggagaaactacagcgggaggcgccacggcccacacttcagattcctcaagtggggtccgtggctgaggctgcgcagggaggagacacagcacagggtgcccttgggagcagaggggtgccaacagctgtccccacacagggcgaggcctggcctggcagcctggtccctcatgcacagtgagttccacgcagcctctgcactggccacccagccaaccctgacccagcctcgggcctcagccagagaatcctcctcaaacccaagtcaccagggcctgcctctccctctcagggtcatgcacgtgccccctgaggccagccttaccccggagtcctcagccccaggagcctccagactgttcctcccacccccaacatcattactgccagcctttgcccaatgtcatctaggagaccccagcttccacctcaaccagagatgccatccgctctgtgtcctgctgggtcctaacagtccaacaggagcggaagcaggagtgcagcagtgattttctgctctgtcctgggagctgagaacaggggcagtgctggcagctggaacctgaaagcgtttgagtgagtgagctgctcatatacaaataagaatgtgtgcaaaccaataagaacaaaatgaccatcacccctccccaaaaaaaggggcaaagaaaaaaccattcacaggcagaaaataactacaaatggttaataaacataagaagatcaacttgcctaatttagaagcaactgaagacaagaccttccaatgacagccagtgccaggcacccccagccgagaagctcctcagaacattgagaatgtaaaatgggaatttatctcaagtattcaaactcggaatgactatgaataataaacctgaatgaagcattgctcataaaagaaaatgctggaaactgcctaacactcgcagggtctccttagcaagtcctgctatgcagtcatcaaagagggagaagagcccagtgggcagggacctggaggtcagcgccagggctgcgaggcacccgggaggtgagagccagggctgcgggggggacccgggaggtcagagccagggctgcggcggggacccgggaggtcagagccagggctgcgggggggacccgggaggtcagagccagggctgcgggggggacccgggaggtcagagccagggctgcgggggggacccgggaggtcagagccagggctgcgggggacccgggaggtcagagccagggctgcagggggacccgggaggtcagagccagggctgcgggggggacccgggaggtcagagccagggctgcgggggggacccgggaggtcagagccagggctgcgggggacccgggaggtcagagccagggctgcgggggacccgggaggtcagagccagggctgcgggggacccgggaggtcagagccagggctgcgggggacccgggaggtcagagccagggctgtggggggacccgggaggtgagagccagggctgcggggggacccgggaggtgagagccagggctgcggggggacccgggaggtgagagccagggctgcgggggacccgggaggtgagagccaggcttgccgggggacccgggaggtcagagccaggcttgccgggggacccggaaggtcagagccaggcttgctgggggacagctggaaggtacacacctccagagctttaggggtaagcctgtgtattttactttctttatatttctccgaattgttggaattttccatgttaaaatacatcatcaccacaatcagaagaaaaaaaaaatttaattttgggaaaagtgaaaagacctccaaagaaaatgcccagaggaggcattttattctagtttccaaattttcactaatcttccttttataattgaaaaaaaaaagtgcactatctacattctaacagatttttgagaagtacatacaggaaaacatttcacagtttcctaaaaacttaaacacacactcgatgatgcctgcctcactacgcgcctggaggcttgtctgcgaggaatcaaaggaatctggtagtgatggctgaaaactgggtcccagatgctcactgctggggaacagggacatcagtcaccgaatctgcactaagctccaagaggaccaactgccacacgcagtgtgctgactcaccagagtgggaaaaccacgcagaagatagcggggccacagggagcatccaccccacattctagaatggagagagccacacagaagacagcggggccatggggagcatccgccccacattctagaacaggcaaaacctccagcaggacgaggagctttcctgaggatggcacaggctgcaggcactgcccacacagacctgtaggttcaccaaaacttgctgaattgcatgcctgaaatcacagaattctgccgtatgtaaacaacaccttcaacacagctgcttccaggtgtggtagctcacgtctgaaatcccagcactttaggaggctgaggcaggaggatctcttgagcctaggtcaagaccagccaaggcaacacagtgagaccccatctccacaaaaaaaataaaaattagccaggcatggtggcgtgcacctgtggtcccagctactcaggaggctgaggctcctgggatgtttctatcactgggaatcgtgacttttcacactgcaggggatgagcctggtgtgtcaccggccttgcctcctggggctgtctgaagctgctgggcttctggatgtggcccccccgtgggtgtgcaaaatcctgtatcataaaaaaaaccagctgctcacacgcacacttctccaattcaagcagaagctgctgaagcacaaacaaggtgatggctgtggagatgggctggggggctgggcggccacccccatcaggtgggctcctaggtggttggtaccacggccgggacaactcactccatcattagaactttcttcaggatggaacacagggctagggttgaattttcctccgttttaagaagtaaactagttttccctcaaagggaaatggtttcccctcaaactgtctttaacaagtagacactgcacgtagaacaaggaagaatgaaaagcatgggcgggtaccatgaacacatgtgtgtgtcaggactgcaggcaacaggcacccctccgccagtctcaggtaaggcgccgtcactctagttgcttacactgaagccaggtgcagcctgttcagaatgtggaagacccaagatgggcttgaggcaagacaggtggcagaggtggccccccagcgaaacacagctggggaagagccctgggcctccccggcagactccaagtggttcctgacgaccaggggcaaagtctcatctctgactccccactgctggcacagccacacacggtggtcctgctgcccactgcccactctctccgcatccttagacccttcctctctcctcacattcgacctcctcagaacttcctgaagtgggtgcttgggaagtaactctttcagaactcacacatcagaaaatattttcattctactcttacatcattgacaggttaactgatgctgaagtctactctggaaatccttttctgactgcattttgaagaccatcttctactttccaggttggaattcatattctggttctcagtacactgtagataacctggtgctacgctctgaatgtgtcccccaaaggcatgtgctggaaactgaacacccagtgctgcagcgctaggaggtggggcctggtggggggtgattaggggtggggctgggaggtggggcctggtgggaggtgattaggggtggggctgggaggtggggcctggtgggcggtgattaggggtggggctgggaggtggggcctggtggggggtgattaggggtggggctgggaggtggggcctggtgggcggtgattaggggtggggctgggaggtggggcctggtgggcggtgattaggggtggggctgggaggtggggcctggtggggggtgattagggatgcgggatgctctgccctaggaatggattaatgtgattctgaaagggcttggggctgtgagttccacctcttgcccttccacctctccccacgaggtgacactgcacaaaggctcttgccagacatgggaccctccatcttggaattccaaacctccaaactgtaagaaataaacctctgttctctgtaaaccactcagtctcaggtattgtttcagcggcacaaacagacgaaggggttttgttttgctttgttcttctctctggaagttgtaaaaatatgctctttatccctggtgtcttctggtgtcgccttttcattcactgcattggacactgtgtgagcccatttcatctgtgaattcatttctggacaactgtggcgttcctttggtgatttcctcccttctgtttcctgctcttcctggaactcctaccaagctacagtgacccctgcctgatgctcggtttccgtacctttgtgctcctggtgtccatgcctgatacccgccctgcgcagtcggcctgctgggaagggcgcgcagcaccatctcccacacctcactggctgtccgatcctcctctctcaggcactctttgctgtgcaccggacgctcctttctgtacaagtctgctcttgctacgtggtctttacaactctgaggagacccacgaacgctatgctttactctttggtttgggctggcttcctgctttttcatctgctttggtctatctggtgacccctgccccctcacatcacatgtggcaggaggcactgcaaagctcactgatggctctaggtgcacggagggggcttcgctgggggagtctggctgtattcaacacctttccagcatcacaggaaacgacttaccagattgaagggactcacccagcatccacgtcattgaatgcagaggccacatcagggaacacactgacatttcagaacactaagggacatgggtggcccctcctccccactcccagtgcccaagggttttttctcttggctgaggagactcccattctctgctggagggtggacctcagctgctggggtcctgaggacccggtgtgggaggggcagaaggggacctccctggtggatgtggaaagctgtcaaggcttcatgtgcaggatgatgccctccactacgcctgggtctcagcggacagtgctatgatcccacgtgctcggactaatcctccagacacagatcagacatgaatggggtgtccagctgcttctaaacacacctccagcctccagaccagctctgctgtcttcagctccaccatccaaggggctcccagactccatgggagccatccacagtttctcagtgaaaacacttcccctgctggtcagatttcagctttcctgagtttgcgttcattccacccgaccctcagctttccaacttccaaaatgtgtctgctctcgtctcctctgcactctctgctcctgcagatttctgcctctccgaaactccctgggcgcttatccaagtggggtcgagaagcagggccagcacagaggctcactggtgctcatcagccagagccctgtctctctgctcttcagcatcctagtgggacgggagcacccagggaacacaagtgcaccatgacgcggagcccttcatcaccgcaggccacggcgcttgtccttcccagaggcccccaaccacagctgctgagcgacacccacaccgcttctctcttcacacagcggactgatgaggagtcccgccaagcaggagctctgagccacagcacagagtgtgctggcccaagtccacgcctgcatgcaagctcagccatgcgtctaatggcaataaccgtggaatgagctcgtgaggttcggagagtcccaccccgacggggagagccacagggagccccaatctcggcagtgaccggctccaggtccccacgtaccgtgagagtggggacagcggtggacagcagcccttgagcagggcacaaccttcagagagacctcgacaagtgaacacttaaaccaaggtcgaccctgggggaaacgcagacctcctcccagtgcccccttcagaaaaggtactcaaacactggctcccatcatgagctgggcacggaaccaggcatgggtactacctgcctccagggcttggagctcgggaggggaaccaatcccgggccctcgacctgggaggtgccagaaggccctcacacaagactccagcactagggtggggaggttaaagtaaacaggacagaggggttcaactaagacaatacctttgctcacggtcagaggcgaaggcactgatgccagccggcgccgactcaggtgagcacacaagctctcccgccgcggctgcaccacatgcctgataaagggacagccctggatgtctagttcctcaggcacgtgtgcacacatgtgtgctgcgtagcactggcaccccattcctgttctgccccaggtagctggtgcattccccggtgctcaccggctcgaccccccagcaacacgagagacctcacagagggagtcacactaacgtggtcggggctccagagcgaaaccccaaccactatgctcacagccaggaccgagcaggctgggccaacggcagtccctgcccagcgcccggctccctccgagtggccagcagcgccctctggtggagactggctcggcctccgcggcactgcattcccacggcagtggtccatctagtccccaagtcctagaggaggcccctctctctccctcagccctggcagggtccttggcgcccattctccacacctgcactccttggccctccaggaattaccggcctcaggggcgctcctggaagcagagaaggggatctgcctggaccttcctcagaggcacagccttcacagaggcacgaggggctttggagcagaggaggctgccacttatcagccagacggcctgggctcaattcccagctgcagggccctggccagtgacatcacctctctgcattttcccacctataaaatgggaatgctgacctccagcatgtcctgagcaggtagaagattgtggccctccccggggaatccaacaccagcccctggacacccctggatgctcctgggcatggcaagaccagcaaagtcacctcccagctgcccaaaaggagtgtccacaccaacaggggcagcagtgacccgagtgcttctgaacacaccatttgggcaatcatcttcaaaattaacagaaccaaggtgacgagaaaaaaggcacttctatggcaagctctgctccgagtggccatgaagaagctgaatcttctagctgtgcaaacagaaggtgccaagtactggctgctttctaggtctctctaggtctgactgtcatccccctcctatcagccccagggcagtacccaaaacacccactgctcagcggtggccacatgaatcagaagcacggcatcctgaggccatggtaagcaaatcacaggagacggctggtaatgaggacacgaaatatgctcggcctcaccaataaacagagcagcctgatgcatgtgaaaccacatgccgctgatggagtggggggcagggaaagactggcacccgccctgtaggggaaggggacagttagacagtggtgaaacctccacatgccactgatggagcggggggcagggaaagagtggcacctgccctgtaggggaaggggacacttagacagtggtgaaacctatcaggccagagggggaacgggtgcccgttcttagacacaagcaagggagagacgagccagtgcgggccctgctgcttgagcactgcacggtggggtggagtggaccgccacaaacaggcagaaaggagagagaaatcggagtccagtcctgtttgcagcagggctgcgttcaaatgcagagcctgcaggggatgccgttaggcaggatccagaacagaggaggaacccatttttgtttcagacaaagaaaggaagacaggcatgtcccggtctagcacacaggcccctgtggggagggatggaggcttcagtgctacttttcaccactgtaaggtgaagcatgtgactttacttttatagtctctcttccaacgatgaagaaaaacattacataaaccaaaaaataaaacacagagccacaacaagcccccccaggacagttgggccagtgcccagcctctgtggcccccgttccaggacgaccccaggctcactggagaggatgcaaagggcagagagtgcccaggggccaggctgcccggccccacctccccggccagcagcactctccggccctccagagccacaatgggtacacgctaccctcatgtgccggctccaccccctcaccttctgggggttcaaccccctgcctctccttctccaccaccctccgccatgccacaaacagctctggctgaggccaccctcagctggccgtgtcctcaattcccatccctgtaacacagggcaggcacctgtggaggctgatcatggcctcccctgcagccacccgtcacagctccttccagctccttctctctcgcaccagctcttcctgttgtcaccgctacccccacctctggctcccccaggcagcacgctcagggtataccagacagctcacctccagttcactgtgtccagagatgtctgacacaggtaccgtgtctgcctctgagaggcgcccccaacgcctgccatctctccacagacgatgccccaccacaactgctcagggactcccggccgccatctccaccacctccctccccagagtgaggcttgtcaattccctccgttatcggccagagcaccctggaagggggtcgagcacagctgggccagacgcaactcccacctctcagttcttcaggcaggctcctatcactttgtccctccattttgccacctacataacagggtcacggtaagcgccctgcagggtgtggcggtgagcagggggacagtcggaactccagggctggtcacggcagcacctgtgccagcactgtgcccactgtgactctgcctgatgtcacagctataggcctaactagccacataaccacagagaaaggaggtggctgagaaacaagggtctggggacagtaggaagatgctgcctgctctgacagacaccccccaccccacccgctgccccgatggagcccacttggccatatttgacaaccccagacaggatgcagagggacactgccctccatgactcacctcaaagagctcacttggaaggggaaaggaagggccatgaaagggtgaaacgcaatggcttctccctcccgtcctactgtgtgtccgcagcggttactccgcagagccgccaggtacaacagtcaagacatgggaaaacctcaacgcccaatgatggatcaagggatggggaaagtgtggtgcacacgctccgtggtgacccccgcgagactggcctgcgcacagggacggcttcacgcgtgtgacagcaggggagcaggacctccgggccagacaagcctgcggggagctgggcccccgtggtccctggagccgcctgcctagggctcgtctgcacagccagccgggccaccctttgtctctgcagcaatggttccgggtagaacccaagaacgtgcatttctaacaaggtcccaagcaacccactgttaagtttcacctacagctgcctccttacatattttaagttccacctaaaggtttctttgtacatcgtgaactatgacaagtacaggtgtaaacagatcatagcctatacttgtgccaatcaccaagttttggccaatcatatgtaggtaactgttcgagctgtgttcaaataaggcaaatgccgagcgtaaccaatcggctgtttctatgccttacttccgttttccgtaggtcactttccctttccataaatcttcccccacagggctgctctggagtctatgagcctactctggctcaagaggctgtcaatccaagaatcgtttgttgttcaattaaagacctttacattaagtttttcttttatcactgcccttgctggtgcccacaccccacctggggaaccattgccctacagcgccaggcacacacctggcctctctgcacctccattctggggcagagatgcaatggggaccaagtggggccgtgtgcacccagttctcagcggcacggtgccggcacgcagcagactccccttgagggtgagtgagtgtagcagagggacttcgatgcatgctctgcagggtcctccacacacccccagcacacatccatccactggacacctgccccaggactgccctgggactccgaacccaagaactcactgcccctgcctcccagggaaggccagcaagtgaaggaacgaaggccaggatggaaaggaacaacagatgtttccagcaaatgctaccatggacagaaacccagcatgctacaggggagcaggaggctggggtgtgaatctgggtcatttctgggcagcccctggccacccaggcagaagcacaggaaacagactgcggtgctgaccagagatgcaggacacggaacagagcggtaagctttacaccagtgaggacggcgagtgctggaaacccggaggcattctagttgtcatcacaaggggggacaccaggagaccgtgtccacaataacacacagtgggctttataagaagttaccccaaaatcaggtgttcaggataaggctgtgctggaaaaggaagctcagatggaatcaagagtgtccagaaatcaccagctgcctcacttgacacaagctgtctgctcaacagactttagaattcccaacctcataattagtcaaaagggattttaatgcaaccattcagtaatatgaaatcaagaactatgactgcaaaggagattgaatgttccttttaaacaacgtaaaactaaatactattgaatcagtggagaaatgaaaaacagagtcttgctaattttcattaatggagactgctttaagtctttcagtttatgaccagcctaggcaagacggcaagactctgcctctataaaaaaatttttttcaaaattcgtggggcacggtggtgcgcacctgtggtcccagctactcaggaggctgaggcaggaggatctgttaaacccaggaggtcaaggcagcagtgagctgtgattgcaccaccgcactccagcctggtctctaaacaaaaaataaaaaccaaaacaaaaaaactatttcggtaagaaatctaggctgtaacaaggccatgtggggactgcccactgtttctgcagctcactctgcgggcccggggtcagatccccagtttctcagggtcgtgttctgttccctttgctcatctctcctccagtccccagggaagggcttggtctccacggcgtcaggaactagactgtgaacttgcacgtcaatactgagagtggggcttccagagagcagccgtgcttgctgccctgcccctctcaggctgcagcccagggagatgccactgagacgctggccatcgggctggccacccccgggctccctccatcctcacggtcctgctctgtgctggcagtttccactgaagtccccctcccagtatgcagcaagcctgatctgctatcactcgctcacaccatgcctccgtgtctcccccacatctcacatgaagtaacttctgagcctgtttcaaagtttatcctgaacagggcgggcagtctggccccttcaccatctctttctgtgtgggtgcaccgaggtgtctccctgcagaagtgcattctatcctatgctggggtaaagatgcaagtcactctcaaactgctgagaaaagacccacgtgcaggtactgagagagagaaaacggcaaggcagatgtggcagaaacgctgacactggccaatctgggagaaggtatgcaggaattattcacactactttggcaacttctaactttgaaattatgtaaaaatttaaaaatataaacgtcagaagcagctggggccaggaggtggcagataccctcgagggagcagcagtgcatctgacagccgcttctccacagcaacgccggaagccggaggtcggcggcctcacgtcgaaagagggctgaaagcaagccaaccaagaacacgacacacagcgaaaagctctgccaagaatgaaggacaactgaaggcattttcagacagagactgagagggcgcccccagcagagtcacctgaaagaaaatccaagaaagctcaaggctgcagcacaagcagaggaaaactggtcacagacgcaaaaggacaaacccagaaggacaaaggaggaaggagagggtacagccaaagagatggagcacaaaaccagccaacctaaataaataccagcgtacaagtagcatgtgggggtccgaagtgtacagaatttaaaacacagcagtagcatgtgggggtccgaagtgtacagaatttaaaacacagcaagtgctcacaactcaagaggggaagtacccagaagcggtctagtatcttgggtacttcggggaggcggataaagctgttaatcaacatcagaccctggaggtttagcgtgtgctgtaagaaaaccactaaaggagggtgtgcacggtggctcacagtgtaatcccagcactttggaaggtgaaggtgggtggatggcttgaggccaggagtctgagaccatcctggacaacacagtgagaccctgcttctacaaaaaatcaaataaaataaagtacctaacttccaaggcaatttgaaagaaggataattaaaaaataaaaagaagaaattcaaacaaagcatgggaagatgaaaagcacaagatgggagttccacacagcagcgagcacaccaggtggaaagggttagcaaggcgccctgacacccgctctagtggcgcggtgctcactagacacccgctgtcacgtgcagtgcgtctaaggcttggggttttcccgggctcaccccaggggagacgtggtcaagggctctttcccagggctcggggccgtttgcacgtccttcttcatgaggcatctgttcaagcctctgcccatcttctacgggacgagctgtttcttgttctttgttggagcccgtggggaagtctggatctgagctccggtaagttctaggtatggtaaattccccctgcaaaagttgctttcttttttttttgaaacagagtcctgctctgtggcccaggctggagtacagtggtgagatcatggctcaccgcagccccgacctcctgggctcaagggatcctcccacctcagtccccctgagtagcggatgccaccacgtccagttaatttatttttatttatttatttatttatgaggtctcactatgttgcccagcctggtcctgaactcctgggctcaagcagtcctccagcctcggcccctcaaagtgcagggattataggtgtgagccacggtccccggccagccttttcagtttttgaggaatatctttgataaacagagctgcttaattttaatgtaaaccaaattatctatcttttcctttatgatgagtactttttagtcctgtttaaaaaaacttttcttaacccatgggtcaagaatagcatcttctataacagtgctgttcaagagaaatataacacaagccataatctgagccatggatataattttaaatgttctaatggccccattgaaaagtaaaagaaacagccaagattaattttatttaacccaacagatgtaaaatattttcgacttacaatcaatacagaaaatacaaggtgccactgtatttttttcagtctagcgtattttacactcagcacatctctagcgctgccaagctacatggctggaggccgtgctggacagcagttccagaaccttctacacttagacctacattctactgggctcaattattctttgtagggtgtgaggtacaggccaaggtttttttaaatatggctatctggttggccagcatgacttatgaaaaagactggctatctgtgccatctctttttccctgtcttgatcactcttgccagattttccactatattcctgttttcaaagaatccaactctggcctcgatgactatatctgtgggagactgactttctgctttgttaacttctgctccagcctcatttccctccatccaccgtctctgagcccagctactgctccgagagtgacgagtacctgagggctgtgaaccgctcctggccggtgtgcaccctgcaagtctcagcatggcatatttttgttatctttcagctaaaaagtatgttgtaatttccattacaaattcttctttgtcccactggttacttggaagtgtgcttcctaatttctaaatactaggagtatcactttgctgatttctagtttaactccacttgggtcaagagcacactccagaggaattcaattcaccgagataagcggaggttttggtcaacgttccatcagcgtgtaaagggggcacacagcctgtcaggggtgggttccctattcttcctgtcaggtgaaatgtgtgaatctggctttgaaatcttcatgctgacttgtgagtacagctgagctgctgggacaaaggcccaccatcccaggccccaagtccttccctggtgttagcccagggcaggggtcaaacttcaccctccaacaccttcctggggccccagccatggggcagccctgttctcaccaagggctgtcgaggagccgcaggaaggcaggaagaagaggaaggacaagcatcttccagacggtgactagaaagctccacctgcccccacctatgtctcagtcctgaagctcaggacacaagggaggctggagttcaagtgcctgagagcccacagccagagaagcttgcacggggtcagaaagacagacgggagtcagcaggtcacagccctgtgcccacaacaggtggcaggaaagaagctcagagacctgacaacagccacagcaaggacatgtgtgcacacaggccaggtgtctcggcagaactgcagacactggagggccagccaggctgaagtgcacatgggccacacagggtggggctggagagagacaggggacttcaccccacaggcaatgggggtccaccaaagtgccttgtatataggaggatgacatgtggatcctctcaggtggctgtgtggagcatgagtcaaagataaggacatacatccccgccaccgccaggtgcctatggctataagagcctaggcctcagcccagggaactgcgggcttgcttagggaatccagcaaaaccctcacagccttctggatggagccccatggcatggatggcgaggcgtgaggggaggcaggacgtggccttcctgagcagcaggctcgaggcacgggacacacaggccaccaccacaacttcaggctctgtaacagggacctacccacgcaaaaggtccttatctgaaagggctccatcctcaccctagagccctccacacgtcattttgggggacattttatttattttattttttatttttttgagatggagtcttgctcttgtcgcccgggctggagtgcagtggcacatcttggctcactccaacttctgcctcctcggttcaagcaattctctttcctcagcctcccgagtagctgggattacaggcgcatgccaccacgcctggctaattttttgtaatttcagtagagacggggtttcatcatgttggccaggatggtctcaaacccctgacctcaggtggatccacccatctcggcctccgaaattgcagggattacaggtgtgagccaccgggtcccatttcattattttgattagaaatgaaatgacctgcccaggcgcggtggctcacgcctataatcccagcactctgggaggctgaggcgggcggatcacctgagctgatccccagcctgctggggaaggggaaggaaggtggccacaggccccagcatagtacagactgacgcccttgaagtccacactgcaccgtgggcccagacagaacaggcctcccgccccgccctcacagaggtgcctcgtggacagccactgcatggcatagcaagtccctggacccaggcctgtccagaccctcgtgggagtgggatatgagctccacaaacgtttcggggggcacccaggccccaagtccctgttccaccaccagggcagctcaggagccaggacacttagctagtgaaccctgggacctgctgcactccgggggacactgaagagctcgggagccgacaaaccacaaatgctgctacttagaacctgtgtgtccaacaaggagaagacagcaaaggagggaagactgctgggcaggagagcacccgagacaccaccactcctaccaagaagtctctgaggacaactgtgggccaggatcctgcgtcgtcagcacagagctgccttcggtctgccttggagtaagggcctcggagaggcacggggtcacagaaaacaacacttttattttcacatgaattataaatacccaggaaccctcacacaattcagcttggcccagcacttcttcagccaaaaaggtaggaggccttcccagcaggaataacagaatgtacttgaagataaaggttttaatgaaaaagggtttctaaacctcctgacagtggccacctccagaaaagcccctgggtctccacactcacagtgcaggagtgaatgtcaaaaagcactcccaaggcagggcacagtggctcacgcctgtgatcccagcactgtgggaggccaaggtgggcagactgcttgaggccaggagttcaagaccagcctggccaacacagtgaaaacccatctctactaaaaatagaaaaatttggccaggcgcgggtgtctcacacctgtaatcccagcactttgggaggccaaggcgggcggatcacctgaggtcaggagttcgagaccagcctggccaacatggcgaaatcctgtctccactaaaaatacaaaaattagctaggtgtggagtacgcctgtaatcccagctactagggaggctgagacaggagaatcgcttgaattcgggaggcggagactgcagtgagccgagatcgcgacacagcactccagcctgggcaacaagagcaaaactccatccaaaaaaaaaaaaaattacactggcctggtggcatgtgcctataatcccagctactcagcaggctgaggcatgggaatcgtttgaacctgggaggcaggcggaggttacagtgagccatgattatgccactgcactccagcctggatgacagagcaagaccctgtctcaggggaaaaaaaaaaaagcattcccaagaccccaagcacgagaggaagcaaatcccttctgtgcatcccaacgcagagctcatctcagaaagctctgcgtccaggtgtccaggaggcagccagctggccaggcagaggcataccctgggtggtcagacccatccagcgcctgctccctgccctgggcacgccaggtacagcaggggtacgtgtgggtctgtggagaagatgaagcctgccctgaagcagtatttgttacacatttatgaaggcaaggaggacacaggaaactgttcagcagaaaacgctgctgtcacgaagggagagatagccagctttgggaaatgaaggtgcccactctgccctcaaggaagcagcaagcctcaactgcacacccgccacacagctacccaccagccccaggcagtctcaggccacacatcccagaggccccgtggcatgaaaagaggatctctgagggcataatacccgactccccggtggggagtaaaatcacctctggagcacagccgggcagacaccaggcctgcacccccgtcggcactgggggtggtgcctgtggaccatcggcggctttaaattctcttggctgctcccgttccaccatcccctctgacagctaagaacaggctgagggcgggcaacgggagtaggaattgggtgggaacagcgggtggcagcggccgggcagtggcaactacaggtcacacagtcaaccacggttcccttgctcagagcctgtaactactgccatccactgagcttccaagagggcctcagactttacctggggcttcctgaattcacctggttgtctgggaggactagtgtttcttgagagacggtgagaaacatggccctaagccctctgcgtggccccgtgcccactgccgtctccatgctctgaggagcctcagtgactaaacgtggtcccaacctgtaccaggccataccaaagtcctgaacaggtcagtggtgtcaggtgccagcgtggcctggatttcttcctgacagaggaactaaccagcgcacagctccagccactcagaaaggaggcaggtgggaggctgtaaaagaaagtaagggacaggcctggcatggtggctcacgcctataatcccagcactttgggaggccgaggcgggtggatcacgaggtcaggagttcaagaccagcctgaccaacctggtgaaatcccgtctctactaaaaatacaaaaagaaaaaaaaaaaaaaagccagttgtggtggcgggcgcctgtaatcccagctactggggaggctgaggcaggagccaggaggcagaggttgcagtgagctgagatcgcaccactgcactccagcctgggcaacagagtgagactccgtctcaaaaaaaaaaataaaataaaataaaaaataaaaagtaagggatggtgaaaagaagagcatccctcaggcgccagccaagggcaggagcgggcccagggccagcaggtgcccaaggcttcctggcactcgccctcccaggctgccccctggcccccagctcccccggcccccggctctccctggccctctgggctggctcgcagtgtacctgtcctctgcccctctgcaggccaggggagtcgtggagacactgcctcgggctccagcacttcccatcgtttccgcctgggcttttacttttctctttaagaacaagctctaaaatcttaacactcaagattaatacccttaaagagaacccatgccagtcataagaaaactggaccagttcaagacaaagtaggcaaagaccaagcagataatggcatggcccaccgtgcatagaagcatcggccatatcagccctcctgcagtaaacacggactaaaccttggcaccgctctctgcctgtcaacgtggcaaagatcttcttcagaaaagaccaacacaagtggcgggcaccgacctgtggaaacaccagcactggcaccacgctcccttcccagggacttgggaagcatcacacaacctgggaacgtccccattcccaccggcaggggagcagtggacaactcccctgggtagcaagagtcccactacagagtgaggctggttttaatgttaagtacagactatcgctgggtggtaggaggatttgcttttgattttctgggttttttttcctgtattttgtgtctctacaatggacatgtaacaccaagtcccaggtgagcagggatgtgtccttcctcctaaggtccccccacccccgcaggacaaggcacataggacaccagcagggtccaatgggtgctgggaagatgaatggctgctgagcacaacaacctgaggccaggccctgcggagccagaggcaggtgcgggtcagccccaccctcagcaccactcctggactccaccagccagcgctacccactgttacaaaagcatcaacccagagggagctgcggtgacagggaagggtcccgctgtccctgcccgcggttccctctacccaccctgtggggccagaaacccggctcagtaaacctcacctcccatgcacctttccttccctgttggagaccactgggcccatgctgaggtcccgtttgctgagtcagagaatggcacttgggaagccctgtggggtctgtcttgctgagtagccaaggaacccacccagggctggtaagaccactgccagtgcagagagacgtctggtgaaggggcgtgcagtgcctccacagagaagcctgaccaaacacgagaaaggacaaaagcccacaaacagcggcttctgaaaacaccgcggacacagccacacaggagcagcttatctgctcgtagcctgttttatacgatttctgccatttttgctagggccagcttgctgcttggtaagtcccaggcagtgtggctcggtgggttccggggtgtgctccccatacctcccaagacagtccaggccagcactgagtaccgacaccccctcagaccggcgactagggctcaggaactcttcctaaacgaggggctgcctgagcagcctctccctagaggcgtctcccgggccacactgaagccctgtcacagtgacactggactgaatcaagctgaaagcttgggtgaagccacagaacacgttgggccatggcctgcacaggccgacgctcacctgagcgggcaccatgaaagctcagcaatggaaacgcgggctgtccagtgttggctctgcctcggcagccctcggtggtacccggagacagcacctgccccacctgcacaaccccatggcccacagtagtgccgggctgcacgccctgggaggaaaactaaatggcaggaagaggaaggtagcccgtgaggagggccgagccctgcccagaagttagagggagagagaaaaggccttggtctctgaggtgaccagccagggcctcctgaaggaggcaggaggaccagggcctcctagagccctcctccatccagaggcaggctgtccactcttaaccactcccacccccagatccaggtggctccgtgactccctgaccaacagaaggtggctgaaaggatgtattgtcttccagccattttcatgatggctctcctgggatgaaggccgtcccggcagaggcaaagagaggccacgtggggagtcctagagcccaaagtgtggtctgggaccatgaggttagcactgtctttacagtaccacaaaggtgccatgtgccaaagccttgtggaagccacctggcctgtaaaattacagcaggataaacacagaacctgacagatccagctctcgagatttgcaaaaagtaaagccactctatttatttgactctagaagataataggttttttttttaattttaaaaatattacttatgttaagatatactgggtttttaattatttctaaatgaattaaagttgttttacattctcaattttaatttctgaaagatgaatattcatagctccatcatgtaaactcaataaggactttttttttaattttagaggcagggtctcactatcactgagactggagtgcagcggtgcagagctcaccgcagcctcagcctcttgggttcaagcaatcctcccgcctcagcctcccaaacaactggaactagaggcatacaccatcacatctggctaattctttttacttttttgtacagatggggtttccctatgttgctcaggctggtcctgaactcccagtctcaagtgatcctcccaccttggcctcccaaagtgctgggattacaggcagaagccaccatgcccagcctcaacaaggactttaaggggtcctgagagcaagaagtccaaaaactctgctctagggtgaggatataaaactctgcctggagagatccatgtgggggaaactgtggcaccccagcagacacccatgacagcaaggcccctgagggctgccagcccagccaccacgggtggcagtgcaggaataacctgtggggccagagccccacccaccagcccacagatgcgggaaaggtgatgaggcctcatgttaggcccagaagtttcagggttggtcactcagaaacaggtgagcaggaaccacccacggccaagccggaggctgctgagccatgcccaagatcagagacgcacgcgtctggagcagcgcctgacacctgaccctggtggctgaccatgcggcctgcctggcagtcctgggcatgggatgcacacccgcaccctggcccacccaggggcagaagaggggaccacgaagttgtgtgttttctgctgagagcatccaccagagcagagctgctcaggagggcacacggtgctgcaggctgagcatgtcacacgcagagccaaggccgcctgctgggaagcccaccgctggcagggagcacagcctacgcacagaatgatgctctcatggtaatactccccacggaaccctgcaggggttcattttattctatattgtcatcttttttaacattaaaaacttggctaccggtgacactgattatttcttttaacccacaatattcataagatggttgccaaattgtaagagcaatctgacctgccaccgaagcctcctgagcgcagcctgaggtctccttgctgttcctcctgtcctcagactgtcccccatgcccacatgagctcaagggctttgctggcacagctcttcagctcagaggttatccaggtgatacacagccaggctcaccagttcctgctcacagaggcttccctccctgccccttcgtctattcaactgatacgggagctgagtcacatgcgctcctgctggctaaatttgacacagcccattcatcaaaatattattaaagacgacaatcgactgaaaaatattaaataaaaacccacgtgtccctggaaccatgagggggaggaggcaaaggcagcccttctgagacaaagcaccagggagccagggctccctccataggcctgcatggcgagtcccctccctcacctccgcaggtctcagctcaacagcaccttctcaaagaggccttctagagctcctattcaaacagctctcccacgcaccccctccaggcaccccatcccacacctccttactcccgtccccctcggcagtggggaagctgcccaggggtggctcctgttgcctctgttcacgcgtgtccggagcactcagagcaggctgcgcgcatgcaggcctccaacaggaacctgactcaacccagattctcaggcccacactcttgtatttcatgacaccactgctatgacaaatggtcctgtcacatgtggcacaaagaacagggcacgcagcagaagggcagatgtgccgggaggaggaacccagagcggccgcccatgtagagggctggccgcaggctgtggggagaggccagggctgtgcaagacaaactcaacacagacaagccatgctcacgccagcagctttcaacccacgccggagctaattttatgctcctgggctcacgcccaggcctggccccaggctcaggcatctggctcctcagggccacctggcaccatcaggcctttccatgggctgaggacaagtcccagcaaagcaggagttaggagcttccgtagacggtgcaggccaaaccccgagacaacagccccacctgggctcctgagattgcattgctgtggggatagggtctgccagcccacagcctgcacagccaccatgtctggaggggaaaaggcgctgctgaaagggtgcttggaagaaaagtctcccaacccgcaaaggtcacgggcaaaagggaaacagcatggtgcctccatgctttccaaccctccagcttgcctgctttctgcagggaaaagctgcatacctttgtgggagctctttgcctccccgcccaccacagcgaaatgctcgatgacacagaccaaaatcaccaccacgcagggcgaaaaacaggagctgcggcacttaactcactcacattaactaactcacgttagccccgggacatccgcaaacaactgcagggatgaatgaacagacattccagcccagggagccgtgtgcgctggcaaaggagaccttcaaagagaagggagccagggacagcaacgcgactgtggccacagtccacaggccaagcagtgccacagatcacacgtggcctggaagccctgcccaccatctccttcttttctctttaagcttccacattttgtttgttccaattgtttctacttccactgaacaccaatgggtgtgccccagccaggagaaatcctgtgcagaaaaaaacaaacatggtgaaggcaaagaatgggaggctcttctggccaaagacagacgggaacagcacacgcccttcccttccagacaggtctagcactggcaggaggctgcacaagcagtaatcaccacggagaaacaaaggccacggccctgtggctcccaaccagcactaagtggccctaacaaaagttgcagtgggccctggtgtttctaacccagaccgctgtgtggacaaaggagaaacactggggtgacaggggcatggcacaggggtcctccctcacagtggcctcaacacccctcctcccgtaccggatgaccgcagcagagaccacagcttcctctggagagggggtctggtggtacaccaagcccctgctcgatctgacagcagcacttggcaggcagacccctagggtggctggctttcccagggctgggaagaggccctcatgagccaggacacaagggtggcacttggtggtggcaaaggtgggggctgcgctgtctcagatacactcgtgatgagaaacgcagccctgctgtctaccagcccccgaccaggggaggccgtctgcagctcccctggtgggctcacccccagcttcaaggacacttgtgcaagggttcctagtagtcagtccgagcaggagaaatgggaggggtgtcgctaggggtttacggggaggctcattctaaaaagggctccatgtatccacgaccactgcttttttttttttttgagatggagcctcactctgtcacccagactggagtgcagtggcgccatccccacttactgcaacctccacgtcccgggttcaagtgactttcctgcctcagccttccgagcagctgggattacaggcacacgccaccacgaccggctaattttttgtatttttagtagagacggggtttcaccgtgttagccaggatggtctcaacctcctgacctcgtgatccgcccgcctcggcctcccaaactgctgagactacaggcgtgagccactgcacctggccgaccactgctctttttaaggttaatttggaaacgggagggatgatggaaaacttttttttaaagaagaggactctgaatgcaacaccaccctaggcaaacacctctgaaacccaggcctaagagtgccctggtggagccctgatggaaagaggctattcctgaaaccagaccttccagggctgcccgctggagatacagcagacctgggccagccggcttctctgctcacacctccgcatgtgctgctgcttcttcctgggccacctccttcctccttccctcttggaaaagcccttcatacctgctctaaccgagccccctgcttttggccgcactcacccactcctcaattctcctgctgcctggggcccttctctaccagcctgacagctctaggaaagcgggaatggctgtgtctccatctctggacctccgccccagcacagagcctggtacacggcagcccatgaactcaggaatctggggcccccggctgaggaacaggcccagctcactgtcctaaaagtcacagtcacaaaccgcggatcagtggtggaaggagagtggcagatgcacatctccccaggacggaattgcacttggtgatgaagaggacggagctgcagacacacgcaacgccatggatggacgttcgcaacactgcgccgcataggacaggcacacagcccgtgtactgggattccatttgcatgattcagctcacccacacagatggcgggagactggtggccgcctcgaggctggaggtggggatggggagcagtgccagtggacatgaggcttctctggggcatgatagcaaagttctcaaattaaactgtggtgatggttactcagccctgtaattttaccaaaaattatttaattgcaaacttaagttaactttatggtatgtaaattatacctcaatgaggctgttaaaagaactctagagattcaagcaagttcagcctgggtgtcctcataatcagaatcaattgtcaaccaccagtaacatcctcccatgcggcaaagaaaagaaagaagaaaaacaaggtcatcatcactccattcacattcctgcagagacacacactcacgagattttatctcggtcagagaggaggacccctgaaggcagctgggagagccaagttagtaagcacaagctagcagccccaaagaggccctccccactcacctgcagtctgtcttcaatcagagctgagtcagtaagcacaggccagcggccccagagaggccctccccattcacctgcagtctgtattcaatcaccagcactgtggtgccacagcccgagcccgctaacccacagttcacctgctgcttggagagtaaccagggcactggtgtcaaggcaccgtgcggcctcagaaggagccaggagagccccaaggaagggtgcctgagatacgtgcccccttgccctggctgtggccagccagagaaggtgcctggaggagaggggcctttccccacaaactccaccacactgggccctgtgcagggccagcaggagggcggctacattcccatcagtcgggaggggaggaagtgtgtttcctctcctgtattcccagatgctcagctgctcctgggctgtgcgttccgttgggtaacactgactgcacacacacctcttcacaaatgcctgttgtcagttgaagacaagacaaaagtttctcctaaactccaaacagtgtgtggtagagttcctcccttccctagcctccacagaaaccaccgcagctcaagcttctcctctccacctgcctacaactcagtggcgcgggatgacatcctgtcactggctgcccagaatggaacagagcttgtatacaaaaagtggaaaccgctttcaagttacaaattactctttgtaaaaggaagaaagagagaaaaaaaagtttacctttacagctacttcaccagcaaactcaaagcaatgccaagcaaaggaaacctacgagaaagagatggtggagagccatgcctgcaaaccttctccggaaaagccccagccacgctcatcatcaccagtcctgacgtgctgggctctgttccggtttcccgagcaggtttccctgcagggcccccgttcctcaggagcggctaggagtgctgatgataaggctgctagaatgctcagcaggccaggctcttagctcttctcccagtgacaaggaagacatggcttttcacttgcacatccacagaacactcttccggtgatcagaagagaacacggcaggcaaaggcactgtttgctgctactgtcaagtccatactttgtcatctgagatgaactaattcaaagaaatcctttctttaaacaaaaacttttaaaacgtaagagacctgtattccaaactaactacttggctgacagtgagtgctttgaattaattaaaaatatcaagaaatagtcaaaaataacacatttccccaatcccagactgacagctagttgaaggattaatggccaacgaaagcgctggcaatgaccacacaaaagctgctgagataggagcaagcttcttcactcaccgctgacccctctccagtggcagagcctgattaagtgagcagtggaccagaatgagagagacctgtgggtccctgcggctcgctcactcttcagcttttacaacttatttttatagtagatgctcaataaacatgtgaaatgagcagagggaaggagagacagagtagtccctgggccctctctgccctgcatccttgtataccagcttaaaacaggctctggaggaaaagcagtacttgaccactgaaatgtacctcttaaaacaggaagcacagccaggcgcggtggctcacgcctgtaatcctagcacattgggaggccaaggtaggcggatcacctgaggtcaggagtttaagaccagcctggccaacatggtgaaaccccatctctactaaaacacaaaaaaattagccgggtgtggtggcaggcgcctgtaatcccagcgactcaggaggctgagaggggagaatcacttgaacccgggaaacagtgttgcagtgagccagccaagatcgcgctactgcactccagcctgggcagctgagcaagactccgtctcaaaaaaaaaaaaaaaaaaaaaaaaggagggggggaagcatatatttaaggaattgttaaagaattcatgattcacaacgtccaatagatttgaaaccacatatgcaaagataactgcactccatgctaatcccacttgaaaatctcactgccctcttggaactgcccacttttacagccaggcaacggcaaacacctcttccctggccagggccctctgaggcagcagctccaaggtcctcaccagccttcccctggcacccagacccagcctggggcccatgagatgagtgtaccaccatccttccctggaggattacttggttaccaaagtcttaacaagggtcacaagaatctgtcccccaggctggtcgtggtggctcatgcccataatccctgcactttaagaggccaaggcaggtggatcgcttgaggtcaggagtttgagaccagcctggccaatacagtgaaaccccatctctactaaaaacacaaaaattagccgggcatggtggcaggcacctgtaatcccacctacttgggaggctgaggcaggagaatcacttgaacctgggaggttgaggttgcagtgagccaagaccatgacattgcactctagtgtgggcagcaagaatgagacaaaaaaaaaaaaagtggcaactgacagaactgcttgtactgcagctccagctaaacattgttttcaatctggggcacatttaaagctttcatgcactcttgggtctcttgctaattagttaagaacagcacattcagtaagtactggtcagagagggtaggttagctgccccacgtctacttccatttcctttttcttctctttgcttctccccctcttcctcctccttccttctcctctttttacttagtaattgaatgctgagcaatatgaccacaggaaaaactattttatccagcttcccaggtaggcgaggtggccaacgagatgtaaggtgaaattattgcatagcttccaggaaatcctttttgtccttcctgtctaccccagccctgtcccagtctcctgcttcctgaccagaatagacaaaaaaaatgatggctggagctcttgcagccaccttggagcatgaggaagtgatgatggagagcagaaaggcagaaagaacctgggttcctgctgaaactcagaaccctccacgacaatcctgattctcttaccaaggtgcttatgttatttgaaagaaatatgggttaaatcatcgttcttccgaatttctgctacttgaaggaaaagacaatgtctaattgacacatccatcggtgtatcatggtgctggaggtgaaacagcccatcctttactttgaaaagaatgttctcagatcattagatccccaaaatgttgccaaatccctaaatgttcatgggatatatctcttggcaagcacatgtatattttttctctttttctttttttctttttagacagagtcttgctctgttgccaggctggagtacagtggcacaatctcggcttactgcagcctctgcctcctgggctccagggatcctcctgtctcagcctcccacatagctgggattacaggcgtgcaccaccacgcctggctaatttttgtatttttagtagagacagagtttcatcatgttggtcaggctggtctcgaactcctgacctcatgatctgcccacctcggcctcccaaagtactgggattacaggtgtgagccaccgcgcccggccacacgtgtattatttagcctctagagtatctaggtcctcggctccggggcctgtgaacgtggcatcattcatacgatgtgatatcctaagagacaatcaaaatctgtgtggacgaggccgggcgcggtggctgacgcctgtgatcccagcactgggggaggccaaggcgggcggatcttgaggtcaggagtttgagaccagcctgaccaacatggtgaaaccccgtctctactaaaaatacaaaaattagctgggcgtggtggcaggcacctgtgatcccagcactttgggaggctgaggcgggttggagaccagcctgggcaacatggtaaagccccatctctaccaaaaatacaaaaaaaaattagctgggcgtggtagcgtgcacctgtaatcccagctactccgaaggctgaggcaggagaattgcttgaaccctggaggcagagattgcagtgagccgagatggcgccactgcactccagcgtggcgacaagagtgaaactctgtctcaaaaaaaaataaaaaagtcgatgtggatgaaattgtggcagagcgaattcgagtttgcaggaccctgaggcctgagtggggaggtatactgccaatttctccaaataacaacaccctgcttctgatgttctctgtttattgggattgaggtgggtgtggctgcctgatcaatagctgaatcataactgttgattggctccaataaggacaccacgtctggaagaacagctgcagttggaatcattacatctttcaatccactgtcaatcaccaacactctctgtcttccgcacagacaacacgtgggagtgagactggaatcctagaggggccccttctctgcaactttggggtctgggagggtggcacccatttctgggcatctctggagattaaggtttgcttttggttgacagttctggcaggaaggaagacccatagcgtttcccactcagccctctcctccttccattcacccattcatctgacaaataggtagtgagtgccaactacgtacaaggacaaggcacttgtaaggtgcctggagaacagtagtagacacaacagactaaagcctccccttgaggagctgtggagtgtcagtgaaaaaaataataaagcaggcagcgcattcaaaatgaccagtaccctggggtaaacagagccagggagagggtcacggcacactcagtgtcatgggctgacgtgtgtcccctggaaagataagaggcagttctaacccctagtaccagtaaggtctgaaagggaccttatctggaaaaagagtcactgcagacgtcattttttgttgttgttgtttgtttgagatggagttttgctcttgttgcccaggctggagtgcaatggtgcgatctcggctcactgcaacctctgcctcccaggttcaattgattctcctgcctcagcctcctgagtagctgggattacaggtgtccaccaccacgctcggctaatttttatgtttttagtagaaacgatgtttcaccacattggccagattggtctcgattataggcgtgagcccccatgccctgtccacagatgtcatttgttaagatgaggtcctggtggggtgggggcttccaatcctatatgactggtgaccttataaaaaggaggaatttaggctgggtgcggtggctcacgcctgtaatcccagcactttgggaggcagaggcgggtggatcacctgagatcaggagttcgagaccagcctggccaacatggtgaaacgctgtctctactaaaaatacaaaaattagctgggcctggtggtgggcgcctgtaatcccagctactcgggaggctgagacaggagaatcgcttgaacccgagaggcagaggttgtagtgagccaggatcacaccactgcactccagcctgagtgacagagagactgtctcaaaaaaaataaaaagggtcggggggagtttggacacagcctcacgtagagaagacagtgtgaagagacacaggaaggagaaggccatctacaacacaaaccgaggagcgacacctggagcagacccttcctcacagccctcagaagaaaccagccctggtgatgctgacaatgtcagacttctggcctccaggactgagagacagtccatttctgtggattgaagccgcctcgtgacagcccctgccctttctaatcaggctccttccttctgcctggctctagagcagccccaggggctgctgtgcccactgggagttcctggccagagaagtgaggggcttgattttcccaatcatgcttccatctagactggggaccccttacaggcaggacctttgtggagatcctcgggcagctgtcctccactgtggggtggaaagctggggcttccaggataagggtgacctcatggcatgtttcaggggaaagacctgattccccagtcaaccgctgactccaggatgcaggccaagccctgcggggtcattcacggactctgctctgaccctgtctgtccttctctcgggcccactcattgcctttcggggccagcaggggacatagctggtgctcagcgtcccctctctgtcccaggctgcgccgccgagaggccttggcacggggtaggcctcgtgacacacacattctcctacgctgcagagcctggagaacaatggctccctctcacctctgagctggttcttgtgcttgggacagtccccagtgaggctgagggtagccacagctgccagcgcctgcctgggcagcccctccatccccagcacccccatggttcagcattccctgtacctcctagacctgaacagagtctgatttggggatggtggcgcagaagcctgccctgcctcccggtcccaaggtgccgccagctcttccaagccttcaacaaacgcctcagatgccctcctgctgatcgcactgtgcctgctgtcctgctcctgctccctcacttaatccccaggcagtgacaatccagagaggaggctgaggctcctggaggaccagaggcttgtccgaggtcactcagcgagtgggcgggcagctggggttccagaaacatctgctctcaagcccgccattgtcccaccatgacctgcctaccaaagggatgctcctccctgggtcttgaggaaacagtcaaggtggtcacccttgggagcaggctgggcagtgttctccaggcttcagtcatccccgcctcccctccagaggccaggacagcccctgcatttggcttagctctccgtgggggcctggtgcccctggggtgaccggaatgcaggcagggcatgaggatgctgataatcagtgtcacctgggattatggctggggccgtcccatgagccaggtgcagccgaaagctccgtgtgcatgacctgaagcagctgccagtgctctctgagagggtgccctctgcctccctatctccaggtgtggctaagtaaacaggccacggcggcaccacagggaggcaggctgggtgctcctgctcatctctggtggatgctgctacccacatccagggctgtcacctgcccattcacgcacggccctccaggccacttcctcccccaggacctgcaggcggctgcaacaacccccatcaaaggtcccgctagccaggattcactgaggtccagtagagggagggctgcagcctctgctcccagaaagctgccctgtcctggccaggagcagtggctcatgcctgtaatcccagcactttgggaggccgagacaggtgtatcacctgaggtctggagttcaataccagcctagccaacatggtgaaaccctgtttctactgaaaatacaaaaattagccaggcgtagtggcacatgcctgtagtcccagctactcgggaggctgaggcaggagaatcacttgaacctgggaggcagaggttgcagtgagctgagatggtgccactgcactctagcctgggtgacagagcaagactttgtctcatatatatatatacatatatatatatatgtacacatatatatacatatatatgtacacatatatatacatatatatgtacacatatatatacatatatatgtacacatatatatacatatatatatgtacacatatatatacatatatatatgtacacatatatatacatatatatgtacacatatatatacatatatatgtacacatatatacacactctcatacacacacatatatatgtatatatataaaatatgtttattattttatgcgcacacacgtatgtgtgtgtatatatgtgtgtgtgtgtgtatatatatatatttatttgagacagggtatggctctgctgcccaggctggagtgcaacggtaccatcgcagctcactgcagcctcaacctcctgggtacaaacgatcctcctgcattggactctcaaagccttgggattacaggtgtgagccaccgtgccccatctctgagcatatctttctggggcacacaattcaacttgtaacaggtgcagttaccggccacatgattcatagcatatagggtgtgctttacctgaggctgagacggggctcatctcccctgggaatcattcttgtaaggtgccagtgatctgcaaatgcagatgaggcctgaggctggggcacaggccacctgccagctggcaagtgcaggatgggcagagtccttgtccagacctgggcagagagcgctcagggcaggcagcgtccaggctgccgtgggttgctccttgaggccctgacccccagggtcacctgcaggccattccttgaagcaaagaggtgactgacctggggagttgggaacctgccctttgtgtccccaatgagcacccttcctgccacccccacccggccgggatccaccacccttcctggccggtggtgccagcccctaacaaaacaccctttcaggcaaggacctgcaggtttgctccccttgccctggggacagagtctgacatccttgggaactgaccgttccctgccccctccccagctctaggaactacttcatcctgtgcactcggcagggtgcccggccctaggtgggtgtgtggtcggtcaggggctcccgtggctgcagtcatgggctcccctgcactgcggggcttcgaatgtgctgctactgttgggaaggagttgctcctctcaaagaactcctgctcatcacacaaggcctctctcacatgccccttcctccaggcagccttcctgagtggtggcaccttttgtacacacctgtcacagaaaccactgatctcagagtgatgacagaggcttgtttcccaggcacgggggctccgaggggccatccccagcaccagaagggttccacacatgttaatggaaaaaatccacaaaaagcaggaacgggaaagtaagttactgacattccacccctccccaattcccattttgcagacaagaccctgaggccccagagggcccagtgggtgcggcacagtatggaactggcccccacagagctagcctgtgcacaggttccccgtctccctatgggaaggaggaggcaccaggcctgctccagctccctctcctggattgggacactgaggcccattacacaggtggggtactggcaggacagctctgccctccagggtccagtgggagctgctgctgctcccacaagccacgcagtgcctggagccagactgggagaagctgtcctggtgggagcctgtgccctgggacacagagtgcatggtgcacatggccaaagcgtggcctggaggcgtggagggtcaggaagcagtgaaggagcagggcctcggcctcgtggggatgcacccacacagtaactacagatggaggccaggaggctcagccttcctcctggctctgcctctagccagctggggttcactattgtcccctccatccactgggtagggacccctagatttcaggtccccaaatgtacatgtctcatcaacagatgcagcagactccgtagggaaactttggaaatacagattcctgagccctgcccccacagaggctggctatgtaggtccctgggccctgcatttaaagatccccccaggcattgctggagggcaggagggtgggagtccccggaccagatggaccctgacagcctgacagcttttacttatcaaacccatgcgggccccacctcctgggatgctggctctgcaaactcacctctgcggagcccgttcctaggactggttgccagcagtgtggtgagggcagtctgaagggttcccggtggtggtcatagagcctgcacacgcctccttctcccaccgatacctgttatgggtgggattgtgcatcccacattcatatgtcgatgtcctgaccccagtacctcagaatgtgacctcattatttggaactagggtcactgcagaagaacctagttaagatgaggccacactggagtagggtgggtggacggccttgtgaaaggctgcagcgaggggctgaggcagatgctccctcctggccctccacggagcccacctgcctacacctggatcttggactcatggcctccagaccttgtagagacatttcttttctttttctctcccttccttcctttctttcctccctccttccttccttccttccttccttccttccttccttccttccttcctttctttccttctttcttctttttttgttttgttttgagacagaattttgctctgtcacccaggctggagtgcagtgacgccatctcagctcactgcaacctccacctcccgagttcaagggattctccggccttagcctcttgagtagctgggattacaggtgcctgccactacacccggcttatttttgtagttttagtagagactggggtttcaccatgttggccaggctggtgtcttactcctgacctcagatgatccgcctgcctcagcctcccgaagtgctgggattctaggcatgagccaccgcgcagggctggagagacgtttctgttgaagccgcctggtttgcggtgcttggctccagcagcctcaggccacacacaatatcccagggcggcaccctcaatgccaggccctgctgggaagtcaagggccgaggtgaacatgccctctgcacggtaggggattcagagtgccgccctgcacctgggctgggggaggagcgcagagcacaccggcagaccagggaggggcccttccaggaatgcgctttgtagacagctgggtagggctggggcggactaaggggcctgcggggtctggcggaaccatccaggtgagggcgtggtggcgggagagccaagaacagcagctaggtgtactgcttacctgagaagggggggtggccgcgaagggggttggaggcgttgggatgggggcctagtcagacgcaggtggccgctgccatttggcattgcccggtctggaggacagggagaaaacctggctggagacacagctggtcactgactgcctgagtccctggggccgcggtgtgggcgaccttcctgcgggacccgcaagcccagagcaggtgcaggttgtgggtacagctgaggcagccgaaggaccaaggggagggccttagaaggagggtgggctgggggcgcggggtggagacagggctgtgccttcctcccagcaggtgggttcccgacgggtgggcgtgcgtgcagggcccccggcccgagaaccggccccagcctcggcgggcgcgggcagcagatggcgctgccgggctgcgctccgcctcgggttcggggagcgccgggtgggggtggcgggcgagcccaagtcgaagcccgaggcgggagaagagctcatactacgttccccgggccggacaggcgggctccggaggggcgctcgccccgcccatgcgggacaggtgtttgcccacctaggccccggacccggagccgcgctgcccacgtgctcggagcggagcagctgctccccgcgcccgccctccacgccagcagtgcctggggacccggacccgcgaggggcgcgcaggacgcgggagccgaggagcagcggcgctttgcggatggagagcgccgcggagggcagtctgggagtgggcgcggccccgccgggcgtgaggtcatcgcgagcagctggcgcaccccccgcgcctgcctcccggtcctcggagcccccggctgcgccccgcggcgcgcgcaggttgggcaggttctgggctctgggcggcggggcgtggaggagccctggggcgggattgtgactgggcgcttcctgcggggttggcggcccggacgccggtgccacccgagccacccagcgatgctctgggccccctacgtcggggctgacctcaccgcccatcctggcggaccccgcccgctctaatgggaccgcgcccaccctacactggcctgcagccgccgtcctcccggctgcgggttccttgccctcagggagggcggggccgccaccagctgcccggagaggtggggggacccaaacctcccctcgcccacaccaaccccgtcctactgccctcaatcctgcccctcctggagtttcttgttacggtccacacaggcgaagggccccatcggccgcgccttgccagccctaatgccctccgagaggcggaggccccacagtaggaacccggactgaagtcactccctggcgctgctaggggctcagggtggagggctcaagggtgtccgggaagggccttcgcccttcagcctcaaagcccccccagtcctctggttttctgttcctcttttgggcccccagcttgtgagcgcccgctgggtaggtgggcaagaggtgaccgagcagaaccaggcaccgggaccgtccggtttgggtctggcttccacactggctgcagtgcgccctgccccaggccggcaaagtctctgagccccattcctgccgctggccgaaggattgggttgggcgaggaagatatggaaactgccccacaagcccccctcccacccccaggacgccgcccccaccggctaggctctgggcaggcctagtgtccactgatctcgccaatcggccctgtgttccagggctgtcgggggtctcctgggccaggggcttgacggagggagtggggtggggagggtggagaggcaccggaatctctttctgcttgggagtgggggcgggcggatatcaggaggggccactgccccgcagatgacccagagccgaagaccgcgggctgtggccagcgcaggctccacgcgccccgaccctcgcggcagggaggccccgcccactgttgggcaggttcttgacttcaccctgcttccccaaacgtttccgggtgcaaacgcccctctgggctggggtgggatgagggaggggagccctagaatggagttttgttttcctcctctggcatcaggtgctcaagcccaagctcctccctccacccgcctctggcccttccctggcttctatttccagctctccttggctatttatagctgcgaccggccggcaattgcgtcagtcaggggcaggcttcggccggcgatgccaacggtgccaccagtccccctacattcccctacccttcctgggtagtcacctgccctgcgctgtcctggtcggaggccccaggtgtgtggggggcgggagtgcgttctgcaggtgcgctcagccatgagggcgcatgtgctggggcagagtgggagggcactggacttggtggggggggggggcagcagaattcctggcggggaaggggtaagcggcgtcttcccctttccttcccagagcttcctcctgggagctgcctggggacaggccactgttccttggtttcatgggtggtgtctgcaaagactgggagagatgcccctggacctagcacccgtccccctccccccgcccaccttccagaatgaaggcccttcactgagttcctctcctctcaccccactactgaggcctccctctccccagcattctcactcaactccagttcagctcccataccccttccctccctgaggccacccccaacccagcccctctggagggggacattgaagggttctgaagcaagacaagtctacctgctcagtttggaaggactgaagggcatccacccaggcacttgcctagtgtttggcaaaggcctgccctggcatcgccctgcttgggggtgggaggcacacgcatgttcccctcgccccaccaggatcccctctgagctctggtccccacagtcagggaccactcgcttcacaaacaagccatcatcacgccttcagggcctagtgtcttccacagaggctcctaccccaggagacccattcccaggggcaggagtggggcctgggactgtgggctgccttacaggtctagaccctcacccctgggccagaaggctgtgctttctctggagggactgtgccgccgagccccagctgcctgcagggataattgagtttccccacgtgctcccaccatggacacaaggcatttgttgtgaagctctgctgagaatcagcccctcctctcccaccctctgtccagggcccgccctgccctgtgccctgcgcccttccggggaggttggggcaccctctgctggtgtccattgtataggcccctcaaagactccatggcttccccttaacagcaagtcctcccttcatcttgcccacaaagaaccactcttcttagacactcccccaacccacctgccattcagagccccatcgagatgcaccctcttcccgtcgggccttgccttggccagaggccttcagcttctgcctggctccccgcagggcgctcctacctctgccttttctcccatgctgtggacctttgcaatgtcctcctgccccacctgcccccagcccctccaaacacaacctggccttcagaggccaaaactctcctcctgaaaggcttcctgagaactggccctctgccctttctcctgctcagtctcttcagttctgagctccggaagggccttggtaagtccatccacaggagtacagtggcagctggcaggggtgccactgagaccagcctccagcttacttccagggatggctcggcaggcagaggaatggtgcctgagagaccaggaaccaagcccagccccaacttggcccctgaccctctaagggacattgaccaagcctgttcctctccctgggccttggagagggtctctcctgtgatgtcccactccaagacagttagtatgtggcttattcattggacattcactgggtaccttctgtatgcaaagaccaggtacccatctgcagtccaatggagaatggaggtaagcacaagctggctttaatgtaagactaacagaagtgcaactaacgcaatgtaacattattacccacccaccttcgctccctccctccctctcatttacccattcttccacctcctatccaccccatcacttctccacccgtccatccatctgtccaccttcctttccttctactccctagccacacatctacttgcctatttatgaatacccatttatgtattcatccatccatccatcctattcattcctccacccattcatccatgtacccacccaccccactcatccctctacccattcatccatctgcccatccatccatccacccacccaccccactcatccctctacccattcatccatttgctcatccatccatccatccacccacccatccaccccactcatccctctacccattcatccatctgcccacgtatccatccatccacccacccaccccactcatccctctacccattcatccatctgcccatccatccatccatccatccacccaccccactcatccctctacccattcatccatctgcccatccatccatccacccacccaccccactcatccctctacccattcatccatttgctcatccatccatccatccacccacccatccaccccactcatccctctacccattcatccatctgcccatccatccatccatccacccacccaccccactcatccctctacccattcatccatctgcccatccatccatccatccatccacccacccatccaccccactcatccatctacccattcatccatctgcccatccatccatccatccacccacccatccaccccactcatccctctacccattcatccatctgcccatccatccatccatccatccacccaccccattcatccctctacccattcatccatctgcccatccatccatccacccacccgcccaccccactcatccctctacccattcattcatctgcccatccatccatccatccacccacccaccccactcatccctctacccattcgtccatctgcccatccatccatccatccacccacccatccaccccactcatccctctacccattcatcatctgcctatccatccatccaaccacccaccccactcatccctctacccattcatccatttgctcatccatccatccacccacccaccccactcatccctctacccattcatccatctgcccatccatccatccacccacccaccccactcatccctctacccattcatccatctgcccatccatccatccatccacccacccatccaccccactcatccctctacccattcatccatctgcccatccatccatccatccacccaccccattcatccctctacccattcatccatctgcccatccatccatccgtccacccacctgcccaccccactcatccctctacccattcattcatctgcccatccatccatccatccacccacccaccccactcatccctctacccattcatccatctgcccatccatccatccacccgcccaccccactcatccctctacccattcatccatttgcccatccatccatccatccatccatccaccccactcatccctctccacccattcatccatctgcccctctatccatccatccacccatcccatttatccctccacctattgatccatccacccatccaccccactcatccctctacccattcatccatctgcccacccatccacccattcattgatccatccatccatccatctacccacccacccaccccacgcatccctctacccattcatccatctgcccttctacccacccatccatgcacccatccatccatccaccattcatccatctgcccatccataaattcacctatccatccatccatgtctccctccctcatccacccatctacccacccatccaagacccatccagcaactaaagctcttgtcctggggggagacacagctgtaggcagggcaacaagcctttaggggactctacgtagcagttggaggccagtccaccagtgttcaactcttgcttcaccgcctactttgggcagctcttggaccactaggagcctgattgagttggtaaatgagaccccctccttccatctggagtcttacactgcccccagggtcctgagacctatgtgccccagatgggcatcctaggagaggccgtcacccacctgctggagctgcaggtgctcctgcgcacagggggtaagggagcacctcggtgctgcttgagtcagccatcagctctttccaggcctcagttttattgactgctgggggctgcctgagttataaatagatgttcttgagccaaaaatagccttgcgggagcatcagactatgtttctagctttcctcctttttgaggactcttaaagatgcaggattcaaggaccctacctcctcctgcagcccccgaggagggactggccccctcctcttcccctctcttgcttcctcttcctcctgtctcatgagcactcacacacacggtctggacagcatcactggttgggaggggtccctgggagaggtatactaaacctggaagaagctgcatgaaccaggtctgtgtggtaaggacagatctggtatcctccgccacagtgtagacaagcctcagcccgggctgcacgcacactgtgaatctttgcagcctgtggcacctgcagcagccaggtctgccctcggtggggggtgggggggggggaggcggggctctgcaggccgggctggggctgcctccagggagaggaccctggaggctggggacaagcctgggggagacaaaccagtactttctaccacataccctggtgtgcttttaatccttgtatgacatgcacattacttaagatttgaaaagctggttggaggccaggcacggtggctcacacctgtaatcccagcactttgggaggccaaagcaagcggatcacttgaggtcagtgagattgagaccagcctggccaacatggtgcaaccccatctctactaaaaatacaaaaattagccaagtgtgatggcacgtgcctgtaatcccagctacttgggaatctgaggcatgagaattgtttgaaccggggaggcggaggttgcagtgagcggagatcgcaccattgcactccagcctagatgacagaacgaaactccatttcaaaaaaaaaaaaaaaaaaagtctggttggagacactatatatagctagacccctatttctgctggtacgtatatgcacccacacacatgcacacagcacacagcacacatggaggggctgggagggaagcatccaactgttcacattgggattgtgggagtgaggggactggtgggtaacactgaggttttatatcgttttaagttatttaagcttttactagcctgtaacaactgaaaaagtgtgttttacaccctaaaggtgcagctgaggacctgtgcccatgcctggcccccagggactattctcagagctcacccgcggtgtgagcctggggcaagtttccagacccaacacaccaggctctggcctcaggcctgcctcccagcagcctctgcccccaccctgcccaccaccagtctgaaggaagaggcgcggagtcgtggggaaaacatccactttaagctttattacaacacattgtctccaaatacaaagggaggggccgggagcagaaggtgcggctgtggcgggaggggctccaaggggggctgaagggccggcagcccagtctacagagactggaggctcagcgggggacctgcaccctctcctccgctggacttcccagcaaataacaggaggggccgggtccattttggggcgatcccaatgccaggcagtggccaggtgggaggggccggagagaggcttggagaggactcagggctgggtcaggtgaaagccaccaggtggggccctggcccgcctcccgcagcactggaggaggcagtggccaggtgggaggggccggagagaggcttggagaggactcagggctgggtcaggtgaaagccaccaggtggggcctcagcccgcctcctgcagcactggaggaggcagtggccaacacaggaccttcgcccccctgctggctgctcactttgcggtaaccagtgcctcaagagtgggagcagagacagactgagacagacagcccccctcaacggcctgcagaagggacaaggggaagggggaagggagaagggggcccaaccagtggccccagaccactgtctcccggacagcacaggggtggggggcgagaagcgggaagccagtgcatcctcctcacccagggtctcctcagaaacccaacgcaacagacatatgggaggcaaatttacataattaataataattaaccaataataataaatacttaaacctctaatccatagattgcaaatacaacgatagcttattttcttgggggaacaggagtgggtggggacagagggaacgggaacaggacttttgctgaaaggagggatgacaggaacacagagctgtgggtgaaaagaagaacaaatagaagaaacagcagagagggcggctggctggggcgggatgggcgcctccctggccctgctccaggactcaggactgggtcctgccctgggctgcctctccggccaagcccctggcctcttcccacagtgactggccccactcctagaccctaggacatctgaagggcaggggtcccaatggcccgagggggtatggggcaggggcagcaggctgacccacctgggcccaaaagccacttgtgtttgggggctggcatgccacctagagagagagcaccctgggaaaggggtgaatgggagtttctctcctgagcggccccatgggggtgggggcaaacgagggggctttacctgtcttgaggcagtgctccctaagtgaagcaggcctatcccagcagcacaggggcttggctggcgcctgaactccctgtgtgagcagcacctgctcacagagcccctcagcctgcaggtgcacacctgaattccaagttctgcctggggcatggctgggaggggggcggggcagacctggaacagaaccctaagaccaccccctcctcatacctgggggtccagggcttcctgcccagtggagccagcactggctagccaggcgcctcctgcctgacccccggaggccaagctcctctcctgcaatggtgccaccctgcccggcaggcagctctgggggcatgggcaagggagaagggagggccgcagccctctaggaatggcctttctgagccactctgtggctggactggggctctggcaggagttgggggcactaacacctctgtcctcccctgggctgcacctcatctgacgttccagaaccccctgcccgaagcccctacacacactgttctatttctcagcccctctgaacaccctggcaccatgaagcccaatgcctgtcctcccctgccagagaacagctctggggcaacgggcagcggggtgccctccttgccaccaagatttggtgcctggagctgatggagggctggccgcacctctccggggcacaccagctcctgctcctccatcctatggctttggtgcagagccctaggccggcgcagagaagggagggagcaggggaggtgggtggggggagaaggggggttctgcggctcagtttgtggcaaagaagtttttttttcctttttttcacctttttgttatgtaaaaagtgcacgaaagctcggcagcctttgcaaaggtcagcagtgtttcctggggcgggggaactgggaggggccccaggcctggcacccagcttgcgactgaaggtggcctcgtattgcttagaaacgtatgtttcagtttaaataccagacagtaaaaatagagctcgaggaccacccgcactgttgccaaatcattgccagaatgaacagcttaaataaataaaaaatcgaaatatttacttctcgataaaaatcccagtaaaaccatttacctttctttgcattatatataatatacatttataacgggcctggctgcgggcggcggggccgagggcagcggaggggtcaggacacctcgatgacctccacgctgcccgagaagctcgcctgcttgcccagggcggccagctcctcgccgcgcgcgcgcccctccaccatgccctcctcgaactccatctggcagctgcggcgcttgaactgcgtctccggggccggctcctcgggccagccggtccgcgcgtcccggggctcagccctcgctgcctcccgccgccgcaggtcgctgccgccgcctggtcccggggcgcccgcccggccgaagggcgcaaacagcaccccgcccgccccctgtgcgccctcggggctgaagcaccagggcccgtcgggcgacggcgtgcctggggagtcgagcggcggtgcccaggccccggggccggccggctggccagggccgggcagcccgggcgccgacagggccgagaggccgtgccgcggagtctgccgggccgcatcgccgaagttcaggccgaggctgtgcgcgggggagcgcgcgggggagccggcggggggccggggccgccggcggggccgtgggcgcgcctcaggcgcggcgtccgggctgtccgggctgggcgaggacaggcccagcgcggcccccgacgggctgtccagcttgcagagcttcggggcctcgccggggtcggggggcccggggccgtcgggccgcctgctaggggcgtaggcagacttgatgtccagggagaaggagcgcttgaggcggttagtgtcctgcaggcggtccgaggagaggtgcaggccgcgcaggccctgctgcagtgcgctggtcgccgggggcgtggggggcgcggggggctccccgcccgcgctcaggccgccctccctggcagccgcattccctgtggcagcgctctctgaggtaggtggtggcagccgtggcagcggggccccggcggcaggactgggcggaggctccggcgtccctgagggggtgcccgggtcgccctgcagggcggccagcagcttcaggctgcgctcgtactccagcagctggcccaggaagttgaagttgggcgagatggacgggcgcctgtccttcacgaacctgcgggggaggaggctcagtcccaggcgcccgccggggccaggctgcccacctgacgcacccgctgggcacccacgagctcatgtgcgccaggctggtctcaggccctcctcccttgccacgggtcctggacggtggggtcattctggtgcaagtgggcagccgggggaagggaagcgacgctgtgagccacaagtgcgcgactggggaaggtggtacctgtaggcgtcgtcggaggacatgcccatggtcttcatgatgtaggcgatggcgatggtggcagagcgggagatgccagccagacagtggacgatgacttggcagctggagagcttggctttatctgggcaggtgggccatgggggccaggtgagggctaagactgcacagcttctccctggcccaggtaggggaccccacccgcccaactgccaacagttccggctacttcctggggacccctcctgtgtctgtggccacacacagctctagccttcctctagccaggtccctgccctccgcccaccgcagactcaccgatgaactcgatggacttgtccagccagggcagcagtttttcacagtagttgtcgttgatggggacccgcatgaagcggctctcgcagatgaagtcaggcttggggcaggagttgctggcgttgaggacgtagcttattccattttgcgtcatcagatcctggaggggcgggagggcgggttggaaaggggtgggagaagctcggggcgggagtgaaggtggaggcttttcctgccctgccgtcaggagggcctttagaatcctgggagccttggaatttgtcccagatcccagtgtatccaggggagggcccaggaggcctctctggtccaccctggcaccctgggcccgtgcggggggtggggcacggctggcctccgactgcaggccccacccacggctggtggtgggctcctaggaattttatgattgcctgggtggtggcttttacccttttccctcgtcaccatttttaaaacatgggattctttcagagctggccagaggcccagtgacatccgcagcttggcatgccagctccccgctcctcccccgagccctgccgggccctcccgcaagccctgctgtggtccttccaggggcatgggtggggagcctggggtcctcctgggcccccacccatgcttctcccacacccagctcatccactgccttcagctcctttcctccctcatcccccgctccgctgccaagctgcttctggagctcctgcccctttcccattgaccaccccccgaactccactgcacacacaccttgtttaggacgtccttctgcgagcccaggtagaggtgaggcaggatgcgggtcaggcccacgctgggcacaggcaggcagggctgggagaggctcatgggtagcagggcagcaggcttgccctcgcagaggccggggaagcaggaggagaaggtggcgaagccccctgtaggaggagggccgtcaagtgggttgagagaacacctagggctccctgtccgcctagggtgccctgtccgcctagggcaccccatctactgctgaggatcagtcacacccagcccagacccgagcctgagcccagccggcaagcctctggcggagcacctgctctgcccgcggtggggggagggggtactgccacacatttacagcctgcacctacgcccacattcctcctcatgctaattaggggctgacccagctgaggacgccgctaggatgcccgtaaaggtggcgttgaggtggctggccatcacggcacgcgctgggcccaggcaggggtgggctcagaggccacaggggtctcctgctgagggtgtgtgtcacacagcccagaggagaggccctcacgagcccggccatctcccatacccatggcctggggccaggctgggccttcctcctcccctgcactgatgcaatgcctccctgcctccagctggctgggagccccaggcctgggcttgggtgccaggaccaggaggccagggcttccgagaggccctccccgtccccaggcatgacatcaccctggcacagccctcggggcatttgctgtctggttatggctgtactccacccagcaggggaggacggagagtggagaagcccggggcactgggggcacgcagagcaggcagtgggcacccgctgcacacgtgaccagcgtgtgctgctgccttccacacacgtccaagtccgaggccacaggctggtgggaggaagtcccctgccctgcaccagctggaaggacccgaacgtgaatccctggatgtctgactcagtgaccatgggtagtgcacaccatggctctggtctcagcttcctcctcctgcctgccacacagcatcatgtggttccaagaagataatgagcacgaagacacatggtgagaatggacctggccgtccctgacctggctggggcgaccaccgatgtggaccagaaactgggcagcacccacctggtggctgccagctcttgggagggtgaagccagcatggcccagcaccaccccgaggacaccttccagaacataagcccccatggcaagccggctcctgcttgtgcagagcctgaggcagctgggctgaggcctgccctatcccattggacggggcaggggagtgacggcgggagctcagggcctgggaaccccagggctcttttttgtcctggtttgcagaagaggctggtgccacatgtgtagcaggtgcccactgcctgccccgcgtgcccccagtgcctagggctcctcctctctccattctcccctgctgggtggagtagagccaccctggataactcctgaggacaggggagtgtgtgcaaacccccaaccagaacacctgctgtgccagctccccgtgtccctaaaaagggcgtgacgctgggggactgtggagataggggaagctccaggctgggtgggttgaggcagcagccttggaggaacagtctcttctgtgggaacctgctgactggacaggggaaagcaggtaggtgacttgtcaccaacgacgccccagcttgcaggttcccctgagcagaggctgggatgggcactgtagctggcttccactcactgttctgagctggggtagccctggatgttcccgctgcaggacagccccggggaggcggaagggctgcaccacttctctgcagactcttctgccacctgctgcctctcctcctccctgtggctctcccagggattttgtgccttactctctgctttctccagggcctggccaaaggaggaggtgctggggattccatcagtaccctcccacctctcccagaggaggtaaaggcaggaaagtctctggacaggtgcagagaaccgacagctatgtcagcaattccccaggaagcttcccaggacctccccaggcggagcaggtagtgtggatgtccctacacaccccactgtggatgccaggcctagcagggaccgaggctccagggatttcagaaccacccaggctctgggggtgagtgataagtgaggggtgttggggttcagtggaccctttgtaggtcccagcactctttgggccctggggaggcacccctacccccaggcatctccaaaggcgccttcccagtatccctgctccctgactcgggggtttctggggcagcgcctgcagttcacctgttactcacagtgaaatcccagacttgaaaaaaggcgtgtgtaccaggacatgtgcctgccccatgccacctgggagaccctgcaagcgcttatggccacagtcacagacgcacttctgcccgccacctccatgacccctggactccccgccagggcgggggccgccaccccacccacttgcagtgcagtcgcccggccaagggtccaaggccgactgcgggccgctgcttaaagggccaggcccctctctcatcccttgccgcttgccccccaacatcgtgagcagcgcagctggagtgggggaagaggagcggcagggggaggtgggcttcacagcagtcctgggaccccagcacagcctgtcctgccactgtttctctcccgcttcccgcaaacctgccctgctgtggggaggacagaggcttggtcctcacattccggcctctactgtccctgcaaatggaccaaggagctgtgttgcctgtgccgcgggatcctggaacatcccttctcctgggtgaggggcagcacccctgccccccccaatatattctttcccactctccctggttcttcgcagagccagcccagagcaggggctgtgcccaccacagggtgggagggagcctgagggcagagcccgtgggcctgcctgggtgtcgccatgagcccactgtataccacggggcctgggactccttggcagctgcacttctggagaaaaggggacacagcctcaaccttgcagggcagatgtcagcacagaaaggcagttctgagggtggcatgaccaggccctgggagtgccctcctggcaaatcctagcacaggcccggcccctcccatgcccatactcatccacgcccacctgcacacccatgctgtcccacccaccagtgctgggtgagggccccagccccccaaaccgtcccactctggcctcgagggagacaggcccttccaggcttgggactttcctgggatctgcctgcaggtagggaggtgccactctgggacctttctcagcctccaagaagagtctcctgactcccattcctggctagggcagcaaactggcctttgggaggggtcctgttacacctggtgagctgtaaaaagccccaaactactctctccccgccccccaccagttcagtcctcaaactggacctaggggaacagggttggatcagagtgcgtcattctgtggcttctggttctgagagttcacacatatgcacacaaatcccaaatctcacccagacaagcacaggcgggtacatacacaaatatacctccatgtatatacatgcatatacacgtgcacacacgtacatgcacatatgcgcacacacaggcatgcatatgcccatacatgcacacatgtacatgcacacacatacatgcatgcacatgcacacacacacatacatgcacacacatgctcacgtacacactcgcagaggcagatgctggtcaccagacgcccagagccatgcacagacgcacagacaccctctgaccatggccacccagcagtgcagggtgctggtctcacccacagagaggtggggagggagcctggcctcaatgctcttgcccaggacactggaccaccctcaagcctcccaggtgccctttaggtcccaggacatgccatgtcgggaggtcggcctggccaaagcggctgccaccccttcatcccccacagtcgccctcaggctgggtgaaggtccctgcttccactggatgcagggccaagggcctggcttggctgcctactcctcaccccaccgtgcctgcaccccacagtcccccatatcctctgcttgcctggaacagcccctggtagcagaggccaggcagaaggagcctggacaaagaccccagacctggatgggggagggtgcacatccctgggacaggccagctccgtccggctctgggacctgggccgaccccaggaggtggattctacagacacgccctcagccacagcccaaggaaagaaagaaccctctgggaccacgagtgtgtgagtgtatatgagtgtgtatcagcgtgtgtaggggggcggcttccctgcctccagggcttggggccagttgcccaggctgcttttgggccacagggatccctgggggctgtctgctgggacccaggcagcagccttggtgccaggctgttgccaggcaacctgcactcagctgggctttcggaggtggggggacttcctcgggaccccacggctccaactgagtttccagaggatggggcctctgcctccggcttctgacaggagctccgggagtgggaggggctcccagcctgcatgccttgccctacacctctggagcccagctgtactgtgaggtttccttctgtgttgaggatagtcatattggtgggtcctgaagtgtgggcgtcctggggagaggatggtggggcctcaagaaccacagatgtatggagatccccccgtgcccagcggacacctccctgatgccccagccccagccccagccccactgctggcggagcaagtgcctcggggaggcgtgggtcatggactcaccagtgaggatggccacgctgtcgaagcagccgtccagcttgctcagcaggatggagaggaagctgtctgcggccagcacgctggcgtcccgcgtgctctggtcatagaccaccacgtcctgtggctccgtagcctccacctgggggccatggggcagagatcagcatgccgcctccacctatcgatgccctggccccgtcccagatatgctggctcaagggaatagtaagggcatcagatgatgggaggcaggcagctgtcaccttgctgcctggaggggagggcaggtgcagtcacacactctcctccatctgccagaggcccagatgcacacacccacaccacacagcaagccatgggggcagggaggggtggactcctgccctgcgcagctgtgcccccatgccatgcacatgggtgaaggggacggacgctctgggccaggcctgtgtggaggagacacaggtgagtgcgatgggagcccaggataggacctggctggctcccagggtggcggagggacagagaagctcggccctgaaacgcatgccttcgggtgtgggctctcagtggggctaactgtgtagccagcaattctgctccccaccctatcccctccccaacccccagcggagaaacagagggctgcagcaggaccccaggcccctgcaccaattccggaggcagcagctggaagctgggttcctcctgccctcctcccccaccccaagggccagcccagatgttgagcggcttttgctcagacagcaccggtgcccccgccctgcaagcacacactcagcccttaagccagctgagccgccaaccctgggctgggtgacgtcaccggcagccaatgggatcgcactctgccgggagtccttgctgggggtcattaatcaccagattccccttgttggaaaccaaagggagccgattctggccttggggtgggcggactcctggccagtggccatcccacttgagtcctcccatgtcccagctctgaacagggcctatcagtgacccagacccctctcaaagcctccagggccaagagcttgtcacccttgtcccctgcgaggcagtagaaggaggaggtgccgccaccttcacaggtcaacagccccgctggtccctccccagctgcacctgatggtcctgggcagaatgagctgtccttccccagaaggacattcctggggggccacagagagaattctgggtccctgaatactctgcgggctgggggaagctgtgggacggggacatggactgctcacgtgtgccttttgaccacccctcctgtcctcacagcagtggaagtggaccacacagctgtccctgtcccgtgtaggccagctgggctgctcccactgccatgtggtcacaccttgctattccactcactgctcccctctgtgagcctgggttggccctggccacacagtcctatctgcgtggggagggcccggcacctctgtgcagaagctgagcaaggaggccctggagggagggtagggaagggtgctgcgggcgggggtgcgggggatgccctgagcaggggcaacaggcagcggtgagaggcaagtgccagggaggactgctccacacgcccctggctgtgaccccaaggagtcgagtttggactggaaggcagaggaggggggtgctgcccgagctgagggccccttagctgtggaccctggacgtgatgcatgcctggtgggcagtgggctgggtacctggctgcgtgcagccggctggatgagctccgcaatggtcaccttgccctgctgcagccgccgcttcaccagcttggagcagcagatgttgacggagctgagcacatgccagctgttgtactccacgaaggagcggctgtcgatgaccagcggccccccaggcccgccccgcagcaggctggccagcttcttggcatccatcaccttcctcgggagccggtccccagccatggtggggcaatgggtgctggggagggtgacccctgaagtgaggaggggctgctccgacggcccaggtgtggcctcgcgctgggagtgacctagcacatggtgctggacctgcagggacagggggatggtcagcagtgctgcgggcccctgggtggcacccagaagctccccaggacagatcagagctgggagctgcgcccaccaggacacaccaacatgtgcccgtgggaacccttctccctctggagagaccccgtccaggtcacaaggccagctctcagcaggatgcaacaaggcagaggggggcaaatgggccccacagagaagggtctgagggctggaagaggccaggggtccttcctgtgggccctggggttcacggacccttaggcattccagaacattccatctcatccctgggacacaggcatctccctgctgtgacttctgcatcttttccaccacaggacccccagcaagtcggggtctggactgcacctcaccctcccacatggtcaagctctctgccctcctccgggcttgctgtcctcacacctgcccctctctccctagcacagccccagggagtccaatccctggagacttgactccagggcagctccgtaagccgataatccagcccctggtggatggtggccttggggctgcctccactggagagtgggctcccgggggcagccggatagcaggcgggtgcgggaggggctcaggcacagaggcacggctcctttgccactgctgccctcctgacctgcaggctgaggtttagtgtgcgccacgtgcctgctgggggtgagtgcccagctcctgcaggggcgtgttgcacccacacagtgcctctcccctagcggagcctggggtctaggaggctccttcatgggctgatagggcccaggatgggaggggcggggcagccctgggaggagggtcagtgtcggggaccccgcaggtgccaggccctcggcatggcctgcaaaggcctcagactgccgggtgggcaggtggagtagggatgtctgaggatggagtctccggaagcccctcctgcaggcttgatgacaagcctgtcactgccccactgccgggccccatctccctgtcacctgccaggactggccttcctctgggtccactttacactcacagcccctaggaggcgcatagtgttaaggatgatgagtttgctttaactatggggaaaccgaggcttggggcagggttgggacctgggtcacacctgggtcacacacagatgggcactgggtgtccctgcaatgccatcttccctgtgcccccacagctgccaggcagtcaggaagtttactccacccagctcaggactgagggaaggctgggagatagatgtaccctgggccctgcgccctgtgcaaagcgggctacggtgggtagcgggccctcagcaagccagacccccaacccacagccacaggaggcactggggggaggcgccctgaggacacccatgcactgcaaacagcaggctggggacagaggccaccaccgtttctggactctccaggtcagctcccaggccggcgggggccagtgagagagttcacagagcagcaggtgcaaggctggtgtggacctcgtccctggcccagccccaactccacactgaggggcaggtcccagctcctccctgcccaggagccccagcctcgcactcactctccttctccagacacttcaagcttggcccctgcctggcccctcccgcctcgactgggcccaggcttctgtgcattcccaccatccctcctgttgccagaggccagggaaacacctgactgtggatgggcagcctcagctgaccccacggctgacaccagggattgcagtggcacctggtcagcagggcctcaggatcccactcagataacgttcctgggctggtgctccagcctccaccacagggtggggaacgaggcctgggagtcctctccagggccagacccagcaagttcaacagcaaaagggcctgctgcctgcctgctgtggagggtctctgcctgccaagggggtccctgactacccacagggggtccttgatgagctgtttgtccttcccgagttctacctgagccttgcacaggtggtgagaggcgagggcccagatgtgtggttctggtgagacagcggctccaggtgccccgtaggatacccaagggtccagctcagagacccagaaccccgagaaggctgcagtggcagggacacttgggctgggggtcttttgaggagctgccccggcctcaatgtcctcatccgttaagtgggggtggattctctctcactgaaaacaacagaagcaaataccccccagtgcagggaggagggcaggtgtgaggagaggccctcgccctctctgcagccagggcctagccttcatgcagccctgagtcctgacactgccatgagagacctcggtgcagccagccagatctgagacccagagggaggggagggaggagggcaagtccagctgcagggtggtgggcaggggctggaggggcgggaggacgggtcctggcctttacctggccctgctctgcctcctaagcaacgctgagctggagctgggcctatcacccacaatagtattgttatttgcagccgaaggggattcattagcaagttagcacctccatcgtcaccatggcaacagcagaggtgccaggcaaccgctgctcctgcggcagccaccaccatggagcaggctcctctgcagagtgggcacgcgcccctccctgctctctcctacccaccccagcaggtgcccggcagtgcagagcccagtcctcagcccctccgctcctctgccctacctggtcctaaccttccttcccactccaggtacctgctgtgcccagcatgctccctgcagctcgccggctccccgccccctcagaggccttctctgtactgcgaagggctggccgagtgccccctcctgcaggaagcctctgtgccatgctggcctctgggagagcatcctcacccacagggtctccctggacctacagctcccagggggacatgttcctcacctctgtctccccagatgctaaggatcggggctcagctatgccagggatggggcaggttgggtggggtggggagcagagacactaaggacagtctggtgcagatcagtggggccagcactggccatgtgggaacagaggtaaggaaatgtggatggtgttggttccatgcctctcctttcacggccccacatgccaagccctcctgagtacctgtggccctgctattccagtgcctaggggttggggggtgagaggcagggctggggacaggatgccccctagcacagccccatacacccttttcaaaagtctttgagcccaggaggaagcagtttccaagtccaaagtcagaagaaggctcctcccaggcccacaccttccaggaggcaccaggccgccaccctcccctgggacacagcacgcctggctccagtgctgcgtgcacactgccctctgtgcgtgccagaacacacctctttgcacacccactccacacacagggctggtgctccttacccacaatccacctgccctgtgtgcaagtacccacgcgtgaatatgtgcacacgcgtgggctggacatacactagagtacacgcacgtccttgccctctgtatgcaggatcccctgagaaccccaggactccagtacccgaggggtcagcttcagactccttacaaacacgagctcccacacccagcgtctctgtgcagcacattcctgtccctgagcacagacgggaccagggagtcccaggccacccccagctctcaactgacagcatccttaccatgttaccttctgctcagcacctagaaatggggactcactaccttcagagacagctgccaggactgtcaagcatggggggatgggactgtgtctccccctcacacctaggcaggctcttggagctgtccggctcactgttacccagggatgcttctggaggcagaaatcgtcacactaaggaggctgaggagagactggtgggtggcaactctgggaggcagggaccctgcactcacacaggtcagctcatcttccctcactgggctcccccagatgccctcatccctgcctcccctcagctcccttggctagtgctgtaggacccaagctggcctacactctgctccgctggcctggggaagctgtggacctgggagaaagtggggtggggcggggggctccctccgatcccaggaacggggtccgggcagggcaggggatgggaggacttggcacaaggggccgtgacagtcgagtctcagagccggacatatccaggttccctcccttcccaccagacctgtgtccctcctcctggtcactgtgccacatgctaaacatcaggaccagtgtggcgcttccaaggttcactgccctgagcaactccggcagagggggcctcagcgggtgcagttctcatggccagagtccaaccacctctctctcactgtgggtctgcccctttccctgccttctgcaagaagtgacacctaggtctccccaggccctagctgatgccccttcgaggcacctgtccagtggcagcctctaggccctgacttcagccccagcctgagaagagaagggtcctggagcagagactgactctaagcgtctttctgcacctctgttaatgggactttattcccagaagcctccccgaggacagaggataccaggggaatagaacctgcccagccacactcgtgcagcccccggctggctgcagcaggaggtatttcagcgagacttcaggatgaacttccagctggggtcacatgatctgccatccgcatccagtgcttattagcagtgaatgcatgggactgtcctcctggtggagggctggggcctggggtgctacattcacccctggaccgccctaggtgcaacagtgtctctgggtgggctgtgccagaagggaggcaagggagagtgccggggtttggatctcccctcagaccccccgctggggcacaaaaggagcttccctggcctgcagcaccccacccccaccccaagctgcacagcaagagcactgcggagccacgctacatcctgccaccccctcctccatcccacagtgtccccgccccccatcactgcagcaccagagcccctattcccctcagcagaggccggtacaccccgcagcagggagacggaggcagattctcccagaaggggtgaccctgttggggctgggcctattgttgccccctcccctccaggccagactattaggtatccccacctggtctgctccgcatcccaggctgggcagctgggcctagcgaggtggctgcagcagcctggctgtgccagcccctcccccagcgccgcggctgcctctgcagcaggcggaagggcgcgggggctttatccctcaggggccggctgggcaccccgggatggggaggcagtgcggcctggacactggggggatggatctgcagccctcccccccgacaggggaaggccccttcccgggtgtcccaggccagaggccgtcgcgtccctcccacggccgaggctccacacctcccggaccgactccgggccagggtccgcctgctccggttctggcccccgcgggggtgacgttcgggacgtcgggggctcgcgcagatccgcgctggatctcaggcggccctggtgggtcctggatttttgtcccccccccattccacacccaaagaaggagctgcggggagaagggcggcaacgcggcgggcgggcgtgggctgggcccgggtccgccgggcgttgcggggggcggggaaggggcctccctgtccctggcgtcctggacggccgtggccgctcattccggggccgcctcctcctcccgggcgcccaccgggtgccgctgccccagcgcccccgacgcggcgccctccgccccccggcccgggccggtgaaccccatccccggcgcccgcccccgccccgccggcgcctccgctcacctcgctcgcgctcgcctcgggggcgctccggggacccgcgccgcgctcagggcgcccgctcggccgcgccgtccatgggcccggcgggggcccgcgcagccggggcaggggccgggggagcgcgcgggccgcgtcgccgtcgccgccgtcgccgccgccaacgccgcggggagcgctcgctcgggccggggcgcgcgcactgcgggcgggcacgcgcgctcgcggcgcgcatcccagccccgcggctcggcgggcgcggccgggaggttccggcgcggctcgggctcgggctcgggctcgggctcgggcgtccggcgtccggcggggcgtcgtggggggagccggctcggccgccgcgctcggccgcgagtgacaggcccggggcggagggcggggccgccggcggggatgaggtcatgccgagcgaaaaaagcccctgacgtcacctgcagccaatcagcgcgcgcggctcgggggcaggtgacgtcagcggagcccgggctcggggtgaagctgaggcggctgccgcggggggggggcggggtgcagggtgcgggtgggtcgcgccgccgccgccttccgccctcaccccgggaccggctcttaaagggaccacgcggcgtccgggaccccgcctccaggaagccctcccggccccgggccccgcgtcacccaggccccccgtcacccgggcccccggccgcgtcgcacagaccccggacggtccagctgagcggctccgggcgcgaagtcctccccccgacccggacaggcgccggcgccgctccccccttctcctggcctttgttggcgctgggccgccgccggggagccctccccagacccaggcgcggcgttttacctgcagcggctgtgctcgccccgccgcgacccccgcaggacggagccggatccccctgcactcgggcggacctgggaccctcagaggcgagccggctgcctcgggtcacacatccgcgaactccgggggcgggctccccaggacgccgccgaccccccacgacccccagccctcccgcttccgtggaaagccgccccgacgacccctgtgcgggctgttgaggggccgcaccccgccgaccgctgtgggaacacctccgcgcgtgcggcggggacgcggcgagtccggggcaggaagaacgcacgggtaattgcaccttcggcaggtgttgggcgggagcaagggggtcagactcgcgctgcagggggagggcgggggaggcctcgctgtcctggaggaaggggacaaagacccctgcccaggagcctgggagcctttgaaagtaatgattttttggcgggggggggttgtcacgagacaccctagacatttctaaaaggccccctccccgctgccgggtggagagggagcgtggggggatccgccttctgcccccgagcccccagccagcctgggccccccagggtcaccctggggctctgaagggggcttcggccgctggttgaatgaagggccacagaaaatgaagctggcgcaacgaccgcagaaccctcagtgggcaccaggaccacggagctcagggtgccaatggtgatggctgggggtggggagtactgtgggcagcaggggatgctgagcggggtttggggctccccctttccatactcagtcttcctgccagcctcagagctgagtacaccgttggcgattaataagcgcttgcagctcccttccctggccagcctgaggggagcggcagtggcccgtatggggtgggggtggcggtggagtgcgtcctggcgcagagctggcacacagcacaaacaaacgccttggcgggagtgggtctgtcccggaagggagcccaggggttattggggttggggctgcgccccaaagcgggagggccctgcgagaagggaggccctggctggagggggaccctgagactggaggtgccggacccggatgcggggccaggtgagtagggctgcctgctgcagccttgctgggtttgaaaagtgggggaggcttggccctgggagggggcaggaggattcaggctgagacccggagggggcgaaggaggtccttgaggaggcagtcacaggcctgaaaggacctgggacccgcaggcatgggagctgttagccgttagatagaggggctgtcgcctggggggaagcctcacctggcttgttccccctgccaggcctaggtgagcccgatgggcgtgtcttctgcccagctgggatgtggccagcatctgcctgtggcctgggagtgcccattgtcccctaagagctctggttataccctgggcagctactggccaggctggagcaggtggcaggcagcgacctttagtccctcctggaggctcccagggggcggtttggaggggaatacggctcccctggagggcctgggctgtccctggggggcagagtgccctgggcggcgattgttataatccccgtagccattttcatgcaaataagcactgagagcgttaggttctgcccctaaccaggctggcggactagggaggtggcaccctggggaggacggtggtttttctgcagccccgccttagttccacgttgcctttgcacccagcagaggccggcctgggcggtgggctcaggggcctgggtgcccgaccaggtcggctcggctcagctcagctcggcggccgcaccgcctcccggcacaggtgtggacgggggtgggaggcgcgaccagggagggggctgcggtgtcagtcccggcccgggcctgtagacgccgcctcgggggtctctggggctcgggaggaccttgcgaggggccggggaggcgccaaggccgcggcgagggacgtgcgggggtccagcagcctggggcggggacgcgcgctccgggccgtgcaggtgggggtccgagcggggccggcccggcggttcgcgcgcgccctctgccgtccgcaggccgtggcgcaggctcggccgcctgaagctcctctcgcctccgggaggacgtccaaggtcgtttcttaaagcatccctattgcgcagaaggaacagtggggttcacttttctcgctaatgtgcatataatcgttgcaactaattatgtgtagcaaacctccatgccactatttccccaacttttttaagtcaaggcatagctaactcaatacaatgcccatcccagctgttcaagtagactttttctcccgttatttctttaaaaaccgtatgattttttcttgtggtaaaatgcatgcaggaacatacggtgtgccatattaactatttttaagtgaatttggcagcattaagtacattcactttctgtgtaaccgtcaccaccacccatctctggagcttttcgtcttggaaaactggaactctactctgtcctcattagacaccaacttcccaaccccctccccagcccttggcacccattattcaagtagatttttttttttttttgacggagtctcattcttgtcgcccaggctggagtggagtggtacgatctcagctcactgcaacctccatctcctgggttcaagcgattctcctgcctcagcctcccaagtagctgggattacaggcggccactaccatgcccagctaattttgtgtgtttagtagagatggggtttcaccatgttggccaggatggtctcgaactcctgacctcaggtgatcctcccgtcttggcctcccaaagtgctgggattacaggcgtgagccactgcacccagccagtagatgggttttgacaactgtatatgtagttttatcaccatcaaaatgagacctagaaactttattatcccagaagttccctggtgccctgtcctcaccctctgacctgtcaccgtgagttactgctatctgttcgtacactttataaaaatggaaacaatggaaacaaacaatgagaggacttttgcccctggcatctttcactcaaggaaatacttttttttttttccagacagagtctctttgttcccccaggttggagtggagtggcgcgatctcagctcgctgcaacctccgactcccggtttcaagcgattcgccagcctcagcctcctgagtagctgggattacaggcgcccgccaccacgcccatctaaattttgtattttttagtagagattgggtttcaccacgttggccaggctcgtctcgaactcctgacctcaggtgatctgcccaccttggcctcccaaagtgctgggattacaggcgtgaaccaccttgcttggccttaaggaaatacttttgagattcgtccacattgctgctttcccacaacctgatgataacgtctgtgtggttctgtatttcatgggtgtatggcaagagtggaaccaattctttattttttacatattagattattttcatatttgggctataaaaaactgcagcaggccgggcacggtggctcatgcctgtaatcccagcactttgggaggccgaggcgggtggatcatgaggtcaggagatcgtgaccatcctggctaatgtgatgaaactctgtctctactaaaaatccaaaaaattagctgggcgtggtggcgggcgcctgtagtcccagctacttgggaagctgaggcaggagaattgcttgaacccgggaggcggaacttgcagtgagccgagatcgcaccactgcactccagcctgggtgacagagcgagactccatctcaaacaaaaaacaaaaaagaaaacaaacaaaaaaactgcagcagacagcatcctattgtatatgcttaaaaaaagagatatgggatccctctattttatccaggctggactgaactcttcctgggcccaagtgatcctcctgcttcaggcttcccgtagctgagattataggcacgtgccaccacacccaactcttacatgtttgtaacacacttctcagattatttttctttcttccctctctctctttctccatttccttcattccttccttctgtccttctgtccttcctgtcttccttttctttcttgacaggatctcactctgtcacccaggccagagggcactggtggaaatatagctcacagcagtctcaacctcctgagctcaagggatcctcccatcacagcctcctgagtagctggcactacaggcatgtgccagcatctccagctaattaaaaaaattttttttggccaggtgtggtggtgcgtgcctgtaatcctagctactcgggaggctgagacaccagaatcgcttgaacccaggatgcggagcttgcagtgagccaagatcgtggcactgtactccagcctgggcaacggaatgaaactccatctcagaaaaaaaaaattttttttgtagagatgaagtctcactatgttaccgaggctggtcgcaaattcctgggctcaagcaatcctcctctcttggccttcagccttccaaaatgctgggattacaggattattttctttcctagtttttttttttttttttttggatggcatctcgctctgttgcccaggctggagtacactggtgcgatctcagctcactgcaacctccacctcctgggttcaagcgattctcctgcctcagcctcctgagtagctgggattacaggcgcctgccatcatgccctgctaatttttgtagttttagtagagacagggtttcaccatgttggccaggctggtctcgaactcctgacctcaggtgatctgcccgcctcggtctcccaaagtgctgggatgacaggcgtgagccacagcgccccctgcccccaactcccatgtccccagatattgcaaagttgccctgagtggagaattctaataacttgccagcaggctagaagaactccatttaaaacccttgccagggctgggcatggtggctaacacctgtaatcccagcactttgggaggttgaggtgggcggatcacctgaggtcaggagcttgagaccagcgtggccaacatggtgaaaccccatctctactaaaaaatacaaaaattagccgggtgtggtggtgggcacctgtaatcccagctgcttaggaggctgaagcaggagaatcccttgaacccgggaggtggaggttgcggtgagctgtgattgtgccattgcactctagcttgggcaacaagggcaaaactctgtctcaaaataaaataaaataaaacccttgccaacacttgggattttatgcattttgattatagctgcattacttgatgggttgactaggaggacactggagtgtcttctcacacagactccatatttagtttgaagacgtccttctatattgccttataatcttccccagggaggccttacagtcttcccattgcgtatattactcctgagcttatgatttcggttgctttgtgaaaggttataaaaaccacaatttctgatgtgttgttgcctgtcatgggctggctgtcgatcaccctctctgacttctcttactcctccaagcaggccgcctgtaggttcacttggatttcccaggtagatggccctatcatctatgaatctgcactttcgtttctttccaaacctcacattgcttgtttcttgtcatattgcatgggctggcatcaccattataatgctaagtggacatggtgatggtgggagtcttagcttccattccccagaaagtagccagatgcaaagctcagtgtacacattttctggaagggaggaacacaccgagccagggaggaggtgaagctgaggcaaggctgcttcttactcagctgctgtggctttttggaagttgcagctcagctggccacgtctgcacaccctctcccacgagaccatacagcgatgctccacctcagaatggtccacagggaggaggaagggagaatagtttctctgcaagctccttcctgtcttctgctctcataggtcagagttgctctcccgaggaattaagttccctgcatcttcaggtggtgttactggcccctcttggcagctgctgggcaggccagagtgtctgagggtttggggaagctggcacattgtgtggagtgagagagaggttcattaaaattcccaattattcctatacattcccaattatagtcccaattgtatttgtggatttatctatttcttattttagttttgtcaatgtttgctttatatgttttaaagctcagttatttggcacatagaagtttaggattgttttctgtttggttgcatgaactctcctatcatcatgaaatgttatctcttctaataatggttttgtttcaaagtccacattgtctgatcttactatcattatactaggtttttgaaaacattaatgtttgcctaatatatctttttttttattcttttgctttctatcttcctggatcttgatatttagggtttgttttttctaaacaacatgcatcttatttaacttctctctgtttttttttctttccttttttttttgagacagagtctcactccgtcacccaggctggagtgcaatggtgcaatctcgagtcactgcagcctctgcctcccagattcaagcgattcttgtgcctcagcctcccaagtagctggaattataggcacgggccaccacacctggctaattttttgtacttttagtagagacgaggtttcaccatgttggccaggctggtctcaaactcctgacctcaagtgatcagcctgccttggcctcccaaagagctgggattacaggcatgagccaccgtacctggcctaatttctgtcttctgttagcttccgggttatgtattcattatcctttaatggctaccttagagatggttatatttatttatttatttttttgagatggggtctcactctgttatccaagctggagtgcagtggcataatcatggctcactgcagacttgacctcccaggctcaggtgattctcccacctcagcctcctgagtagctaggactataggcacctgccaacacacccggctaatttgtgtatttttggtagagatggagttttgccatgttgcccaggctggttttgaattcctggtcttgagcaatccatctgccttggcttcccgaagtgctgggactacaggcgtgagcttctgcacccatccagagattatgataacatattatcagttaataatctcgtgtcttcataaacaaggcaagaaccttacaactatttaattctgtttatccctctcctgacttctgtgctgttgtcatatattttacttccacaaagtttaaaaattttataggacattgaatattgttttatttatttatttagagacggagtcttgctctgttgcccaggctggagtgcaatggtgcaatcttggctcactacaacctctgcctcccaggttcaagcaattctcttgtctcagcctccgaagtagctgggattacaggtgcccaccaccatgcccagctacttttttttttgttttttttttgagatagagtcttgctcttgttgcccaggctggagtgcagtggtgcgatctcggcgcactgcaacctccacatcccgggttcaagcgattctcctgcttcaccctcctgagtagctgggactacaggcgcatgccactacacccggctaatattttgtatttttagttgagacaggattttaccatgttggccaggctggtctcgatttcctgacctgtgatctgcctgcctcggcctcccaaagtgctgagattacaggcgtgagccactgtgcccagcccttggctactttttatatttttagtacagacagggtttcatcatgtcggccagtctggtcttgaactcctgaccttgtgatacactcacctcggcctcgcaaagtgctgggattacaggcgtgagccaccgtgcctggcccttggctactttttatatttttagtagagatggggtttcaccatgttggccagtctggtctcgaactcctgacctcaggtgatccgccctcctcggcctcccaaagcactgggattacaagcgtgagccactgtgcctggcccaatcatagttattttaaagcccttgtttcctaactccaatatgtggcttatctgtaatctgcttcttctgttagctttccgcatgattattgatcactgtttcctgctgtgtcctgtatctcgtgctttctgtcagaggtatgcctcaaaggaccgtgggggtccatatctagggaccgtggggggtccatatgtcgggaccgtgggggtgtctatatctcgggaccgtgggggtccatatctaaggaccgtgggggtccatatcttgggaccatggggggtctatatgtcaggaccgtgggggtctatatctaaggaccgtggggttctgtatctcaggaccgtgggggtccatatctagggaccgtgggggtccatatctagggaccgtggggggtccatatgtcgggaccgtgggggtgtctatatctcgggaccgtgggggtccatatctaaggactgtgggggtccatatcttgggaccatggggggtctatatgtcaggaccgtgggggtctatatctaaggaccgtggggttctgtatctcaggaccgtgggggtctgtatctagggaccgtggggatctgtatctagggaccgtgcggatctgtatctagggactgtgggagtctatatctaaggaccgtggggtctatatctagggaccgtgggggtccatatctcaggaccgtggggatctgtatctcaggaccgtgggggtctgtatctcgggaccgtgggagtctatatctagggactgtgggagtctatatctaaggaccgtggcgtccatatctagggaccatgggggtccatatgtcgggaccgtggggggtctatatctcgggaccgtgggggtccatatctaaggaccatatgtcgggaccgtggggttctgtatctcaggaccgtgggggtctgtatctagggaccgtagggatctgtgtctagggaccgtgggggtctatatctagggactgtgggagtctatatctaaggactgtggcggtctgtatctcgggaccgtgggggtctatatctcaggaccgtggggctccatatctcaggaccatgggggtctgtatctaaggaccgtggaggtctatatctcgggaccgtgggggtctccatctaaggactgtgggggtctagctgctctcttccaacagtgagcacgtggcctccctctctagtgcagacagggagaggagctgaacatttcgtctacccgctcagttagggattgggccacttcagtcaatcgtccctctgtgtggctttcctggagttttggttaagagcctggccagtccgtgtcttcttatccctgacaggctgtcagagagtcacttctttccctgaggtacaggcttagctctttagttgtctgctcaggcagcttcaaaatttggaaaatgtcttaagggccagattaacctgtgcctggggcaggaccccttcctctagaaaagctctgtgtactaagctccacaaggctatgcgagacttcagcgcacctgcggaggcctcaggcctcacttcttagcctccccagaaatttgcaaatgtcccagttttctgctccagcccctgtggttgccaagagccctgctgggtatttctcccagtagaattcctcttccccagtgggaccgaggctcagctcatacccagcactggttaattccttaaagggagagaagccgacattcagctcatcttggaagggctctctctgaatgttttcatctggttcttgttgcttctacagttctccaatgtcttttttatagatacatttttccggtatttcaaaattgtgggccggatgcagtggctgacgcctataatcccagcactttgggagggtgaggcaggtagatcacttgaggtcaggagtttgagaccagcctggccaacatggtgaaaccccatctctactaaaaatacaaacaaaacaaaattagctgggcatggtggctcatgcctgtagtcccagaaactcaggaggctgaggcaggagaatagcttgaacccaggaggcagaggttgcagtgagtggagatcacactactgcactccagcctgggcaacagagtgagactccatctcagaaaaaaaaaattgtggtaagatacatacggtaggatttcctgaagttatttatttatttatttatttatttatttatttatttattttaccatctgagttctgtaattaatgtggccttctctggttgctgcaatgggattgctgaccttccatatacatcccctctggaatgtcatatttgcattcttctggctttttttgtttgttttttgttttttttgagacggaatcttgctctgtagcccaggctggagtgcagtggcgcgatctcggctcactgcagcctccgcctcccgggttcacaccattctcctgcctcagtctcctgagtagctgggactacaggcgcctgccaccatgcccggctaaatttttgtatttttagtagagaggggggtttcaccgtgttagccaggatggtctcaatctcctgacctggtgatccgcccccctcggcctcccaaagtgctgggattacaggcatgagccaccgcacctggccgccggcatctttaattcagactgccagcttccagaaccctgagaaatacacttctgttgtacatgccagtccatggtgttctgttacatcagcccaaagagaataagaccgcgtggtaacaggccatgatgaccccctagtgattgcttttgcctgatcaaggcaaggcacccccgccctgagccagatgctgagagggtgtggtagaggctgcacggcaaggggctgagccaggtggctgctggtgctcctgcctctgaccgccaccatgtatccaggatccctgctggccagggcgcccacctgcctgctccggtttggttcagggccggtgtgtgtgtgtgtgtgtgtgtgtgtgtgtgtgtgtgtggttcccaggggacccagtgtagccacagatgccccccacctgcctcgagagggaaataaacataaatataccaagacagctatggggtgctggggtgagcggtttattggatgtttaaaggacagagatctgaactcctagtgactgcagagtgagcaagcaccctgggctgtcctgcagggctgtccgtgctggatgtggtgccagcaggcagggcttgcggataggcatttgctgcaggtggctggggcggtggggggctggtctccagatgcctggaagggaggccttgaaagtcattcttcttggatgcatgggcccatggcatttcttggtagaaggtcaaagagaagtgttcatgcttggcaaggcaggagggtgggagatagggtagtgggtggggaaggagagtctggctcactgggtgccaggaaaaggaggtaaaggctgggcaggaatgcctggccatggtaagagtcctgcaaagccagaaatcagatcttgcactggcagcacacggggacacagcaactggactgggagcagcagggcttgcagcagctggattggcaacaggatgacccacagcctgaggaacagcagcagggcttacagcaactgcactgggagcaggatgacccgcagcctcccttagaccccgcgcaagagccacaactggaacaggaacagcaacacacgggcacaccgcagccggagccacagcccccacagccggagccacaaccccccttggatcccccacaagaaccgcagccccccttgcagcctccacaggagccacagccccccttggagcccccacaagaaccacaggcccccttggagcacccacaggagccacagccccctttgccacagctggagcaggaacaagctggcacacagcagcacatgggcttgcagcagcagacaggcacacagcagctggagccacatcccccacagccggaaccacagccacccttggatcccccacaagagccacagccccccttggagcccccacaggagccacaaccccccttggatcccccacaagagccacagccccccttgcagcctccacaggagccacagccccccttggagcccccagaagagccacagccccctttgccacagctggagcaggaacaggttggcacacggcagcacacgggcttgcagcagcagacgggcacacagcagctggagccagaacctccacagccagagccacagcccccacagccggagccacagcccccacagccggagccacagcccccacagctggagccacagcctccggagcagccgcaacagcccatggttctggtggattgagggtggagcaggtagaggagcaggtgagagggaggtgcaggtgtggagctccctgagcctggaccctttatatccctgcccagggtcatgtgtgaggctgggcacacatttcctggttcctgtttgtgccatttttagggcccctttttcttgtttcctctagaaatccgccccttggtgtatgggctgctcagtgggctgctgctctcttgctgaatctgtgtccagacttaatggaggcccccaagggtctagcctctccctgttgactccagagtcacactggatttacaaaagcatctattttaggctgggcatggtggctcacacctgtaatctcagcactttgggaggcctaggcaggtggatcacttgaggtgaggggttggagaccagcctggccaaaatggtgaaatctcgtgtctactaaaaacacaaaaattaactgggtgtggtggctcacatctgtaatcccagcactttgggaggccgaggcaggtggatcatttgaggtcaggagttggagaccagcctgcccaacatggcaaaaccccatctctactaaaaatacaaaaattagccaggcatggtggtgcatgcttgtaactccagctacttgggaggctgaggcaggagaatggcttgaacccagaggtgaaggttgcagtgagcagagatcacaccactgcactctagtgtgggcaacagagcgggactctgtctcaaaaaaaaaaaaaaagtgatctattttagttgaacgatggtataaagagtaatatatttaaaaaatgtaaaaaaaaaccctactcaacttgggaaaaaatggcataaataaatgaagtctctgttcctccatctctccatattgtttctgtcccaccctaataatttcttgaatttggaattcaccactctcatgaaggtcctcacactcctacttaatatgtatgttcctttaaaaatgttttgtggccaggcgcggtggctcacacctgtaatttcagcactttgggaggctgaggtgggcggatcatttgagtccaggagtttgagaccagcctcactaacatggtgaaacctcgtctttactaaaaatacaaaaattaaccaggtatggtggcatgtgcctgtaatcccagctattcgggaggctgaggcaggagaatcgcttgaacctgggaggcagtggttgcagtgagctgaaatcacgccattgcactccagcctgggcaacagagtgagactctatctcaaaaaaaaaaaaaaaaaaagaaaagaaaaaagaaaaaaaaattttacatgctgaaaactttatgtaatgggtattacactgtatttctctttctgtaaattgcttttgaaaaaaataggtgttaggctaaagagattttctctagggatacatatggttttaatttatttgttttctctgatttctaaatatacattgacttatccatttacttgttgatggaccttttgtttcctttttgttgctatttcaagcaagctgcaactttcttgcccaaaacccctcctgcaggtgtgggtgcctgaaagtcaggaggttcttgttaccaagctgtcttcccaagggatccccccagccagctgctgtccaaccagcattgccagagagctcctgtttcctggcacccccaccaaaacttgcaactgtcaacttacacccttcatgtgggtgtgtaacacagtgttacacactgtggtttaatattccctcttcctggttactagccatgctgtgcctctttccatatggtcacctgtcattagagtctcgttaatttcacgtccttggcccactttacaaaattgagatagttattattattaatttttgagatggagagtcttgctctgtctcccaggctgtagcgcaatggtgcgatttcggctcactgcaacctccgctttccatgctcgagcaattctcctgcctcagcctcccgagtatctgggattacgggcatgtgctaccacacctggctaatttttgtatttttagtagagtcaaggtttcaccatgttggtcaggctggtcttgaactcctgacctcaagtgatccacccacctcggcctcccagagtgctgggattacaggtgtgagccaccacacctggccaagatcattattatttttattggtgtctgaagttctttgaattttctggattcttttattttgagatggagtcttgctctgttgccaggctggagtgcagtggcatggtctcggctcactgcagcctctgactccctggtttgagcaattctcctgcttcagtctcccctgggattacaggcacgtgccaccacacccagctaatttttgtatttttagtagagacagggtttcaccgtgttggccaggctggtctcctgacctcatgatccacctgcctcagcctcccaaagtgctgggattacaggcgagagccacagcgcccagccttttgtttcttcttcttcttcttcttcttttttttttttttttttttgagacagagtctcgctctgttgcgcaggctggagtgcagtggtgtgatctcggctcactgcaacctctgcctccgagttcaagcaattctcctgcctcatcctcctgtgtttcttcttaacatagatgtcatttattctaagtttttcaaatttattgggatgtacttttcatagttgcctctgtttttgaagatgggatcttgctatgttgtccaggctggggtgcagtggccgttcacaggcaccatcatagctcactgcagtctcgaactcacgcctggcctcaagtggtcctcagcctctgaagtagctgggactactacagactaccacatttgactactacaaatccctaccgtgtgccaccacgcctggcttagtagcctgttatttttaatagctgctaaatttgtcattatttgctttcttttctttcttttttttttatggcagggtctcactctgtcacccaggctggagtacagtggtgtgatctcggctcaccacaacctctgcctcccgggttcaagtaattctcctgccttagcctcccgagtagctgggattataggcacctgctatcatgcctggctaatttttgtatttttagtagagatagggttttgccatgttggccagcctggtctcgaactcctggcttcaggtgatccacctgccttggcctcccacggtgctgggattacaggcgtgagccaccgtgcccagcctatttgccgtttttcatccctgcttcaggttatacatgctctttctcctgcccgaccctttttttcctcattggttttgctaaatattgttgattttctttgtcttttgaaagaccagcttttgattttgttgattctgtttgttgtatgtgttaaacatttttatttagttctgctcatatctttattttctccattgttctttttgcactttctaaacatgcgggtgctggggtgcgtgactgtctgctggacgtggactgtcaggccaggaggcgtgcgatagagagtcactgccatctgggctttctatctgtccctccttccttccctccctccctccctcccttttctgcagtcattttcattcagcttctttcagcctttctgcaagcttctgggtgaggtaactactgtggggctgctttaaaagctcccatattttggggtctctgttctttacccgatgagctaagcctgtggggtttgctgtgatttctgacatacgtgggctgcttcccaccaccctttgcatttcaccatcctgtggtagtgcttccttcccctcttcttttagatggagtttttaaggttctgtttttgtttttattttgttttgctttgactgacttagaagttatatacactattcctgtttttagcagcaaccttatgcatttcatgtgtatttttaaacaaatgttgtctacacgtgatggccctctattcctcccctgctgagagttgtgcagggagctggggacagcttcttcccctgcccagcccctccggtgtcagctgtgggagtttctccagcgtcttagctcctctcacattgctcatcattgtttatttatagtcagtatttgcttaaacttgccacacatccaccaacaactctaggcgtggttcttgcttacaccatacttcttccttccgggctcagcttccttcttcctgaaaacatcctccggaagttccctcacaagcattcatcagtagacagtctgcatttttacatggaggtggcttgtttcctgctcctcctgagcattcatcagtagacagcctgcattttcacatggaggtggcttgtttcctgctcctcccgagcattcatcagtagacagcctgcattttcacatggaggtggcttgtttcctgctcctcccgagcattcatcagtagacagcctgcattttcacatggaggtggcttgtttcctgctcctcccgagcattcatcagtagacagcctgcattttcacatggaggtggcttgtttcctgctcctcccgagcattcatcagtagacagcctgcattttcacatggaggtggcttgtttcctgctcctgggctcaagccatcctttctcctcagcctccccagcagctgggatgacaaaggcacaccatcacactcagctaattttaatttctgtgtagagatggggtctctctaagttgcccaagctggtctagagttccttggctcaagcaaccctcccaccttggcctcccaaagtgctgggattacagacgtgagccactatgcctggcctgccctcacttttgaataatgctttggttggcacaaaattcctcagtgcttgaaaggtgtcactggcggctgtttcgtctgttgctgctgtcactttctctgcccctccgctggagtccccagccttctgagtctgctgtggaagctggagtctctggccttctgtgtccgctgtgaaagctggagtcctggtcttccgtgtctactgtggaagctggagctgcctggccttctgtgtctgctgtgcaggctggagtccctggccttccatgtctgctgtggaagctggcttgcacatttggttctcccacctgcttcatgccatgtccttcctggaccgagggttccagtttcaaccttgggagactctccctgtctcacctctcccgagtctctctcatctctagttggacaaatgtcaaatctactacatgtccccatatgtctttttttttttttttttttttaagacagagccctgttctgttgcctaggctggagtgcagtggcaagatcttggttcactgcaacctccaactcccggagtcaagtgattcttctacctcaacctcccaagtagctgggattacaggcgcctgtcaccatgcccagctattttattttattttattttttgtatttttagtagagaaggggtttcaccatgctggccaggctggtctcaaactcctgacctcatgatccgcctgccttggctgcccaaagtgctgggattacaggcgtgaaccactgcgcctggcccccatgtgtcttttttaaaaaaagaaaaccgttttattgagataaatgtgcatatacagtttgtctatttaaaagtccacaatctggccaggcgtggtggctcacacctgtaatccctgcactttgggtggctaaggtgggtggatcacctgaggccaggagttcaagaccagcctggccaacatgatgaaactctgtctctactaaaaatacaaaaattagctgggtgtggtggtgcatgcctgtaatcccagctacttgggaggctgaggcaggagaatggcttgaacccaggagcggaggttgcagtgagctgagatcttgccactacactccaacttgggcaacagagtgagactccatctcaaaaaaataaataaataaaagaagaccgtcataagtggagaaatatatcatgttcatgggtggaaagtcttaacattataaaaagttcagtttcttatattcatacattcaatggattttattcaattaaaattccagaaggatttaattctgaaaattattccatagatctaaaatttatgtgcaaacttgtgaataactgagacactcctgaataatattcagaaggggtagtctctgcctgatattaaggcataataaagtcttcgttgttaaaacagtttgctactagcacatgaatggataaatagttagaagtacagaacaggaacccagaaaagacccatctattgcagagctttaattttttttttttttttttttgagatagagtttcactcttattgcccaggctggagtgcaatggcacgatcttggctcaccacaacctccacctcccgggtacaagcaattctcctgctttagcctcccgagtagctgggattacaggcatgcaccaccacactggctaattttgtattttagtagagacggggtgtctccgtgttggtcaagctggtctcgaactcctgacctcaggtggtccacctgcctcagcctcccaaagtgctgggattacaggcgtgagccaccgtgcccagccagaggagctttaatctttaacaaattgaatggggaagatggctcactctatgcagagaattaaaattagatgcctacctcacaccctctataatccacatggattgaagacctaaaaggatatgtaaaagtgaaaggaaaatataaaaagagtggaagataatataggagattgtgtttattatcttggggtcaggaaatgaattcttaaatatgatccccagaacataaacagtaattaggaaaatgctgtatttaaccacatcaaaattactgatatatgtctggatatcaccccacaaaaaaaccattaaaagatgattggggccaagtgtggtgggtcacccctgtaatcccagcactttgggaggccgaggtgggcagatcacctgatgtcaggcgttcgagaccagcctgaccaacgtggtaaaaccccatctatactaaaaatacaaaattagccaggtgtggtagtgcatgcctgtaatcccagctactcgggatgctgaggcaggagaattgcttaaacctgggaggtggaggttgcagtgagccgagattgcaccattgcactcccgcctgggcagcaaggtgaaactccgtctcaaaaaaaaagaagattgatcaactgggagaagatatttgccatttgccatatttataacccctagaagctaatgtctagacaggaaccctgaaaatcaacagaagagggcaggagacctagtggagaagtgggcaaagcataggaatagaccacccacagatggctagtgaggacgcgaaaagaccttcaaccttatttttaatcagagttaagcaatgaaaacaaaacgcccctggtttttgaagagaatggaaacacctgcagtcttactgatatgttacatttagcgcgtggtatttagtgagaggcgtgagcagctatgtgcttacctgcagcatacagcgggagtcgttacgtgacttctgcctttcaagcacatacagtgtaatgggatccatccatcacacaaatatactagctctgtacacagccttgaggaggagcaatatttttggttgttataaactgcattttttttttttggtatggccttttgattctgggaagcacattcattctatggctattgcctttttagatcatgaaagcatcattccatattgatgaagaagatgtagatatggcactgatcaacacctcagtcgccttccttccaaaacagatacttctcaagaaatctggggccgggtgtagtggctcacgcctgtaattccagcactttgggaggccaaggtgggcagatcacaaggtcaggagatggagaccatcctggttaacacagtgaaaacccatctctactaaaaatacaaaaaattatccgggcgtggtggcgggtgcctgtagtcccagctactcaggaggctgaggcaggagaatggcgtgaactcaggaggcagagcttgcagtgagctgagatcgtgccactgcactccaacctgggcgacagaatgagactgtatctcaaaaaaaaaaggaaaagaaatctgttctcccaggctccccatttcagcatcccactcattgatcattgaaaactcattcactaggttcaccactcctgggtgttatgctgagcaatgaggatattcatcatggtggattatatggcagcaaagagctcaaaaaagggtgatggatgtgggaaatggggggcaggaatctagtggaacacacttcagtggccagaaataatgcattgtattttcatgtagcaatacatgccaaaagcaccagatttgcttaaaacgcaagaaacagaacagaatttataaccatcatgaatttaaataacatacacaaggctggacacagtggctcacgtctgtaatcccagcactttgggagggccaggcaggtggattacttgagtccaggagttcgagaccagcctgggcaacgtggtgaaaccctatctctacaaaaaatacaaaaattagccaggtgtggaggtgcgactgtagtcccagctacttgggaggctgaggcaggaggatcgtttgagcccgggatgtggaggttgcagtgagctgagattgcaccgttgcactctatctccagcttgggtgacagagcaagacctgtctcaaaaacaaaaccaaaaccaaatacatacacattgaaaaatgctacatatttgtcatgattatatgcaaatgtttgtaaataacttatggaagatgaattggaaagatacctgcaaggatggatgcctatgggtggagaggatgatgggacttgggataatgaaggagaaaaaagttaaataaaaacaatgtctatataggattcattagctgaggattgtgatctataaaattctcagcacatatatgatgcatgcatatatatatatatgtatatatatattttttgagatggagtctcactctggttgcccaggctggagtgcagtggcgtgatcttggctcactgcaacctctgcctcctgggttcaagcgattcttctccctcagcctcctgagtagctgggattacaggcgtgccccaccatgcccagctattttttttgttagttttagtagagattgggtttcaccacgttggtcaggctggtctcaaacttccgacctcaggtgatctgtgcgcctcagactcccaaagtgctgggattacaggtgtgagccactgcacccagccaggcctttgtttttattttgcctactattagtatagcttgctttgcatgttatgtctttttctacccccccttctttttttttttttacatttttgaatccttatgttttagatgcaacttttgactttacatctagttatacattttttaagaaaacttgtctagcaatctttatatgtaaactagagcattttgtccatttacttgtgaaataattactgaaatatttgggtttaaaacctatgttcttagtctgaattttctattgcatcacctgatctatatttctttttctcttctgttctttttgattagtgcttttttattctagttttttatgtaattgtttgactgtcatacatgactttggttaggagtcttggatcttctttgcttcttttcaatttttgtcattgtctcttgaatcctttttagttcttcatttctttttggtttttaaaatttattgtacttttttactcatacgtttgtcccactttagactttatttctagagtgatttcttttaactctaattttctcttaagtgatgtcccctcatttagcaattcttctatttatgacttttgttgttcatttatgtctctttttttgagatggggtttcactctgttgcccaggctggagtgcagtggcaggatcatagctcactgcagcctcaacctcctaggctcaagcaatcctcccgcctcaacttccctagcagctgggattaaagacacacaccaccatacccacttagtttttaaaatgttttgtagaggtgggggtctcactatgttgcccaggctggttttgaactcctggcctcaagtgatcctcctgcctcacctcccaaagtgctgggattacaggtgtgagccaccgcgcccggccttatttatgtctggtatcatttcctttcattgttcattagctcctttggaaacagtaggctaccactgtgatctgtttcacggcaggcttcctagctttcttccattgcctctagggacttaccgagggcccttgcacccactcaccactagagggaggaaaaccttccccatttcaggagccaaatccaaaattcatgctgcgcttttccagcacacacctgttggctcttttgaggttcccctgttttcgtctctgttagatgtttcttcgctttctcctgcacagacactgaaaccctgggggactgtggctcttggaaatttatccccaccttcttgtacttttaggttcacctgctttttcttaagacaccatctcactttatattgcccaggctggagttcagtggtgcgatcacagctcactgcagcctcagactcctaggctcaagccatcctcctgcctcagtctcccaagtagctggggctgcaggtttgcgctaccatgcctggcttacctggttttgttataagtctccagcatgcatttttggttttgttaccgagttgctcggtgtcctgtgggctgtgggaatgtacagggcccaaatgtaatgaactctgcgttcatgtctgctgccaccttctggagtttcccagtttggatttttgagtaaactgtcttaagcagcatttccttttaacgtcgtgaaactaacgatagccatgtcccctagcaagatgcacctttgacacacttttattccctctcctaaaagtggctgaattaatctaagcctttatttctagattatttcatttttccttacattgcatctcttttctctcagaaatttgtcctggaaattcccactctgctcttccctggcattatcagcagtcgcttagatctgtgggtgttctgtgggagctcatttctcaccagcgctccctgtgtgctctcttccctccaccttttccctccaggttcgcttgtctggagatcatcctcagatcactctcgtcccctcctccccagtgcgtgatttctaaagccttgcctgtgacactggtcagagaacaggctcagcgtggtggcacgtcaccatgaaacagatggacttggctcagggtccccaaatgtgtcatttcccaggaactcccctttcctgccgggagactgagctccgaggacaccttgggccattctgtaacttcctggttacctttagttatggaaagccgttgacctcatgattgtaaaaggctaattgagtgtttgaatcagaccgcgctggagctcagcggtgcttcactcctccctcctccgaccttgccctgcctggggtccttccgaggccccagaggagagcgggaagctggaagccatgggtcttgtgcaaggccctgcttggctggtcgtcaggactcagggcccgcctgcccctctgcgcctctagggcgggcattgaatgccgaatcctccccgggctgagccctcttctcctgcaagcagagactgtgaagatatttgaggccgagaggaggacagaagggaatggcaggcttttttgtgaatgtaccaggcctgctggcaggcgtttcccagcttagctgacagatcagaacacagaatcggtcaccgcacaggaaaggggttggacagaattgcaccaagtatacagttgatttacagacatgagaggctttattgcaaggaaattcattcattattttgttatttttttttaaacagatggagacaacaggaaggaaagagaccttcctggtcacacttgggccacaggagaacaggcagcggcccaggaggatccagggtcctgatggtggttgagaagctggttcttagtgatcactcagaaacgtcggcctggccttgtggggtcagaccttgcatctcagtcagcccagggagaagaagaagatggtccacacccaagtgcagggaacatcgtggcagtcggctgggtgcctgcgtccaggcgaggacacctcccgcatcagggaaacacacgtttctggagtgaggaggctgaaggcagggcccagaggagagctgagccatggaaggaggtgtgtgcatggatggtgagctagagcaggtgcaggtgcctcagggaggatgtgtgggacgaactgactcagggaaccataagaaatgctttcaccaaacaggagaaacctgaaggtctgggtccagagcctcagatcttacactggcagcacacagggacacaacagttggactggcagcaacagggcttgcagcagctggactggcagcacacggggacacagcagctggactggcagcagcagggcttgcagcagctggactggcagcaggatgatccacagcctgaggagcagcaacagggcttacaacagctggactgggagcagccacaagaaccacagccccccttggaacccccacaggagccacagccccccttggagcccccacaggagccacagccccccttggagcccccacaggagccacagctggtgcaggaacaggctggcacccaggagcacacgggcttgcagcagcagacaggcacataacatctggagccacatcccccacagctggagctgcagcccccacagccagagccacagcccccacggccggagccacagcccccacagccagagccacaacccccacagctggagccacagcccccacagccggagccacagcctctggagcagccacagcagcccatggttctggtggattgagggtggagcaggtagaggagcaggtgagagggaggtgcaggtgtggagctccctgagcctgggctctttatatacctgtccagatgtcaggcatgacacagggtccctttcttgtgactgtttacactatttttccagagctctatttttttcctctttgctagtgacttccttctggctcagttgagcatctactttctttgttttctaaatttgtctttttccccatttgttttggcccctacaattaaaacctcagctccaggctgtctggttcttcctgcaaagctccagggtgctggtcacctgctctctgctgaccacatgtgaccaatgggcaacagcctctgcccacgtgctctcatctttcctgtgttgactccctcaataatattaattttacatttttagatttcaaaattatccacgatctttatactcatgccagtctcagctttccgggtgtgttagaccattctttgcattgctctaaagaaatacttgaggctgggtaatttataaaggaaagaggttagaatggctcatggttctgcaggctgcacaagcatggcacccacctctgctcagcttctggggaggccctcagggagttttcctcacggtggaaggcgaagcaggaacaggcacaccacatggtgagagtgggagcaaggggtgaggaggagccacacacttgtgaacaaccagatctgagtgaacacactcatcgccaagggggtggcactaagtcactcatgagggatccacccccatgacccagacacctccctgcaggcccctccttcaacactggccaacaactatatgaaaaaatgctccacatcactaactattcggggaatgtaaatcgaaaccaccacgagataccatctcatatcagtcagaatggcttttgataaaaagtaaaaaacaaaacaaaacaaaaaaacctaaaatcagatgctggcaaagcttgagagagaagggaacacttgtacactgtcggtgggaatgtaaatgaattcagccaccacggagagcagtttggagatttctcaaagagctaagaattgaactactatttgacccagcaatctcatgattgggtatatacccaaaggaaaataaatcaatctaccaaaaagacacatgcatccatatgttaattgcagtgctattcacaaaagcaaagatgtggaatcaacccaggtgcccatcaatggtggattggataaagaaaatgtggtacatatacaccatggaatactacacagctgcaaaaaagaacgaagtcatatcttttgcagcagtatggatgaagctggaggccgttatcctaagggaactaatgcagaagcagaaaaccaaataccacatattctcacttataagtgagagctaaactttgagtccacatggacataaagatgaaaaccatagacactggggaacaagaggagggaggaagggagggagggggcaaaggctgaatactggggaacaagaggagagagcaagggggcaaggactgaaaaactactgggtaccacagtcactattttggtgatggattcattcatactccaaacctcagcatcacacaatatacccatgtgaaaaacctgcacatgtactgcctgattctaaaataaaagttgaagaaaaagttctttatatactctagatactagatgcttatcagatatctgatttgtaaatcttttcttcctttattatgtagactgttctttcactttgttgatagcgtcctttggtgcaaaaatatttaacttttgatggcatccaatgtatttgtatttctcttttgttgctggtgcttttggtgtcctatctatgaatccacaccgaatccaaggtcatgttttcttttaatagttttatagatttgactcttaaatgtaggccttttgacccattttaaattaattagtgtatgtggtgtgaagtaggggtccagctcattcctgtgcatgtggatgtctagtttcccagcatcatttgttgaagtactgctcttcctccattgaatgatctggcaccctgtcaaaaatcagttggtcatctacatgagggtttatttctggctctcaattctattccactggtttatacatttattctaacaacagtgctaaactgccctgatgactgcagctttgtagtaagttttcaaattggcaagtgtgagccctccaacattgttcttctttttaaccttgttttagctattccgggtcccttgagattccacatgaactttaaaatcagcctgtgaatttctacaaagaagccagctgctttcctgatagagattgcatagactctgtagatcaattttgggggtattgccatctgaaaaatgttaagtctcctgatacatgaacatcagtctgcttttgggctgccataacaaaataccacggatttggtggcccaacaacaggcatttattttctcacaattcagaagtccaagatcgggtgcaagcaacttttgtttctggtgagggctctctcctttggttgcagatggccgctttcccactctttgctcacatggcctttcctttgtgtgtggagagagaaagagttggagggaggaagagagagagagagagagagagagaaagagagagcgagacagaggcaaatgctccctggtgtctcttcttatgaagatgcaaatcctgtggaagcccttatgaccttacgtaaccttaatttcttccttggagaactcgtctccatatacaaccacaatgggagtgatggattcaacatatgaatttgaaagaacatgaatattcagtccacaacaaatctgggatgttttagatcttctttagtttctttcaacagtgttttgtcactttcagagttgcaagtgagtagaaatacaattgatttttatatattggtcctgtattctgaaaacttgctggattcatttattagttctataatctataaaacactggccgagcacgatggctcatgcctataatcccagcaatttgggagcccaaggcaggtggatcacatgaggccaagagttcaagaccagccaggccaacatggtgaaacctcatctctactaaaaatataaaaactagctgggcacggtggtgcatgcctgtaatcacagctacttgggaggctgaggtggaagaattgcttgaaccaaggaggcagaggttgtagtaagctgacattgtgccactgcactccaacaaccgagcgagaccctgtctcaaaaaaaaaatctataaaacattagtagctcttacaaattgacaagtagaatacaaacaaccaagtttttaaaaagatgattctctgataaacaaatggaagtgtgcaattaaaaatataaaaagtaaatcagactcactggtagtcagatacacgggatcttttctgtggagtcctaatgatggaaaaggagccaggttggttggaccaagggaaagcaaaaagagaaggcagatgaactacaagtctgcctttcttcctggtgcaggacttagccctcctatgcaaataactcacataactcacaatcttcctgcactcaacttatgacctcagttgatagaaaaatgcaaattagctcactgaaaccttggcattatcagcactgcatgtaaccctctccggcacaagcaccatcctataaaatccccagcaagcctttgtctcctggcagccagctcctcccttgctgacctgccctttccattcttgcaacgtattttcctacattctctaataaatctgcctttccttacctacaactgtcttggtaaattccttttctgcccacgctagtggactcagttagtggctacctgcaacattttatatctactagactgaccaaaattaacaagaataataacacctattgctagtgaaattgggggaaaaggtactcatacattgttctggggatacaatttattacagtttttttgaaaacaatatctaataaaattaggtcatatcaatacaattagtcttgaaattactgaaaaaagattaaacgtaaacatattcgtgtatacatatatgtgtatgatctattatttacagtgtcagaaaaagaatcctagcaaattgaaaattaatactaaaagtcatacccactaaaaaataagattacacctgtaccagtggacttggagaaatttcctcaaggctctggctagtgtgaaatgtagatgcagagaaatgagccctgtaggatcctattttagtagcaagcaataaaaatatcttttacacatatgttgagtgtgtgcctggggtacgtaggacagtggctgggtggagtggggaaggtgtgtaggaatcaacaaaaagcaaatgacagtgaaaagtgagtccagtatgtgtgatcctacttgtggaaaaactccacatatatgaatacgcatgcgcgtaaagaaacatagacttatacccagatctacttcctaggagaggcaaccatgatacaagttctagtgaaaagaattaagttgcaaagaaatgtggataataaaatccgaattggtagcaatacccaattgtgtatgcgcatctattttttatacattgtatgtgcaagtaggagggttgggtgggggtgcctgtggggcctggcactgggggtggcttttattgttttttaattgtgtatatttaagacatacaattcgatgatctcatatatgtctacattgtgaaataatcaccacagtcaagataattaagacatctgccacttcacatagctctctctctctctctctcttttcttggtggtgagaacatgtaggatctaccctctcagtacgttttaagtacataataaacaccgtgttgttacctgtggtcactttgctatgcattgggtctccaagccttatttatcttgaagaactgaagctttggacccctgggccagcacctcctcatttcccctttccctgcctctggttcccatgcttgcactctgtgcttctgtgagtttcactcctgtagactccatgtgtgagggagagcgtgtgatgtctgtctttctgtgtctgcctcttttcaccctgtgtaatgtcctccagatttgtacatgttgttgtaagtaaccagatctccttcttttgaaagctgaagaatattccatatatacacgtatagatgtatgcatatattccacattttgaaaaagtcaaatacatagaaacatagaatagaacagtagttaccagggtctggaggaagaaggaaagggggaggaggaggtcaagggcttgcggttgtgtaggagagggagccgagcagtccagtgcacagtgcaaggactacaggtgacagtcaggtgttgtgtgtggcaggtgtgctgagagaagactccaggtgctcctaccacacacacatacacacacactaacatcgtacacacatacttaccctcatacacacacatacacacacacactcaccctcatacacatacatacatacacacagtctcacacacaattaaaaacacaccttacacacactcatacacacataatcatacaaacacacacactcatacacatgcatacacactcatacacacacttatccaaacacacccatgcacacacacttatacacacacatacaaaaaggaaccatggaaggtgttggagatattaattgcagccatcatttcagtagtgtacatgtttaccacagcaccatgttgtccaccatgaatatgtacaataaaaataaatgtaaaaaaagatgtgtcttgggagagtccttcataataacacctgagaggtgtcacctttcttgactttttctgaccatgaaatgcacctgccaaggatggcagacgtagggaactgacctcctgggccctcacgtgcccaattatctttggccctccggactggagcagtttgtagaccttggaagcagggccccagcactgactgcttggcctcaggcctctgccccatcggtggtcaggtggcggccacgagggcgtgggagcttggccatccctgcctcctggagtggacgaggttggcggctggtcagcctgctcctgccccacccttgcctcatggaccctggtagcatcactggctcagccttgctgggcatgcacaggcagcagcacccgctctgatccaggaggcttgccctgcttttggctaagttctgggtccggccactgccacagaaggctcagtcccctgtgtgatcctcctggctgctgctgggtgcccatggcgcccctgatgcccttcccttgacagggcttgggttagcatcaggccaggaccctctgggactgggacttgtgccctgtctggggtccctgtcccacaggttgggccagaggccacagggcatgctgctggctggccatggctgcaggaacgtgacactcacccttccctctggcagcctccaagtgatgagttttccagtggatattaatttcctgaggccaggagccatctggggctacagggcagcctgccgtgtgccatcctggccccttccacaccatgctggccactgcctgtcatgggggtcggaagcaggcgatcccgtgcaggaggtgtctctggacctgcctcttctcttgctcatcacaaggccaggccaagcctggtgtcaggaccctggtggggttgcagggccaggcctgtcccctgtgcctggggtgtccagggcacacatagaggaaataggggccctgcatcccggctcctcaatgtactgtagaaatcatgggccctcaacattcaggtccgtgggaggcatccacagagacttccaatgaaggaactgttagacaactcctggtctctcctgagctggggacaggccagccacaccctgagcccctggggacccccagagagtggcctactgtcttgggctctgaggaagtgctctcattgtagagcacgggggatgttgtggcccactcctctcaattttgctgtgaacctaaaactgctctgaaaaaaaagtccattaaaggaactagcatgggctgatggggaggggctcattcacccctgagttggacaccgtgtggctacgaatccaccctcagaccacagagtggatttcggcagcaacaccacaccctagcctcatcctgagctcaaatttaactcagatagaccaggccctttttctatcgttcttagccaccattaaaccaggtcactcgttctgtgtttttgcaattggcttttaaacaaaagagctgggtttggtgtatgtttccttgtcaaatatttttttccaataacacaggtggaagaaaacagacagggcctctttctggtccagccatggggtggaggccgtttttgactttcaccttcctctgtgggtccagctctctcttgcttgttggctctgaggattatttagtttttcaacagctcagtgacttaaaaaaaatatatatgctttaaacatagcactttaaagctttatttatttacttacttatgtatttatttatttatttatttagagaaagagtctagctctgtcgcccaggctggaatgcagtggtgcgatctaggctcgctgcaacctccgcctcctgggttcaagcaattctctttcgtcagcctcccaagtagctgggatacaggcgcccaccaccatgcctggctaatttttgtatttttagtggagacggggtttcaccatgtccttttagaagtttcagggttgtgaatagtgtctagtcaaccttactaccgaaacagaaactcagaagcaatttctgaaacttccgtgttgttgagttttcactttcttgtcgcagttccgccaggcactcactgcctaccatcctgtgagacggtggcttcccgagcagcctccagcgctctgctgttacagacgcctgggtctgggggctccagccttgcagcccacctcctcctccgccagctcctgccttccctccccatgagtcgaacatgctggactttggtctaggccctccagcctccggaactgggagaaatggtgtctgttgttccgtcttccaggcttactctgtgggttttgttctggcagccccagctgacagaggcagcagggaagggacaggtgggcacctgaatcagaagtctgtgtagggaggtgtcacaaggaggcaggaaatagatgtctgtaggaagccttccaggagatgctgagggatttggcgacttgtgggggagagaagcccaaggggcctcccaattctgtatcctggaagatgggaaagacggagacgccccaagccaagtggatgccacggctgagttgtgccccctggttcatatgttggagtcctcaacgcagtatctcagaatggcaccttatttgaagataggtctttacaggggtgattagttcaaacatggacctaatggagtagggtgggccctagtctaatctgtgtccttatgcaaagagatgaggacgcagacacacacagagggatgagtacgtgaggatatagggatggcggcatcagtaagccacggagggaggcctcaggaggacccggccctgaggcacctcgatggcggattccggactccagactgtgagacaatccactcctgttgcttaagccacacggtttgtggagcagccctagcaaactcacacagcagggtacggggggttcccaaatgcctgggagtgcaactctgtggaaagtgtacatttctctaatcacacagaagttgaaacaaaagaatcacaatgcaaactcgtgggaggtgcagatcgtatttatttagaagatctagcctaggcacttacaaggcgaagccctggggaaagaaacagggccaggtcggaggtagaagaggagactgggcgcccctcctcctcaggagaggatcctggggtctccaataattccgagtcctctaggtcaactccaaaagcaatcggagcggtggcagctcaggcaggatgaagacgaagcggggaggagccaggaggttgcggggaccggggagaggcggcagcaggtcggaggattccagtgtcagcgtgtttccagcaggctcacaggaggggcccagggatgtgggatcttgaagccctgagaaggttgaagtggtggggtcaggaaaggaagacgggattccgggagggttgatgggcaggacccagcatgccagaagccctcatgacctcagaggctgagcggctgagtactgagccctggacgctaggctgccttagtccagaggaggacagattcagagacgtgcttcaggaattcaggacacagctgcaatcattcctggagagcccggatctgtaggacccactgaggtttgtgggcagagcctcagatcttgcactggcagcaaattgggacacagcagctggactgggaggagcagggcttgcagcagctggactggcagcaggatgacccacagcctgaggagcagcagcagggcttacagcagctggactgggaacagcagggtttgcagcagctggactggcagcaggatgacccacagcctgaggagcagcagcagggcttacagcagctggactgggaacagcagggcttacagcagctggactgggagcagctgggcttgcagcagctggactggcagcaggatgacccacagcctgaggagcagcagcagggcttatagcagctgcactgggagcagccacaagaaccgcagccccccttggagcccccacgaaatccacagacccccttggaacccccacaggagccacagctggaggagcagcagacgggcacacagcagctggagccacagccccccttggagcctccacaggagccacagccccccttgcagcccccacaagagccacagacccccttggagcccccacaggagccacagctggagcaggaacaggctggcacacagcagcacacgggcttgcagcagcagacaggtacacagcagccggagccacagcccccatagccggagccacagcccccacagctggagccacagcccccacagctggagccacagcctccagagcagccagagcagcccatggttctggtgggttgagggtggagcaggtagaggagcaggtgagagggaggtgtgcaggtgtggagttctctgagcccgggctctttatattcctgcccaggtgtttatactgaacacgtgaatacttctgttgttgtttctgctatttcacatgcacaagtgttatttttaatctctccacaatcccatgagccaccatcagctcaagccaagctgtcctttccttggtttctaaatttggcctcttcctcataggtgtttccctttgttagaagacactgggctccctctccagtgggtgtcccaggagcctgggaggcggtggttgcttggccgaagggtggaccattgtccttggtgctcagggctctcctcagcgatgcagaccctccaccccctggcattggtgtttatatcaaggatggtcatttggtaaaaaataaaataaaataaaaattaaaaaaataagctgaaagaaaggctgtctataggttccaccgcttaaaaacttcaagtataaatattttgtcaaatctgtaaaacaaagttttgaagagcatggatttgagtgtggccctggttctcctttgtctttcttacctcttcctcctgcggtttggctcactcctccagacacggattagacccacgttcccttcaggcaagctgggctcacagagggaacagaggaacaggaccctttctaatgcttttgagttttcctctattaattctttgtaaaaattctacaaatcaatggatattcttcaagtttattcttcttgaaggctacaaaaattttgattagccaacctctctaacacacttttattttctaaaagattaattttaatattttttttttgagaaggagtatcgctcttgtcaccagggctaaagtgcagtgacgcaatctcggctcactgcaatctctgcctcctgggttcaagcaattttcctgcctcagcctccccagtagctggaattacaggcgcccaccaccaggcctggctaatttttttgtatttttagtgaagacagagtttcaccatgttgggcaggctggtttcgaactcctgacctcaggtgaaccacccgcctcagtctcccaaagtgctgggattacaggtgtgagccactgcacccagccaaattttaattttttattaaggtaaaatttacatgcagtgaaaaaaaattttttttctgagtctccctctgtcacccaggctggagtgcagtgatgcaatttcagctcactacaacctctgcctcccgagttcaagcaattctcctgcctcagcctcccaagtagctgggattacaggcacccaccaccacacccagctaattttgtatttttagtagagacggggtttcactatgttcgccaggctggtctcgaacccctgacctcaggtgatccacctgccttggcctcccaaagtgttgggattacaggcatgagccaccaggcttgggctgcatttttttttttttttttttgagacggggtcgcattctgtcgcccgggctggagggcagtggtgtgatcctagctcactgcagccttggtctcctgggctctgcacatattttgagtgtacaattccatgagttccgctaaacatgtactcgtgtgcccatcactccaaccatgaccaactgcttcacccccagaagtttccctttcgccgccttcccttcctgcccatcgctccaggcacagctctgctgaccagttgtgcctgttgttgaatgttgcaaaaatgaaatcattaaaaatgtactctggtttctttccctcacgatgttattctgtgtgtcaatgatttgctcttcttctttttttttttttttttttttttttgagacagggtcttgctctgtcacccaggctggagtgcagagtggtgcgctcatggctcactgcagcctcgacctcctgggctcaagcgatccacctgccccagcctcccaatgtgctgggattacaggcatgagccaccacgcctggccttcttcttcttttgtaatcaccgcatagtgtttctgtagcagggcgagccgcagacaagaacccctcagacactgaattgtagaaggaaagggctttattcagctgggagcattggcagactcaggtctccaaaaaccaagctccccaagtgagcaattcctgtcccttttaagggcttacaactctaagggggtctgtgtgagagggtcgtgatcgattgagcaagcagggggtacgtgactgggggctgcatgcaccggcaatcagaacggaacaggacaggacagggattttcacaatgcttttccatacaatgtctggaatctatagataatataaccgattaggtcaggggtcaatctttaactaccaggcccagggtgtggcaccgggctgtctgcctgtggatttagtttttacttcttttttctttggagacagaaattgggcataagaaaatatgaggggtggggccccccttattccatgtaaaaatattctccactgcgttcccccgttctcacgttcatacatatttgaatcgttcacagtttggggcgatgatgaataacacataatcatgccttccagtccttccgtattcatgtttttagttttaattttttggtcaaatattgaggactggccttgctagaccatagagtagtgtatgcttaacttgctaagaaacagacagctttccaaatgctcatgctgctttccccctccccagcaatgcctgagagtgtccgctgccccaggcctgtcagtaccagccagcggcttttcaaatgtgaggcatcggatgggtgtaaaatcgcatctcgtgtgcattttgacctgtgtttctctgatgactaatgttcgcaaggattctttcttgcacttattggacatttgcacatctttcttgttaaaaagttttgctaaaattgtttgcccattttattgtgatttttttttgtctttttgttattgagttgttggaactcttcataaattctatatcaagaatgaatatgtgaagtgctttgccatatgtacgtatatatatttacatatatatttcatatacatgtgtatatgtgtgtatataatatatatatgtagaatatatatattgtatataattttctagtatttgacttgccttattgttatctgaactttttatatggaaatgtttttgattttgaagtccacgttaacatttgttttgacagctagtgctttcttgtgacctctttgaaaaccctttttcctagcatttcctttagaagcattagagttttagtttctatatttagttctatgatggatctcaagctaatttttgcgtgtaatgtgaggtaggagttgagatccattttttcacattttcatccaattgtttcagcagcatttgataaaaagaccttcctggccaggcgcagtggctcacgcctggaatcccagcactttgggaggccaaggagggcagatcacctgaggtcaggagtgcaagaccagcctggccaacatggcaaaaccctgtctctaccaaaaatacaaaaattagccagacatggtggggggcgcctgtaatcccagctactcaggggactgaggcaggagaatcgctttaacccgggaggtagaggctgcggtgagccgagactgcagcactgcgctccagcctgggtgacagagtgagactctgtctcgatataaacaaacaaacaaacaaacaaaccgtgcttatcccactgaaatcactggtgtttttaatgagaatcagccgacacgatggcgagtttcttcctgtgtcccgctccgcaggtctgtatgccgcttcctaatgcaaacacagcgtcactgtgacattatgggaggttttgaagttaagtattgtgagactccaacttcattcttctttttaaagattgttttgtttgtttccaattcctttacttctccagctaaattttagaaccaacttgatcatctcaaataccaaaaaacccgttgctgttgcaatagacagctgaggcacgggaaagaccctggagagagcccctgtgccatgtgggcaattggagaaggctgaaggctgaagctggagttctaagactgggaaatgcctgctcactccagcccccacccccatcaccagactatggagcccgtgggaacaaaggtaactgcacccaccaagtctttgtctttcctcttttcttttctttctttcttttttttttttttttgagacggagtctcgctctgtcacccaggctggatgcagtggcccgatctcggctcactgcaagctccgcctcccgggttcacgccattctcctgcctcagcctctctgagtagctgggactataggcgcccgccaccacgccctgctaatttttttttttttttttttgtatttttagtagagacggggtttcaccgtggtctcgatctcctgacctcgtgatctgcccgcctcggcctcccaaagtgctgggattacaagtgtgagccactgcgcccgacctgtctttcctcttttataaaatgcctgctgatgtctatgagttggttcctctgtttagttgttttctttgcttgctaattggtgtgagctctttgggttttcaaatgctgagccacggtcagctttattttattttattttattttattttattttattattattatactttaagttttagggtacatgtgcacaacgggcaggtttgttacatatgtatccatgtgccatgttggtgtgctgctcccattactcgtcatttactcagcaaactatcgtgtggtcagcttttatgttgcaagatcctccttggttcatcttttcattctcgcgaggccttcccttgttaaatgagaatccttgagtgtttaattttaacttatcaattcacccacctcttcctttagaattagagtatttggggccttatttaggaaatacttctctgagatcatgatatatttttctgtaaaagttgaaaacttttgtcatctgttttaaaatcttgaatcaggtatatgtgatggttaattttatgtgtcaatttggctggatcccagggtgcccggatatttggctgaatgttatttcttggtggtcggtgagggcagtttctggatgagaccagcattgggatcagtggactcaggaaagcagacgccctccccaatgtgggtggcttcctctgatccactgagggcccgaatagatcaaaacgtggaggaagtccctttctgcctgaccgctccagctggcacatcggtctcctgccctcggacttacactcacaccgtcagctccctggttctcgggcctttggacttgaacagaatgaccccgccggctttcctaggtcttcagcttacagacagcagatcatggagctgctcagcctccagaatcgcatgggccaattcttcataatcatctgtgtatctgtgtatctctctctgtgtgtatgtatgtatgtatgtatctatctatctatctatctatgtaactatgtagctatgtatctatttatctatgcatgtatctatcatctatgtatctatatatgtatctatccatctatgtatctatctttgtatctatgtatccatgtatctatctgtgtatctatgtaagtatgtatctatctatgtagctatctaactatgtatctgtctatgtagctatctatctacctatcatctatttatttatgtatgtatctacctatgtatgtatctatgtgtctatgtatctatctatcatctatgtatctctatatatatccatctatgtatctatatgtctattatctatctttgtatctatctatccatttatgtatctattatctatgtatgtatgcatctatctatctatctaatctacctatgtacctaatctcccactggttctgtgtctctggagaaccctgattaatgcagtatagatttttgtgtattcgtgtggaaactgcctttctcggcatgttttcttttccagcccctcggtcacccagtgtcagtcaggatggcctgggttgtgctgcagcaacaaaccacaccaagatctcagtagctgagtcaacccacacctcccaccaccacaagacacctggggctctgcctcttattccataacccaggcagccagttgctgtgacagaggaaaagaaaaatatactattcataatagaattcagcagtatattaaaaagaattttggcttacaggcatggtggctcatgcctgtaatctcaacactgtaagaggccaaggcgggaggatcacttgagtccaggattttgagaccagtctaggcaacttagggagaccccatctctacaaaaaaaaaaaaaaaaaaggcatactgatgtgcacctgtggtcccagctacttgggaggctgagttgggaggatcacttgagcctggaagatcaaggggacggtgagccattattgcaccactgcactccagcctgggcaacaaagtgagaacctgtctaaaaataatagtaaataaataataaataaaataactttgcaccctaaccaaaatatttacaaaccacatatctgacaaaggactggaatatacaaatctagaccatgtaaagaactctcaaaacacaacagcaaatcatacataaacacaaaaacaatccgatccaaaaatgggcaaaagacttgaagagacaattctctgaagaggacgtacagtggcaaataaggatgtgagaggaagtttgacatcctcagactttaggaaagacaaactaaccagtaatgcgatatcatgatgcccctatgagaatggcttaacaaaaaaatagcagcgacaccaaatgctggcaaaaggcagagaagctgggccactcgtatgttgatggtgggaatgcaaaatggtacagccactctggaagataggttggcagcttatgaaaaaaactaaccacacaaccgccattcaacacagcaatctcactcctgggcatttatcccagagacatgtgcacacggaaaacctgtccacaaatgttaataggaggcttattcatgatcaccaaatgctggagacacccacatgtcccttgatgggtgaaggggaaacacactggttcacctctgccaggggacacgtctcagccatgaaatggcaggaatgacagacgctcgatgacccagatgaatctccagagaatcatgctgggtaggaaaagccagtcttaaaaggttacacactgtgtgtttccattcatggagcattctcgaaatgacaaaattacagaaatggagaacaggagggaaatgtgggggctgcatcagggcaacgcgtggggtccttgctagagaaatgatctgtattgtgaccgtgccaaggtcaatatcactgtgttgttatgttacctgcattccagatgctgtcaccggggacatgggaaagggtacatgagatcccctttgtgtcttcttacgagtaacttcttacgagtaacttcttatgagtaactgcaggtgaatctacaatcacccgaatataaaaagttaaattgaaaaaagagtgcatacctcacagatactcagggagtcatgtttataaagtgtgtgggagagtagctggaatgcacgaggtgctgtcaatatcgggtggtggcagtgaaggcggtcattggataaatcaccaattaggcaattggcgaatcagattccaaatacttttccaaggtagaaccttggagatttgctgttggattggatgtggagggtggaagaggagtcaagaggatgcccaggcttctatcctgagccctgggaaggatggagctgctgtgaactacaatggggaaggctgggaaggcgttggttccaggggaaggaggaggagttcagtctgggatgtgcttagtttgaaaggccagatgtccatgagaagcaggcacctgggcctgtgagtgtggaacctagaggggaaggtgttgtgagagacatggaggaggtcgcaggtgagatagagaccccccggctgaacctggcaccgcccagtgctcagggcctggaggaggagaattaagcaatggagactgaggtggagtggctggtggcacagaaaggaagccagggctctgcactgggctggctctgtccctacatagatagatagatagatagatagataggtacatagatacatagatacacacatggatacatacatggatacatagatacgtagctagctagctagatacagacatacatacatacacacatacatacatagatggatacatagatacatagatagatacatacatacatagatggatacatagataggtacttacatacatacatagatggatatagagatacgtagatgatcgatagatacgtaaatagatacatagatacatacgtacatgcatacatagatggatacatagatacatagataggtacttacatacttacatagatggatacagagatacctagatgatcgatagatacatagataaatagatacatagatagatacatagatgattctgaagaattggaccctgcaattatggaagttgagcaactccacaatctgctgtctgtaagctgaaggtgtcccctgcttgtttccagactgagtctggttccccgatcactctgaccagagattcatgctaagatgctccctcggtgaccactccacaaccagccaacatctctaggctccatacagggtctccctgtgctcattgtaaatcatcaggccttcaaaatattcactagtggcagtggtgcatgcctgtagtaccagctactcgagagactgaggcaggaggatcccttgagcccaggagttcgagaccagcctgggcaacacagtgagactctatctctattaaaaacaagaagaggaaggtaaaaaagaaaataatcacaaacaagtaaacaagctgacaatgtcatttatttatttattttttatttatttgagacagggtctcactctgtcacccaggctggagtgtagcagtgcaatcataactcactgtagcctcaacctcccaggctcaagagattcttccaccttagcctccccattagctgggactgcaggtgtgcaccaccatgcccagctaattctttcatttttctgcagagacggggtcttgctatgtcacccaggttggtcttgaactcctgagctaaagtgttccttcttccttaacctcccaaagtactgggattacaggagtgagccaagcccaagctgactacttcttttttttttgagacagagtcttgctctgtcacccaggctggagtgcagtggcaccatctcggctcactgcaagctccgcctcctgggttaacaccattctcctgcctcagcctcccgagtagctgggactacaggcgcccaccaccacatctggctaattttttctttttttgtatttttagcacagatggggccaagctgaccacttccaaaagtgttctccactcaagcagctcgtttacttaacaatatcacttattcccacacaccccctcccaaatgtctttcatgtctttgcagaaccagctctcttaaatacattttccacagtcatatttacgatgcagattttaagtaaaattgcaatgcttgcaagaaaagaaacgtaggattctgtgatgtcactgaaagtgacattggagaacatctgctgggagccaggcaaggccaccacggtgaagatcaggcggttcaccctgaaagagaagctggtcaaggaggcaagatagaggcttcccaatggggtgagttgacctcaaagagaggcgtccgtgaaggatgagaaggagctcagttgtttttgctacgcgactcccttcagcgtcattctgtcacggccaactgtgaaatgaaggatgttgcagcaggcaatcctatgattttatcaaaaaattatgcataaaatgtccaacacgtgattttctctttgttgatttcatggagagttacaactatgtcttaaatcttgctaacaatcatgtgacatctgttcattattaaggaaggttttgggtttctttctctttctcttctacccccacaccacaagcacagacagcattggttctgttgggcctgtttccaacgaatggctggcggcaggctcttctctggtgcccattaccgtggtagtgaggccatctttgatctgcaggtcactgggtcctgcctgggccaaacacctccccctcttccctgcagaaacctcttcatcacacagcaggacatgaatttacccacaggagccacaggccaagcaaagagaacgccaagtgagccatggggggagaagtttccggcgtcttcttccggacccactgaccccacagcagcccctcctgccccactggccaggctggaggcagctaccaactccctacctcagtgtggtctgttctcatggaacctcatcaaagtgtacccttaaaaagggttccttttagccgagcacggtggctcatgcctgtaatcccaggactttgggaggctgaggcaggcggatcatgaggtcagaagatcgagaccatcctggctaacacggtgaaacctcatctctactaaaaatacagaaaaaaaaaattagccagtcgtggtggtgggcgcctgtagtcccagctacttgggaggctgaggtaggagaatggtgtgaacctgggaggcagagcttgcagtgagccgagatcgtgccactacactccagcctgggcaacagagtgagactccgtctcaaataaaaaaaagaaaaaaaaaaaattcctttcatttgagcttcaattgttctttgctgctcaaaagccttctaagtcttaccatttaccaggcagaactgagaactctgtagctccccaggtttctccaggctttctagaactttcctcctggctggcaaatcagccggttctttcgagctcaccctgttcttgtaatgctttgataaatgcagccacaacgacccacgtgggagtggcattgtgttttctgaactcttccctcagggatacacgatctgggacagtcttaccaaacacataataactacctttctcacctctaataactttcctttccacccaccctctgaccaataaaccaggcccacaatgctatgtttttgttctggtaggtttctgggtcaaccaggatagaccaattacgctgctcacacgcgccacccccacgtttcagtgacttcacacgacacaggcttacttcctgttcatatcccaggccactgcacgtcagctggtgactctgctctgtgcttcgtcactctgggactcagtcggaagcagcagccactgcttggaatgttggtggtcatggtaggagaagaaacggagaatgcagaagactgcagcaggtgcttcaaacttcttcccactgacgcaagcaaatcacatggccacacctgacttagagagggctcatggaagggccaccctaccacctgccatccaacctgttcccagaaggagaggagaaccaggatgcctacaaatagccctaattaccaccccattctgggctctgtgtggcaatgctgccagtcctatagataggtttttgcctaaatgagcttaagctttttttttttttttactccaacatatgcatttaaggctataaatttttctctaagcactgatttggctgcatgcagtaaatttgatagccccattatttcattaggggttacaaaatggttagcttctaattctacgatttcttctttatttataaactggaatacttcctctaattttttggttaccgtaagatagagtttctctatcagagatagaataagtgcctgattattttcctttatatagtcatcttcgaaataatgacttgattcctagaatcctctaaaggcaactaaattttacagtttgcatagtatctctattattatttgtgtatgtatgtgtgtgcgtatgattactcactcctagtttaaacatatttgatgtgtatcagtccagttaagaaattggtgttcagattgtttcaagtctgtctatacagagtttctccaggtttgactcttacctttttttttttctttttttgagacggacgagaggcagcggagacagccagccccatcctagcaccttccagcaacatcaccatcagactcacggagtccgaaatataacaagaataagaaaacaatagccatagccatagtaatgacaccgaacaacagagaaatcagcaagatatgtgtttcagtttgtcggcatggtatttttattagtttgcaactttctgtttaagataaagcagtgtgatcctggttaacatggtgaaaccctgtctctactaataataataaaaaaaaaattagccgggcgtggtggcgggcacctgtagtcccagctactggggaggctgaggcaggagaatggagtgaacccgggaggcggagcttgcagtgagccgagatggtgccactgcactccagcctgggtgacagtgcgagactccatctcaaaaaaaaaaaaaaaaaaaaaaagatacagcagagtgttggacatgcaaagccactccaaggaagcctcttaaacgcccaccttgttgcaggtgggacgcttatgcccagctgctccagctggaaaagacaggactgcaagtgggttcaggagctcaggcctctgaaaagatgagcaaaggcgaggctagtgggtgaggggtgattcagctgcaattgcagttgacttggggagagaatttgttaggagagacaatggacattaattagggtggactcttcttaggaaaaggcagccagatatggcatcgttctacagcagggaatggaccctgagcaatgatttggggctcaacaatgaaggacaggtcacagctttggaagacaggattagcaggactcacatgaggcctgagtccagagcctcagatcttacactggcagcacacagggacacagcaactagactgggagcagcagggattgcagcaactggactggcagcaggatgacccacaacctgaggaggagcagcagggcttacagcagctggactggcagcagtagggcttgcagcagctggactggcagcaggatgacccacaacctgaggaggagcagcagggcttacagcagctggactggcagcaggatgacccacagcctgaagagaagcagcagggcttacagcagctgcactgggagcagccacaagagccacagcctcctttggagcccccacaggagccacagccccccttggaacccccacaggagccacagccccccttggagcccccacaggagccacagccccccttggaacccccacaggagacacagccccccttggaacccccacaagagccatagccccccttggagcccccacaggagccacagctggagcaggaacaggctggcacacagcagcacacaggtttgcagcagcagatgggcacacagcagctggagccacagcccccacagccggagccacagcccccacagccggagccacagcccccacagccagagccacagcccccacagccggagccacagcccccacagccggagccacagcctccagagcagccacagcagcccatggttctggtggattgagggtggagcaggtagaggagcagatgagatggaggtgcaggtgtggagccccctgagcctggacccccttatatccctgggtagggttgctctgagaccttggtcactccatcattcccagcacttcctgggtatgtgattatttgtttgctggacttcgggttctcattggcctgatccaacacccacctgcttatgtttctaaatgtagtcacttcctccttggaactggaccttgtactgaactgatcacctgccttctgttttcctcatgtgatgggcagaggatgggttttctacaaagatcattttggttgttttcttcccatcttttcttcccacctatggcattatatttttctttgaaactgtgaactttgtgtgaagataattttttaaaaactaagctttcatccatataattaaagaggctaattgaggaaccaacgttgtatcttggttctgtcttaacacattggtgcactgcagtgaatctctcctccgccagcctcaggtcgtggggtgctcaggactcctggctgctgcatacacagcctcacgtggtgagtattgtttatgttaaaaatctcaggaatttcatgggtggatgggggatctcatttatcatcctgttgttaatctcttcaattaactattagtgagggtgattcttttactccaatataaattatatacttttttattggccaggcacagtggctcacacctataatcccagcactttgggagaccaaggtgggcgaatcacgaggtcaggagatcgagaacatcctggctaacatggtgaaaccccgtctctactaaaagtacaaaaagttagccgggcgtggtggcgggcgcctgtagttccagctactcaggaggctgaggcaggagaatggtgtgaacctgggaggtggagcttgcagtgagccgagatcatgccactgcactccagcctgggcgacagagcaagactccgtctcaaaaaaaaaaaaaaaaaatttatacctttttgacttctcattactgctttaaaagttatttggatattgagagaacaaatcccttgtgttcaaacagtgtactttgtttttccacaggcatgtacttgagtttaatttctgacgtttttaaaagccattctcactttgtcttaattgtcatttttagcctcgccaacattattagatggtataaaaatgaatgtctttcagccgggcgcgctggctcacgcctgtcatcccagcactttgggaggcccaggcgggcggatcacgaggtcaggagatcgagaccatcctggctaacatggtgaaaccccgtctctactaaaaatacaaaaaaaaattagccgggcgtggtggcagacgcctgtagtcccagctccttgggaggctgaggcaggagaatggcgtgaacccggcaggcggagcttgcagtgagccgagatcgtgccactgcactccagcctgggcgacagagcaagactccatctcaaaaaaaaaaaaaagaaaaaaaaaaaaaagaatgtctttcaagcttgggataaaggccttgtcttatctggaagaggcgagagaggggttataggttccgtcgttcccattgctaatgggagctgtggggcaggggactgagagaaacccacagagagggaagtgcctgctgtgctgaaaatggcttcttcctagggaacacactgggtcagaggatgcagccctgtgtggcaacagttcacgcctcccgactaggcgcggtgaggctgggatggggacacttcataagacctggattgtgagcacagagcccaggcatcctaacaaagctgtcccccaccagccctgcgcgaggccgcactggacatgagcagaccatcacgcaccccaggtgctcaccagagcttggcagctccgccctcaggtgctgggtaaagggaaccaggagcatcccattttgtttcaacataggtagaagatctagacaggattggccaaacccaagagaggtaacatgagattctgtaacagctatgaaaacaaaccttaaaaaacaaaaggaggaggaaaggaaggagacaaacctttctaagcaaacttgtcatccgggagacaaaagtagatttcctgcaaatggttgagttatgcaacaaataataacaaatatggcagcaaattacaaatatggcatactaactttaatagggctctcagttgagatggtaaaattatagagtaagttttattttgtttatttgtttattttttgagacggagttttgctctttcacccaggctggagtgcaatgatgtgatctcagctcactgcaaactctgcctcccaggttcaactgattctcctgcctcagcctctgaagtagctgagattacaggcacgtgccaccacaccccactaatttttgttttttttagtagagacagggtttcaccatgttggccaggctgttctcaaactcctgagctcaagtgatccgcccaccttggcctcccaaagtgctgggattacaggcgtgagcctctgcgtctggcctatagagtaagttttaaaaggaagagcggaggcctcagggaataaatgagcaccagaagtcattacagttcgagtcggtgattaggaagagtgaggggcagaacggaggtggctgggacttgggtcgctggcatccgagaagggcgcgagatgctcacagtgtggctaaagcacaaagccgtggaatcagccagagagaggctggcgaacggggaggacaggaaagctgcagcatcggtgtaagcagtggaggctttaacaaatggagcagaaagcagattcaaaggccagaaaaatgcaccatgacccgcaggaagatctgaaagtttagccccaaagagcgtaacatgctccaggaaagaatgaaggcggaatgctgagtactgagcccgtggtggtttggtgacagaactccaaaggctgaatcaacattgccgcttctgcaaatccctggccagtctgccgtggctgtcagggctgaggagggtgctcatagctagctgctcctagatgctcctcggagaggtcataaacccaaagataggggatcaatttctccaaaaaggacaaaaccaaaacatgacccaagaacatggtgacaaaacgtccttcaaatagaagaaaacaggaacacagcctccaaaatggcagaaatctaagacgacagcacctgggactcgggaaaatcatatggaccctacacaattgggattcattccaattaaaggagtgaggcagggataggcaaggcaggaagggctgaggacagtagaatgaagaccaacattgagtaattaactacacgggcgatggtgagttacggagcccacctgcattcccagagagaaaaattaacctgatgacatctctgctctccacctcctcaggccccttccacaacctccaggtgggtgggggttagagccatggaaggacccggtgacctagggcaggggtccccaaccctcaggccacagtccatggcctgttaggaaccaggccacacagcaggaggtgagtggaaggcgtgcaagcatgacctcctgagctgcacctcccgtcccttcagccgccacattcgattctcataggagccagaaccctactgtcaagtgcgcacgcgagggatctagggtgcgtgctccttacgagaatctaactaatccctaatgatctgagatggaagagtttcatcctgaaaccagcccccacccaccccctgggtccgtggaaaaattttcctctacaaaaccggttcctcgtgccaaaagaaggtggtggttgctgccctcgggtgctcttgaaaatggccctgcattgtggctgggctgctgtctccctggtgggcggcgatcctggcccctcaccacacccgtgggccagcactgtctctaccatctcgtgggtgctactgtttccatacttttcttatttttatattttccttttcgtaggcttttagattctcttttcttgcttctatggacttgctgaagcttctttcttcctttctcctctttttctgctggtttgcactgatgtttttgtttctacttttccccagtggtgactgtgaacattttaacatgcatgtttaacgcagtctgagatcagccactatcttcccctggcccctcacagaggcaggtgctcccctcagactagcatctcctgtgtcaacctgagtgccgtccagtgtttcagatccgcctccttcctgtacccccagcgagtcatgagcatcctacccttcatttcttctttatatacagcacatttaccttcacgagaacctcatacttccttccggaaattatcaatttgaagaagacacttctgtccctcagctcatggtcaggcacgccatagctaattgttacacctgctgaggtggacgtgtgaattctctccctcaaggcacttttgtaatgagttacaatgatacatttcctgacggtgagccatcttaacattcttggaacaaaccctacttatgacttgctatttttaaataatcatattggagtctttaatatttgattcagaaattgtgtgtatttgttaataacgaaatgaagttaaaattttcttgtgttttactggccttacctttttcttttttcttttttttcttttttgagacagagtcaagctctgtcacccaggctggagtgcagtggtgcaatcatagctccctgcagcctcgacctcctgggctcaagaaatcctcccacctcagcctcccgagtagctgggactacaggtgtgcgctcacaggcccagctaatttttgtacatttttgtagagatgagatatcactatgttacccagactggtctcaaactcctgggctcaagtgatcctcccacctcagcctcccaaaatgctgggattgcagatgtgagcacccacacacagcccttttcattcttctctgtcaggccccaaatgttcctgggtggttctggctgggggtctgaggctgcatcccctgaaggctcggctggtattggacccacttccaggatggtacatgccttggcttgtgggtgggaggcctcagcttctcacctgcaggcctctccacagggctgctattggcacaggatctggcttcacccagaaggagtagtactgagagagagagagagagagagacagagagacagagagagacagagagagaggcaagtgttgtaccacccttcatgtcctagcctccaagccccgtgccatcatgctgtctgccgtcttcgtcgcgagaaacatactgtgctgctggccttctccttgttgcttcttctgcaagtccttctgctggagccttctctgctgtgcggcatcagccagcactttactatcccaggaaaaaccgcccctgagccttcctctcatctgagtgtggtttcaggtggtggaggagtgaaaatctgtggggtcagcctagctcgttttaggaggagaaatccttccagctctctcttacctggtgcccccttttctgttgggttcttgatctggagcctacagatacaggtggacatcagatcctgtctggatactgcacagttttatgtaaagttgtgtgtttttgtgcatgtttgtagacttgtttaaagagaggctctgtaaaattccacagaggaatctacgaacccacagtagttaagaatgggtctgcagaggtagttcctaatgtggagcacaggagcaaagtctacaacatactcatgtctgctttacgctgaaaaggtgaaaaaaattaaaattaactaaaattaaaatagcaaatgactagacaggagcatatgcaccttatataatacacacatttcagggggcatttgctcaaaagctacataatcgtggggtgccccacgggacagggtgagaccactgccatgttgattgttccatcagagcattgtaagaggccctctgatgatcctctttgcccaattcagcgaacccgaaggtcatcaatggaccacgaagaacaaaggcccatgaaagggaagatgttcccaaagtacaaaaggaaaagtcctcttgtacccgagggaaggagctgatccaagggtgtcactaggagtcagcgcgggtgttgatacattacttcaggggctggaggcaaatatacgaggtactggaagcaaatgtatcaagcactgggacaaatgtatcaggcgctggatgcaaatgtatcaggcactggatgcgaatgtatcaggcgctggatgcgaatgtatcaggcgctggatgcgaatgtatcaggcgctggatgcgaacgtatcaggcgctggatgcgaatgtatcaggcgctggatgcgaatgtatcaggaagcaaatgtatctgttgcctctgttccagagctggaggatgccgcctctggtggggacagccaacacaaggcggctctctcctaatgggttttctgttcctccctgagatacagtcccctgccccagaacagagtggggctccagcatacacggcaagagtcaccgagtgccagctggtgtttacaccgtggcctgaggcctgttgactgggctcggggcactcacaggtattgtggtcacgggggcaaatggccatccggttccctgctctccaccggctttctttagcatccagtgggcctgcacccgaatgtagttgctgcttcccaggctgagcccgggacccggagcaggcgggcacccagacagggcatcctcttccgctcactggccctgaaagggcctctgccatcagcctgtgccgctgtccgggagcccctgggccggccacgcagtgggggaacccgcttcacagcgacaccgtgcggcggcaggaggaaccgctgcaggagacaatgcgatctgggtcctgacccagcgcagaggcagtgtctgccccttgcaatgcttggatttccttcctcaaaaggcagccttcgatgatctgaaattcaagttccagcaggcatcctgtactgtatctgtcagccctgccacccgagtggtctgaaagccctggaagagaccgcggttatcacaggagaacactttccatggggagcacgcagcaagctccagaataagcgcttaaaatccccgtctcagtcaacactgcaaaccttccaacaaagtcttacaccgaaaacgaccctgctgagctgagggctgaagccccaggtcctgggacccttggaaacagcccgcgggccaggagctgctgtggaccgtgaaggtgtagggcctaggcacgtcccaagcaagacacgatgctcccgcagaggaatcttcccgggagcaagccaggagtcctgggctcaaaatcaccctcggcaagaccaaggcctctgagcgagccactgcctgcccatcgcttccttcttgtcacatggaaagggaaactcaccgcggggccagtgtttactgaggggccgcttccatcacagacctgacagcacattcgagaaaagtgcgaggaaaacaggagttatttataaaaatgtaaagcagaagagaatactgggaccagtggcacaagcaggaaccaggaagtgacagtgtgcccagcctctcacctgaccctggacagggatataaagagcccgggctcagggggctccacacctgcacctccctctcacctgctcctctacctgctccaccctcaatccaccagaaccatgggctgctgtggctgctccggaggctgtggctccggctgtggaggccgtggctccggctgtgggggctgtggctccggctgtggaggctgtggctctggctgtgggggctgtggctccggctgtggaggctgtgggggctgtggctccggctgtgcgggctgtgggggatgtggctccggctgctgtgtgcctgtctgctgctgcaagcccatgtgctgctgtgtgccagcttgttcctgctccagctgtggcaaagggggctgtggctcttgcgggggctccaagagaggctgtgtctcctgtggggtgtccaagggggcctgtggctcctgtggggggtccaaggggggctgtggctcctgtggggggtccaaggggggctgtggctcctgtggggggtccaaggggggctgtggctcctgtggggggtccaaggggggctgtggttcttatggctgctcccagtccagctgctgcaagccctgctgctgctcctcaggctgtgggtcatcctgctgccagtccagctgctgtaagccttactgctgccagtccagctgctgtaagccctactgctgccagtccagctgctgtaagccctgtagctgcttctcaggctgtggatcatcctgctgccaatccagctgctacaagccctgctgctgccagtccagctgctgtgtccccgtgtgctgccagtgtaagatctgaggctctgactgcagactgcaggtggcctgactggtgaagggcccggctgcccagcttccttgccctgggttctctggtgctccactgtctccactgtgtcctcactggcttcatccactccacaccagtgctcccgaaactgactgaggaccccttctggctcattgcctactacttctcctgaacttcctctccctgctcctcactcatttaagatccaaagcggcccactgaggccccagaggcagatcagaccccttagaccctgacagctgctccttctttcaggagtgtgatcgaccctcaatctctctggctgtctgtatatcaagactgaatcctgaccctctaaataaacaaagtctctaagcacaaagctcactgtcttgtggttctctccttcccacctctctctcattcccagaagcaccatcttcttgcctccacccctgggcctgttcccatttctctcccctcagcatctttcatgtcatggtccatgtcttcatgcacagaactaacgtctatagctttctgctctgggccccttgttgtgttgggctccagagatgacagagcagagtaaatccaagctcacagtctggtatgtggggagaggtggggagagggaaaggtggtgagggcggtggtgtcagccgtggaggcactgccgtcccgtgggagggagggaagctcagggccaggccacttcagcggaaggatgaggaagggtctgtatgctgagctgtgcggtacatcaggccctaagaagcccctagtgcatgcaggagccagacgtggagatgcggaggagcttgggcttatctgcaatctcacagggccttgaaaaaccagacaggagaaggcaggactgcacacaacgccagctgcgggacacaagctcgaaggcagccgggagttgaatagatccccacctccaaaaaaaaattccagagctgggggagcccaaatgcccagtgccttctaaggcaacctagcctggagacaagctttctttcagcttttattttgggttcagggctgcatgtgcaggcttgccatatagatgaattgcatgtcatgggggtttggtgtatagattatttcatcaaccaggtaatgagcatagtacccaataggtgactttttgatcctcaccctcctcctgcccccgccacccccgccaaatgcaccacagtgctgttgttcccttgtgttcctatgtactcagtgctcaggtctgactcataagtgggaacacgcgatatttggttttctgttcctgcattagtttgtgaaggatattgacctccagctccattcatgtccctgcaaaggacatgatctcattctttttgatggctgcacagtattccatggtgtataagtaccacattttctttatccagtctgtcattgatggacattaggacgttacgtgaagatgaaggtagaggttggggtgatgcttctataagtcacagaggaccaagggttgccagcaagacccagaagctagaagagaccagaacagaggctctgttgcagccccagaaggaaccagccctgcccacccctgcatctcagacttctggcccccaggattgggagagggatgtttctgtcatttgtggtcctttgttagggctgccccaggaagcgagtacaagcggtggctcagtcagagcaggaaaagcagtcattcagggtattttctgtcggggggatctagagtggaaatcagaagcttatgttctcgatggcagctctgggacctggacttcctggaaggactccagctgtccacagcaggggcccctggagacctcaggtttccaagctgtcctggaaccctgagctccagtgcacctgccatgtggtccagggacagggagccacctcaccgccacctctgccacagccacctcagggcgtccacaggctggtgacagcactggggtgtgcgtctacccaagcctttctctggggaagcaggtgaccagctgcagcggaagccacaggtgcacagctcgccctcatgcgcagcagcacttgagccctggcatgggcctctgcctgccttcccttccagacctggggaaaggcattcgattggcaggacctcattctcaccctggccttggaattgacatttttatcttctagctcatgcagtgtagacaggaccggaggagggggtggagactctgtgggtggggctcgcctacttcctgccttttcccccctcaattatccccccactaaggcttctgtagccctgttactgtacccagggagggtgtccaggatcttggcttctcaaacaaagaattggacaaaacgcacaaataaagcgaggagagcaaaagctgggatttattgagaaggaaagtgcactccacagtgtgggagcagccgagcggaattcattgcaaaggagaaagaatgttgtggaagtgaggtgcagaacagacaggatgccctgggcgagacagggtgcagggcgggctgctcacaaggatgagaagcagagaccggcctgagggaggctccctttatgggactcttccatgattattcctaaggagctgggaagaggtgttgctaggaagcatgttctgggtggtcctctgggtgcatgtgtgcagtagctgtacacgcttgttcataccattcatgtctcattagcatcttaaatctccacccagagatgtgctttatactattataagggccccgttaaagagtttttgtgagtttaaataccctgtactggaggtccgccctatgtaaatgaagagaatgaagttacaaagtcatttgttcgctgtgtgcccatggggaggacatgtcctgtcatagctgaagtgcgaatccgccttatgttccctgcctccagaccgtattttcctgcctcagtcccagagcctgctgcatgggcatgcagctcccacaaacacacaagttcccacacttagaaggcttcatgccttgctgtcactgtcttgaaattctctgctgggcgtggtggctcatgcctgtaatcccagcactttgggaggccgaggtgggtgaatcgcctgaggtcaggagtctgaaaccagtctgggcaacatggtgaaaccccatctctactaaaatacaaaaaaattagctgggcgaggtggcgggcgcctgtggtcccagctactcaggaggctgaggcaggagaattgcttgaacccgggaggcagaggttgcagtgagcagagatggtgccactgcgcgccagcctgggcgacagagtgagactccgtctccaaaaaaaaaaagaaaaaaaagagaaattctaaataactttgtttatcagcttgggctttgggggcaaatctggtgggacaggggagtgtgcacacgacaggggttgcaccaggggcagtgtgcacgcgtgtgcatgcagggccctgggcacggtgggcagcacagacctggctgcgtggtgtgtatctgagggcagtccagggcaccagggggaggctgggctggaaccggggcccaggaaggagttggcagcggtagaagggcagtcatggcagctgcggctcacggggaggagagaccctgcgcatgtcagcagcagcccagggtgggcagctggctggtctgtctgtccccagagcttggttccccagcacctgctaaatatgtgcttcccagtccagggctaggaaaggagctgccaagctcaggcggtacacagtaaattgttacagaatgaaactgtgtatatggacgttagcatagagcaaaccagggggttattagaattcctcaaacacttttgaacctttagatttggaaaacggctgcaacattgcaaagcaaacatccacaagacaaacttagaaattaaatgtaaaggaaatggctgggcacagtggctcttgcctgtaaccccagcactttgggaggctgaggcaggaggatcacttgagcccaggagttggagaccagcctgggcaacatagtgagacctggtctccatgaaaaataaaaataaattagccgggcccggtggtgtgcacctgtagtcccagctacttgggaggctgaggagggaagattgcttgagcccaggaagctgaggctgcagtgagccatgattgtacccctgcactctagcctgggcaaccaagtaagaccctgcctcaaaaaccaaaaagtaaagaacattgtagttgatggaaaagaatactattttcaaataaagcttcaggtgaactgatgattaaagggtaagacagggcaggcacagtggctcatgcctgtaatcccagcactttgggaggccaaggcaagcggatcatctgaggtcaggagtttgagaccagcctggctaacatggcgaaaccccatctctactaaaaatacaaaaattagctgagtgtggtggcgcacgcctgtagtcctagctactcaggaggctgaggcaggagaattgcttgaatcagggagggtgaggttgcaatgatgcccacggtgatggattagaggtggagatctcattaggaactcacgctcagcttcgtacagacacagatggtcacacacaaacacctgcagatgtgtgcagacgtggttaggatgcacacgtatgtcctgttgctctgtcagtggagagtgttgacagctgttgtgagacctcggttcttgtcttcttagtttaaaataatttaaacaagacacacaggagatgcagcacagaggaattcattgcaaaggagaaagaatgttgtggaagtgaggtgcagaacagacaggatgccctgggcgagacagggtgcagggcgggctgctcacaaggatgagaagcagagaccggcctgagggaggctccctttatgggactcttccatgattattcctaaggagctgggaagaggtgttgctaggaagcatgttctgggtggtcctctgggtgcatgtgtgcagtagctgtacacgcttgttcataccattcatgtctcattagcatcttaaatctccacccagggatgtgctttatactattataaggagcaaagggtcagagtgaggacaggtaaaatcaaaatgtgcatgctctctacgggggaaattccctcctgagatagctttgttcgaatgagctcaatgacaacatgaatggggaggcttgttgccttggcccagtggtcactacggttgctgcgaggagatggccacttccttgacaacctctcctgcctcaagagggccccaaacctatggcaccccacagcagcaggaggttgaataccaggctccaacccaaggaccagggacccttggagacatggcaacttctaggactgaggcaaaaaagataaaggtgagtctggagcatcttgtagctccagaaaaaaaaaatctaaaagaaaacaaagcaaagccccgatacatgcagtgatggaaagtatcagaagcacgttgtagggacacgtgagccaaaagaaagcgctcctgggggttacaaatagaacaattcgatcaacacaataaatagagagagtagcattgactctaacccgaactgtaaaatagatatccatgaacatgactgatagaaataagtgatttagtaaataaataaaggaggatcacttgaactcgggaggcagaggttacagtgagccgagatcgcaccactgcactctagcctgggcaatagagcgagactccgtctccaaaagaagtaaataaataaaagtaaataaataaatgggagtggataggcaagtcccccatgcagaagagttcccactaattctgtgtagccctcaccccttaagtgcaggcagcactgggacctccttctgagaatgcagcacgggacaggggaattcaggagcatctttccgtggggaatcctgaaagacacaaacacagccaggagacgggggcagcatagcccgcgaggcacgacgagccatgccaacaggacaggccctcagcatggggtgacgagaagggcatctccctctgtgctcttccttcccacatccacagccccgtctaatcgtgaaaacaccagacagatcctaataagggacaccctacaaacacctgagcagtcctctgaaccctccaggtcaccaccaacaaggagagcctgggaaacggtcaccgcccagaggagcccagggagacggacaagggaatgtcacgtgggaccctgggtggggccctgggacagaaacggaccagcacgtaaatgctaatgagagaagaacaaagtgtggactttagttaataataatgtatcaatattggttctctattttattttattttaattttttttttgagatggagtctcgctctgtcacccaggctagagtacagtggcgtgatctcggctcactgcaacatctgtctctcaggttcaagcagttctcctccttcagcctgctgcatagttgggattacaggggtccaccaccacgcctggctaatttttgtatttttagtagagacggggttttgccatgttggccaggctggtctcgaactcttgacctcaagtgatccgcctgcttcagcctcccaaagtgctgggataacaggcgtgagccaccgtacttggtcattatttagtttttagtttagtttagtttagttttttcttcagacagagtcttgttctgtggcccaggcaggagtgcagtggtatgatctcagttcactgcaacctccacctcttgggttcaagcgattctcctgccttagcctcctgagtagctgggattacaggcgccagccacgacgtccagctaatttttgtattttagtagagacagggtttcaccatgttggccaggctggtctccaactcctgacctcaagtgatccttccgcctcaggctcccaaagtgctgggattacaggtgtgagctaccacgcctggcccaatattggttctctaattgtaagaaacataccatactgaagtaagatactaataatgggggaagctgggtgtaaggtgtatggaaacttgctttgcaatttttctgtaaatctaaaacaattccaaaaataaagcttattaaaaaataatttagactcccatgaaactgatttctttgaagaattaatttttttaaaaaaaatttctccacaagaatcaccaggtctacatgcgctgacatttatcatttaaaacaatttatcagaaactaatcctaatgttgtcacagcctgtaagatacctttactgctccaataacagctgtatcagcacaaagattcttctcaaaggtcatcaaaaattatttgagatcttgcatttgccaaaaaagactgaaataactttcagttatgtcaaaaccgaaaatgaaatttctgaagtatccattttgatgatctaataaatgaatttgcagaaaaaattggaaaaatcataaacatcctattaataaaatattatttattatataaaattctgaatccaaaaattattgttttgtagtttgtaaattggtgttgttacttggcaccactatcacccctatttattgtgtaagtgataaaatcattcctaaaggggaaagctttcactgtggttttttgctgctttttttttgtcccaagacagagtcttgctatttcccccaggctggagtgcactggcacaatcttggctcacggcaacttccacctcctaggttcaagcaattctcctgcctcagtgtccggaatagctgggattacaggcacacgccaccacccctgattaatttttgtatttttggtagagacagggtttcaccattttggctaggctggtctcgaactcctgacctcgtgatctgcccacctcagcctcctaaagtgctggggttacaggtgtgagccaccacacccagccttttgctaccttttgaaccaggagtcccaccatttctgtgtctggcctatctctctccctctccagggcccagctcctcggacccctcccgggtcctcacctgaccctgccacactctcgcccccgaccctgggctgggctccaccacaggctgctgacaaataaacaagagattggcaaatcagacccagcatcagatttgcacaatgatgcatcgtggcaacgaagggttgacatcaagaaagcaaatgtgcctgatattgtaaataataccagacataaatgaggctgcatgtggtggctcatgcttgtaatcccagcactttgggaggctgaggcaggtggatcacctgaagtcaagagttcaagacaagcctggccaacattgcaaaaccctgtctctactaaaaatacaaaaattagccaggcgtggtggcaggtgcttgtaatcccagctattcggcaggctgaggcaggagaactgcttgaacccaggaggcagaggttgcagtgagcccagatcacgccatagcactctagcttgggcgtctcaagaaaaacaacaacaaaaaaccaaaccaacaataaaacactcaccgtagtaatgacagacacgggggaaaacatcatctgttttctccatgttgcggaaaaggtattaataaaccatcaatgcctgatacagtaacaatagaacggcgacagatggagaagcccttcatacagtataaacacaggcacgcccataattaggttttcctgcaaatgtgcacgttcatatctaaagcgaaatcacatctctattcggcaccatgccaggggcggaaggcgcctgctctctaagacaatggttttatagtaacgattgcagcctccacccagagagcttcaggggcctgagctaggggctgtgctgaggagggggctccggtcacctgcggtgtctcccccacccctcccaacgcccaatctcctccagctaggcctccctctcggaccccgggccttgcttgaaccaaatggttcgacctctgcctcttcctaaggctcattcctgagctgggaagagaaagtgaggaaattccttgcagaaaaggagaaatcagtcatcaccttgtgtgttgtgtgtgaggctctcccagcccgtggaggcgggaccttttattccctcgatttgaaaggcaccaaacgcagattctctgcatgtccaaacttttttacaaatggaagaagaatgcataagagcgtaaagcatagcttgcaccccaatacacttttggcttcttgggtttgggccgtctcgatctgagcttgcaccctgctcttcatttccttcttttccccaagctggggggcaccaggctgcagccgtggtcatcgtcccagtgtgaacccccgaggcctgcacagctgcaaccattttctttgtacttaaacacaaacgtttatgttcgccagcgcccgtgtaaactagcagctccctctttccgtctccttgcttgcgttccttcgacgtgtcacctcacagacgccccttcactgtgtcacctcacagacacccctttgctgtgtccatccctccccagaaggttggagccctgagaacaggtgtacctggttttggtcattgttctaccctctggttcaatgacagtgccaggcacatagtgcacacacagtaaatatttgccaaatacgtgcagggctccaagccatcctgagcagctctgggcagaggggctgaaagtctcacctttccctcccgggtttcagggaagagcccagtctgggaagacaggaagccggcttgactcagcagggccgccagggggcactgtggcaagacggcgggagagccgtgtgcccagggttgcaggttctggagcccagaggtggcccaaggcgccaggtgtctggcaaactccaaccgcggatgcaggcgacagccccagtctccaaagattgagtggctgccactggctttaggataaaaatgaagcgggacccttaaaaacacccaaacatggtagaaatacgtgaactggacgggatgcacgttgcgttttgcattttgctttatagcctgcagcagagcaatgcagagggctccaggctcaaacaggctccgtcctggtgtgtttggaactcggggagcagaggagggctgcagggggaagagggcatcgggagaaactcttaaagggagggtcttcccgtgctgtgcacagcccttagtcctgtgccagcggtgggcagctttcatctcgcatggagccccccccggccctagctcccctgcagtgcccagtgcagccctggcatcccgccgggctcccccaccggcccgggccacttccatcttcccacaggagtgggagcctcagggaaggggcttctcggaacttcgcccactgtcgtccctctcgctggacctgcagcttgggccctgcgtgtcttcttatccagagctatttcttagttcctcagccctctgcttgtggttaataatgtttctatttcctgaaacttttctttaatggattgattgaggcctgtagccatctcattttcctggggagttggtcacgcgtgggggagtcccagacacgtggaaagtggctgtagtaactcctgccggtacctggggaagtggggaagaactgccatgctcagaaccgtccctggccactcccgagcaccctcagccttcacctgcctcttgaccctggcgtctctgtccagccagagccccaggagctgcctgtggttgaaaggttgggctacgactcaccacgtggccacacacaccacgggcaccgcggggtcgcaggaggagcgtcaggaagaccctctgtaggactgggctgtggctgggtggttgggggtcaccccgggttggaggctgtcagaaagctggagcccgcatgaccagctggcaaaagtctgaccccaggcaaggcccagctcctgttagcagagagaaggggaggtttggcatttcatggctggcaccgggatcttgatttgtccgtgtttagatgaaattatgaaagggcctcgttctgtctcatctcatcccagccttgaagttgtctgaacttgttttcagctggaatgcaggcaaacaaaccacttccagcccagaccacctccactcccagaccacctccacccgagaccaccccaccccataccacctccaacaccagaccacctccacttgagaccacctccaacctcagaccatcacaccccagaccacctccaccccagaccacctccaccccagaccaccctaccccagaccacctccaccccagactaccttcaccccagacaacctcacccccaggccaccgcaccccagaccacttgcacccgagaccaccccacctcaggccacctccaccgcagatgtcctccacccctagatcacccatccccagaccacccccaccctcagaccatcccaccccagaccacttccaccccagaccactccaccccagaccatctccaccccagaccacctccacccgagaccacctccaccccataccatctccaacaccagaccacctccaaccaaaccacctccaccccagcccatcccaccccagaccactccaccccaaaccacctccacccgagaccaccccaccccataccatctccaacaccagaccacctccaacctcagaccatcccaccccagaccacctccaaccaaaccacctccaccccagcccatcccacccaagaccactccaccccagaccaccccaccccaaaccacctccaccccagaccacctccaaccaaaccacctccaccccagcccatcccaccccagaccacctccaccccagaccacctccaccccagaccacccttacctgatggaggttttggggctctggaaagctgccttcaaagttctctccagcctgggccccctggcccgccccctccactggcgtttacccactgctgcctctcgctccccaccgggaccgaggacctggcctccgctccgcagctggggaggggtcttccttagggcactggcaggaggcccggggtctgtcctggctcttccctggttgttcctcatggatcagataattctctcctgcttcttccccgacacgaagcaataggctcatatccagcagctcagaggcacggtggggggtagggggttgaggggtgtctcgcacccctgggcccaggtttcagagaggcagaatctgccactgcggctgtgcccacgtccaccctgaccccgaccctgaccctgggcatgaaccggcagcaactcgctctcaggagggtggggaccgccgggacggacctgttccctccttccctccctcccaggggagctgaggcagcaccctggacccccgagctgggggtcggcagcgccgtgaccccatctgccccatttaccatgggctgcaagatggggctcctcctggggtcctccacgtgtgtttctggggcagcacatcaccggagtccaggacaggctggggaggcaccagtagccccagcacccttgctgcaggcagggcaaccgctgagactccaggggctgcaccactgccctgtggccgggcccctcccctccttctccaggtccctccaaaagtgctggggatgggcacgggggaagtgacaggactcctggctctcccttcagtggctgaggacccccagtgcccacaggttcagagagggaggtctggcgggcgctgcggggcagccccgacctggcacccaggagaggagccccttccgcgtttcgacgctcccacccacagcacagagagacccgccccagcgctggacattggggtggtcagtgtgtccggccgcaggcacagctgcactggtggctgctcctctgtcctgttttcctgcccatgtgacctggagccgctgtgccaggccttccaccaccaggttggggaaacagcagcagaaagaacccccgagatgcccgacaagcagaggggactcctgaggatcagggaactgccagggctgcgagctctcccagttgggggggatcctcacccacaattcagctcctgtctcccggcacccccaaccaccttcacattgtcaccagcaggggcctgatacccaggtgggaggttcaccccagaggctgcagtctctggcaagacggggtggggtgcatgtgggcggcaagccgcccaggtgccgaggcaagagaccgagggcacgagctcttccagtgtaatgaagaaaatatatacaataagaatagttatactagatatagatcatagatatgattatatacgaacattattaatcattagtttgtagcaattactctttattccaatattataataatcctcactgtataatcataacctaggaaaaaccaggccatacagagataggagctgaggggacatagtgaggggtgaccagaagacaagagtgcgagccttctgttatgcccagacagggccacccgagggctctttggtctagaggtaacgccagcgcctgggaagacgcctgttacctagcggactgtggtctggcggtaacttcagtgcctagaaaaggcacccgttacttagcagaccgggaaagggagtctcccttgccccgggggagtttggagaagactctgctcctccacctcttgtggagggcctgacatgagtcaggctcgcccgcagttatccggaggcctaaccgtctccctgtgatgctgtgcttcagcggtcacgctcctagtcctccttcaggttccatcctgtacacctggctctgccttctagatagcagtagcaaatcagtgaaagtactaaaagtctctgatatgcagaaataatggcgtaagctgtctcctctctctccgcctcggctgccaggcagggaagggccgcctgtccagcggatgcgtgacccacgtgaccttacctatcattgcagacggctcacactccttaccctgcccgcttgtcttgtatccaataaataacagcacagcctggcatttggggccactacctgtccctgcgtcttggtggtagtggtcccccgggctcagctgtcttttcttttatctctttgtcttgtgtctttatttctatgatctctcgtctccacacatggggagaaaaacccacagaccctctagggctggtccctacaggtgcaaaaggtgtaggactctccccttccccagagtcacagggaaccccggggcgctgctttgttgcatgagcattgtccagaggggtgtgggggtaggagtgagacatgacggagcccggcccagctcggcgacagggtggtgaggtccagggtgccaaggttttaaggcacccaccctgaaaccgaggctctgggacccattcaccatgatgtgagtgaccctcagggatagcagagtgtggggtggacccgggcggaatgaggcaggtgctccagggacccccataggacacctggacacctgtgtctccccacatgcgccagcttcagtgcctgggaggggacacccctggctgccacggggaatccactaggaggctgtggtgtagagaaaatgatacccctccctgctccatctctctggccagcgcttctgcagagcagcagaggggctggggtctctgggcacggccatgcagagtgggctccaccaacacctccggcttctgctggaggcttcctccccttggcccgtcgctcacccctttcctgagtgacacagcaggacagggggtggtgggccagtagggaaggctgcaggcaggaacgcccacggagcagtccccgggctctctgttacctccaccacccaccctggcctagggcctgaggactgctgggcttcctcctgcctgggggtttccggtggtcaagtccactgtgcccagccgtccagaaaacaggagccacctgcccgtgtaacacggtggggcttttaatccacaggagcctcaacacctgtgctcctgggacttcctcttttagggggaacatgtggaaccttggtcccttcaggaggggcagtccccacccgccagtcgcccagggcatcaccctctgagcccctctcagtccccagtgtctgagggtgccaagggcctgcggttcctgtctcaggcagttcagcactgctgactcctctggaaagagctcccctgaccgtgggcttccataaccagccgaggtctgcatcgtcagtgcgggcacctggtccaaacccgttattctaaatttgacaagagaacaggggccactggcctgcttttcactggtgagctgtgtttcctggacccattattgatgctggggtctaatgacattttctaaactcttacagcttgtattaaaatatcgaaacctgagtcccttgatattgaggaaagtggtcagttagtcaagccatagagttggacagtagatgcttgcccgtcatcaccaagattgttcattgattttgaagcaatacttcaggattgacaaatgatagcagcctgaaatactgtgtgcgcctgtgagtataatgaacattcggtgagtgtgtcaatggtaacatctcctccctacaaaagatcatagtttctcaggtgaggtggctcacgcctgtaatcccagcactttgggaggccgaggcaggcagatcacctgaggtcaggagtttcagaccagcaccaacatggtgaaaccccatctctaataaaaatacaaaaattagctgggcatggtggcaggcacccgtaatcccagctactcgggaggctgaggcaggagaatcccttgaacctggaaggtggaggttgcagtgagccaagatcacaccactgcactccaggctgggagacaagagtgagacttggtctcaaaaaaaaaaaaaaaaaagaaagatcctaatttcttatcactttctaaaaggtgggcgatggatttcaagatgagctgttctcaacactccttctccttctggaaatccttcagtcagcccaccttggcctctgagctgcctggctgcggaaggaggctgagagatgtcaccagaggatgcatttcagcaccgtttgcactaagatgtaaagaccaaaacacttttcactaaagtgacttttggaactttagatgacattatatttaaactttgtatcttagaggtatttgttttaagcagaaatatttacaatctagctcatcctgagaaccagcctctccacagcaccgctttccaatgcgaccacctttccagagaggggcccacctgtgggttgtggaaagttctttgcattttcttttttcttttcttttcttttttttttgagacggagtctcgctctgtggcccaggctggagtgcagcggtgtgatctcggctcactgcaacctccgcctcccgggttcaagcgattctcctgcctcagcctcctgagtagctgggattacaggcgagcgccaccacacgtgaataatttttgtatttttagtagagacagggtttcaccatgttggccaggatggtctcagtctcctgacctcatgatccgcctgcctcggcctcccaaagtgctgggattacaggtgtgacccactgcacccagccggttctttgcattttctaggacgcagagcagacctgtgtgctgagacctggcacggatgggagccctcttggcacaagaagattgacagctgtggtagaaggtgctgtttcttgccaggagggcgtaacatagagccatttctgattatcttttaccaactctcactcctaatgagaactatttctcatacctaaaagcaagttttactgcctctatggtgaaaatagtctagtttaataatgttttctcttgggacaatgatgctttgtaaatggaaataacacagattctgtactttgccccatcttgtttttctttctttctttctttctttttaggcagtgagacagactttattcagggggactacagcaatgaggttttgcggcagggaaagaggttgcagcttttgggtttgcttcatgccttggacacacagtaacttggaattcttgcacttacaattttttgaattatgaaagtaatacatgttagtggctaaacaagaaaggaaggcacggccgggcgcggtggctcacgcctgtcatcccagcactttgggaggccgaggcgggcggatcacgaggtcaggagattgagaccacggcgaaaccccgtctctactaaaaatacaaaaaaattaggtgggcgtggtggcgggcgcctgcaatcccagctactctggaggctgaggcaggagaatcgcgtgaacccaggaggcggagcttgcagtgagccgagatggccccactgcacaccagcctgggcgacagagcaagactccgtctcaaaaaaaaaaaaaaaaaaaaaaaaaaaaagaaaagaaaagaaaagaaagaaaagaaaagaaaagaaaagaaaagaaaagaaaagaaaggaaagcacgaaggaaaatagcaaagggtcccggtgttgcacacacacaaagcagcagcagccgctggaggtcttccgtgtttggtaaaggtggctacggactcccgcatggagacgcggcctggagggtgtcactgctctaggctgtctgcagggcctctccgcagacctggacggatttcagtgggagactagagcgtcacttaagatgtttgaatgtaaaagcatcctgaatgatcatcttttagcttgagattttggctacctttcaaacagacatagtttgacctttgcagtcctaggtaatgcaggaatggcaaatgctcctgaaggcggggaggcggcccggcccgcactgagcttctcaccggccagagggcgcagccacccggccttcccgaagcaggacagcggcctttccaagaccgcggagtccccgtgagggatggtgcctccggagcctggcatctcgggcggatgagaagctgagcgcggtcagatggcccgcagggtcccactgcgggccgagccctggctgggggacagtttggggggaagcagcagctgcctcagtttacagtggcagccggaggaggacctgggcagtggcgagtgtggctgtttgcatggcggggagaaagaggtggtccctcctgcctgctgctgatgcccacggcctcctgtccccaggaaaggggtctgcgcccctcccccaccggaacagcgacagaagaggcgaccctctcaaaggcccttctgctgctcaccgcggggtgagtgatggtgtggagcaggatctgggtccaaggtcttcttccacgttcagggttcccgtggtaactgaagaattatccatccagagaggcaggggagggcctgggacagggatatatcttattattgataagtacaattttaaattttaaattatcagcaggaccgtaggagatgacataaagaggaaaaataacctgtgtggcgctctcagcataaagcgcccaggttcagggatgcgtgtgcgtcctgctgtctgctcattcgaagagcaaaggaagcagggatgatttagggcctccgaggtgacacggaatcgggaggaatggcgccacgagaaagacgtctttctcattttgtgagcagagagcccatcgttcaggaagagcatctgagccacaaagctaatcacagatcaccgagccagcgccggctcctgatttgtctgtgtggctccaggtggcaggtgctccacggcactcagtaaaaggtgcatatggtgaggggtgcaggcagtggccaaacaagggcttccctggatcctggagtggctccttccagccacagccaaggctgctggagggaagaccaggccgagggcacgtcttgcgtgctctcactcacaagcacacacctgtatttaccatgttatgtacacccacagaatcatctttaagatcttgttaatattaatatataaattgaaggtcggaggcagtggctcaagtctgtaatcccagcagtctgggaggccaaggctggtggatcacttgaggtcaggagttcaagaccagcctggccaacatggtgaaaccctgtctgtactaaaaacacaaaaattagccgggtgcactggcacatgcctgtaatcccagcttctcaggaggctgaggcaggagaatcgcttgaacctgggagtggaggttgcagtgagccaagattgcaccactgcactctagcctgagtgacagagcgagactccatctcaaaaaaaaattaatatataaattaatatgagtaacatatacacatacattaataaaaatatacaaaataatacatatagtatataataatatatgctaagtataggaaatatgaataatataaataaaaagattatgaattatgcattaaatattaaataatattaatatgaatataaatatttattatatctatctatctgtatgtacctatatagacacagacagatatctatctctatagctagatatttctatctctgtacacactcatctatatccacatgcatgtatatgtaaaaagagagagagagcagagacatagagagatttatttcaaaggattatcccgtgctattgtagaggttggcaactccaaaactcacagggcaggcaggaggctggtcattcccacaggaactgctgttgcagtctacagcctgaagggagaattccttccttcttgtgggaactcagtcttttccttttaagaccttcacctgattgggtgaggcccacctgccttcctctgactggatgaggcccacccacattgtcagagggacatctgtttcactcaaagcctactgatctaaaatgactttgattaaatgaccttcacagcaacattcagactggcgtttggccaaacagcctggcactgtggcccaacctaggtgacgtgaagctcatgacctccctgtgcctgcagggcgctgtggcactccatccctcttctgtgtcaaagagctgtctgaactgctccagcaactctgacacatggggacgtcctgtcctgaagggatgggggcatgctaggactggtttgcgaatctctccataaatggccttgctgtctccagcatgagagaaggttggagcgtaaagagcagatttctgcggtgtcccttgtgcttcctgaaaggagtcccacactcaagctcacccccacggtggatgtgctggaccaggaccctggggtgctcggggcccgagggtgccaggattagaacctccacacccagaggttcctgcctggggcctgcatcacccgtggcgtctcctgcctgccccggattcctcctctttcttccctttgccgttttttctggctcctttagctgcaggtccacagctggcttttctccagctctcctgcatactggctgagaagggcacctatgtcattgttgctggctgtttgcgctgctgtaatgcaatccctgagactgggggatgtatacaggacaacactgatttctcatagtcgtggaggctgggaagtccaagatcgaggcactggtaggttcgtgtctggtgagggccccagtctgcttcatagctggtgcccttggctgtgaccttcagaggaggtgaacgctgtgtcctcaagtgggaggcagcagaagggcacatccagcagtgaggctgttgctataacaaatacctacaactgtggaagcagctttggaactgggtaatgtagaggctggaggatttggaaggtgcatgctagaagcagcctagattctcatgaccacagagaatcaccactaagggtgattctggcaggtcctcggaagagggtgctgcggaaaagcccagttctcctcacacttaaatggttgtgaacagaaagttagtagaaatatggagagtgaagactattctgatggggtcttagaagtgaggatttttttttctttgagacagggtctggctctgtcacccaggctggagtgcagtggcgagatctcagctcactgcagcctcagcctcctgggctcaaatgattctttcacctcagcctcctaaatagctgggactgcaggctgccctaccccgccctgccacctcacatggcagctgttctttattcataatccccactgtctgtctctgcttctcttctccctttctcttctctctctgtcttttggggtttcgtcatgttgcccacactggtctgaaatcctgggctcaagtgatcctcccacctcagcctcccaaagtcctgggattacaggcgtgagccaccccacccagccagaagtgaggaatatcttactggacgctagaggaaagaccgaccttgttgcaaaatggcaaagatcttggctgaattatgtccatgttcaagtgctctgtgtaaggagaagtttaggagccagaagctgggacattgctaatgctgcatggagcctttttcagaggagtcttaatcccattcgcatgagaggaggccttcctcaccgcctactcccctcccaaaggcccggcctgttacatttcattgcaggaatttcggatgggatgcattcacaccaaagcgtcaccctcctgagtacctctctgaagccaccttggagcctgggctcccccaggcatgggacagcacaccccgtccactggagccgaccctgatgaatgcaggctcactggctttgccaccgcatgcccccggaggcatcagacgctgcttgtctctgctgcctttgaaaggtgtgcgtggagtcgcaggcctgaactacatgagatcgagacggaaaccccgccaggcaccaactaacggatgcccaggctggagtgaccctcctcctcaccctggcagcagagacccacgttggccatcgagaaagaaccgacgcctagcgagaagtgacagggaacattcaggatcccccgcctgcccccgtctggaccttgagatgaggaaggactttgtcgtttttgtcactttaaccgaatcttggacaatcaccgcccaaagcgtgcactctgtgggctgtttaaaaaattatatgcgcacagactctaaaggaaaaaccagagacaaaccgctcatattccatgaaccttccttctgcataaaccgccacgtgtcgcttggcaaagccgtgggcctggcagtggggttagcctttcccactcaggaaccgcgctggccacgtttctgccggcatcagcgcccctgagctgctttccaaagcgcggcgtcaggaacgtcactcttcactgttgaattcaacgtgggcacctttaatggctcagtcatttttttaaaaaaaatcaaaattccacgcaggggccttggttccagagctccctttccaggaggctgttgcgcgggctggccaccaggtggcactgttgcatagcaaaaggaacgcggctccgcgctggagaaccgggccgggctgcgcggaagccctggagggccagccgggtggagggagctgcaggagggggcggcgtgctttccgggggtgcaacttggttttccctggagggataaagctctcctttggcaggtgcctgggggtgccctttaaagcagggagcccagggaagacccagctctcttcctgtgagctcatccctggcattcagggtgaaggacctgcagcctggtctcggaaacggccctccaaggcctccttgtcccctgaagcacacaggcagaccgcgggtcggggtgcaccgtggctgtcccttccctccaatgctgggcgacccgggcgggtggccaccgcctgacctgggcctcctggctgccagcctgcacgccctgggtgcagaggcaggcgagcctggcctggtctgaacagtcttatgaggattctctgggcccgtgtgctcccgcctgcccctgaagggcgtagtggaagcatccgaacatgcactgggtaccctcgtggcctgggacagcccttccctgctgggctccttgctttgtgttaaccctgaggcctgggagcctgagttggggaaacgggggactccagacaacacccagcttggatgccggcgtccacttctgctcagagaatccagtcaactcagggctttgggctttcccatgaccaaagaaaagaagtcagtgaatgagaatcaaataaaggaaatgattttctgccaccaccggggcgcagacttgctgtccataccactgtccctggctgtagcacccatgtgtgcctgtgtgtccagaggcccacggagcccagatgggcctggggatgatttcagcctccaaggaggccgcccatctcttccggtggcccctgcttctcacccagtgtgggccaggcccacctgaatgctgagggcaaggacgagtggtcgttacctaaacgagccagagatggcctctggggactggcccttgggtcacttatttcttccctgcaggctgagctcattagttcaagagcccactggcaccaaactcagatttttatacattcaattgttttaaaaatagccccaaacaagcagactttcagccatttagagcctgcctgttgcatgtattctgcaaaacctcacctggcagctgttcgctattcatcatcctcactctctgtctatctctctgagtccatctctgtctctgtctccatctccatctctgtctctgcctctgtttccgtctctgtctccatctctgtctctgcttctcttccccctctctcttgctctctctcccttctctctccgtctttctctgtctcttgctctctctcttccttctttcccccgctctctccctttctctcccctttctctcccccacccctaccaccctgtctctcttatctgtatgatggggaatgaaggatgcagcaatggccgcccatgtgtcggtgggagctcacttccccaagcctttacttgaggggactctgaagggcttcatgtcgcgtcagcttgtgatacgcacaagccgactgcagcagacacagctgggccctgtgtgcacatcttcgcccacctcgaggtcacctgtggacaccagcatggagtccagcctgtggggaaggctggagtcagggaggctaatgcccttctaggggcaatctgtactaatgaaagagaaataactcagaggacaccatggcgtcccctgcagccttgcagagggtccccagcagctgttcctgcactgaggcctccttggcctcctcctccctcttccctgcgcttccccgaatccgcccccaacccgtgagctttgccctccagcctttggctcagtgtctgtttttgaggaaacataaactaagataacagccttgtgatttcagggctccctgtgaccgcagcagggcctgggttatccgggcggatgcagctgtccacagacaggcctgaggctgggcagggggtagggggctgtggcctgcgtgtgcctctgttcccattcccgtccccttcttccttgaggagcacacgccttctccactgtcacattcctcctgcatcaggagccccctggaacccgcggcttcgggtctggtgcaccctgtggggcctcatgccacttggtgtcacgtactcaagagtttattttcccacagaaatttaggagaaagtagggattgtttgtagtcaaaggaagaagtgttcctcagtggatggagaaggcctggctgtgctccaaggccctgggccctgcatactcatctcctggggcttcctgaagctccctgtggagcgtgagcctgccgggccacctggagcacagggggcctccagggacagtgggggcactgcgggccgggcccacgagtgggctccttcacctgggcctcccccagggctgacagccccttggatcccagggaaatgcgtcccaaccacagaatgaggtgctgctggggtacctccttcctcgagcaggacagccagtcatggtgcccctctctgagtggcatgggcatccaggtagaagagtgccaggacatgcctgggcagcaccctctgggatgccacgggctctatccccagctgcccgctgtgcctcattctggggttgatgggtgccagggctcccgcatgctggaccagcagggcaccctgcaaggtggtgccgccttgaggcagtgccaggaggtgacggctcgcccacacaggctcccgaacatcagggatacgcagtaaagacaacctcattctaatgttctgtctgtttggatagggacaaacacagcccagatctcagccccccggcagacaccagacaccgcaatgatttgctccagcaagccaactgtcccggagcggtagctgctggagtcctgatccaactccactattgtcattcctatacccaggtgtgggcgatctgtgctgttagacctggggggctgcaatgggtgggacggaagcctctggacccccagtccctggtgtagaatggttcctgggagtctggaagaggtgccatttctcacgcgcctgtcggggatggactgacagctgcaggacccacctcgccgcttctagctgtgggtccatgcagccaacacagaggtttgtggtcactgaggacattcgtgcagacactttgtccagtgcccgaggggacagctgcaggccagctgtagagtccatgcaagttctgccctgagcggtttgcattgaaatccaggcagtcgtctgctctccacacacttccactctgactgggagggggccgcagtgtccttcaaccccatgggtcagcgtccacaggccctggatgatttaggcagagttataccagtaaaagaccacagctgtctggggaagccaggagcatgcctggcacccactcagatgctgccctggcagcagccttgttcagggtcccagtctcctgcacatccgggacgctgagcagggctggctgtcaagtggggctggctgccgtgctcacctgccttctgctgctgggggccgggggactgtgcttcttcgcctttagtggtggaaggaaaatactcatgtaacaaaaactatacacatgaagtgttttcccccaaagaaacaagggtgctagccggaaagatgatcagctgccagaaaaccaaataaaatagcaaaccttctctataggtgcccaagatgcccttgacaaaactccaaagccactcatggcaaaacccaaagccaaagagagatgggaggaaactgctcaaacatgaggaatcgtgcttctcaggagccagtggtgaacacgaccttaacatatgaaatgcaaaccactgtcattcgaatgagaactaacgtggtccccgtcacccccatcatttattttggttctagccaccgcaggaggatcacagaataacacaggccatgtagggaaattgcagcctggccgggcatggtggctcacatatggaatcccagcactttgggaggttgaggtgggcagatcacctgaagtcaggagttagagaccagcctggccaacatggtgaaaccccatctctatcagaaacacaaaattatctggccatggtggcaattgtctgtagtcccaactgcttgggaggctgaggcaggagaatcacttgaacccgggaggaggaggttgcagtgagccgagatggtgccactgcactccagcctgggtgacagagcgagactccatctcaaaaaaaaaaaaaaaaagaaaagaaggaaagaaagaaagaaagaaaaaagaaaggaaagaaaggaagaaaattgcagcctgcctgagtggggtgtcctgctggtgaggtgagtgctgctggggtctgggcttgttgctgacatatgccttgagaaaggtttgaatagggccgggaacagtggctcacacctgtaatcccagcgcttgagaggctgaggcaggcaaatcacttgagatcaggagttcaagaccagcctggccaatatagtgaaactccgtttctactaaagaccccccccaaaaaaaacaaaaaaaaaacaaaaacaaaattagccgggtgtgatggctcatgcctgtactcccagcttcttgggaggctgaggcaggagaatcgcttgaacccaggagatggaggttgcagtgagccgagattgcaccactgtaatccagcctgggcgacagagcgagactccatctcaaaacaaaacagaaaggtttgaatgttcctcagccacttgagtggcccggtctgcccaagtatgagagatttccagggatgcagggctttcaatgctaagaatcattttaaaaaggcagtctccgggagtgagtgggtcgccctagcggctgtgactggtggcgcccttccccgcccctcaccagccctgaagaaactgcccctcatttttgtttttctttgcatttgtgtgatggctgctaactttcttgcatgcacattggccatgagtgtttcctgtaagatataagtttcctgtgtgtattatttgcccatatttcttttcttttttttgagacggagtctcactgtgttgcccaggctagagtgcggtggtgccatctcggctcactgcagcctccacctcccgggttcaagcaattctcctgtcccagcctccgaagtagctgggattacaggcgcccgccaccatgcctggctaatttttgcatttttagtggagacaagagttcatcatgttggccaggctggtctcgaactcccgacctcgtgatccacccacctcggcctcccaaagtgctgggattccaggcatcagtcacggcacccagcccatatttctacaaagattttgtcttcatcttttaagttcagaatgtaaataccctgtggctcttccatcttgttttgggccttagtctgaattgcgccctgtcaccacaaggtgcatgaacaagggcactggcactgccttcagtgtcacagaaacaacaaaacgatgccaaacacacgacgtgaaatgctgagatctccatcaacaggtgaccgccgaattcacgacgatccaacgtaaccgtggaagctgatggaaaaaaggaggtgcatatacatattgatgttacaaccgtcccatgttaggctgggcgcggtggctcaagcctgtaatcccagcactttgggaggccgaggtgggcggatcacgaggtcaggagatcgagaccatcctggctaatacggtgaaaccccgtctctactaaaaatccaaaaaattagccaggtgtggtggcgggcacctgtagtcccagctactcgggaggctgaggcaggagaatggcgtgaacccgggaggcggaggttgcagtgagctgagatcgtgccactgcactccagcctgggtgacagagcaagactccgcctcaaaaaaaaaagaaaaaaaaataagaaagaaatctgcaggtttatgagcatgagcacagacagtgggtgaaacagacactaagaggtgttcacactgacagcggaaggatcaggacgagaaggggttgggggaagtttttcgcttttaatttttgtaccccctattgtttacccagtaagaatggtcgggtattccttttataattaaaggaagtaatccattgaagaaaataaaataaataaagttgaaaaagatgcatgcctattgtgggcctttcttttaggtaaaaataatgtctagaaaaatgaaaaccaaaatttctaaccatactttttttaaagaaagaagttggtaaagataaaaacataaattaggccagactcggtggctcacacctgtaatcccagcactttgggaggccgaggtgtgtggatcacaaggttgggagattgagaccatcctggagaacacagtgaaacgctgtctctactaaaaatacaaaaaattagccgggcgtggtggcgggcgcctgtattcccagcaactcaggaggctgaagcaggaggatggtgtgaacccgggaggtggagcttgcagtgagccgagatcgcgccactgcactccagcctgggcgacagagcgagactccgtctcaaaaacaacaacaaccacaaaaacccaaaaaacataaattaaagaaatagaaaagaagagctgagcatttcacaaacggagagcaggtgtctggtgtttggtgtgttccggtcgagtgtagtcaggaaaaggaagccgcgttgtctgcggggcgggggcctgtgcttgtggctgcagcagccccttcccatcagataaggacattgttcatgcgcggactggcacccaggacaaaaacaacacccacaaaacctggtagccccacttaatgttcccctgccgcggcggctggaggatggaattaccagaagcaattagacaaaggaggttcagaaccacaggcatggaattaactaactttatttaagatgacatgtggagagactggaaggacaccttcgctctgtctgggaagccgtgaggctgagggggctgtcccccgcccgggtcccgtggggagcccatcttctaccaacccatcccaggttcagcagggtctcttgcttttgttcggagcgcagcaggaggccactgaggtgcccacaaaggggagagatgggaggcagaccatgttctcagtgaccactgtctctgctgtgtgatgaggggttgtcttggggaggaaagaatgcatgtgaccggcaaagctgcagaaactcagcttagaacaggtcacaatcatggtagcaaacactggggtggggaagtcggccctgactgagaggccaggatggatcccaggtacgtctctgaggggaaaggaacagggcccgtcacgagcaggaggtgccgctgaggaaaagcaagtttctgatgtgactcctgacttctcacaatggggcgtggcaccagcaatcagaagggtaaaggctgtgggtcgaatcagaaggtgcatcatacgtatgccgagatcagacgcctgtgacacggccaggaggtgtgcagaacacagcccatgatgagactgccccttgggcacagttagggactgcaggatcatatttaaaatttctggtgcacagatgttgtgtaaagagactgggagagcgggagattgggagaggggaaggagaggaggagggggagaaggagaagagagaaggcctccaggagcctcagagctgatggacgcggagaagctgcgaagcctacacaggggacagccgggagggtaggggcagcaggtgagaggagagagggcgttaagctggacggggtgagctgtgcgggtcaccacaggcgcagagggatgatgagcacagaacactgccttcgggggcttgggtgaccacgaagacgtgtgtcaggctggagaccctaccctgcttagaagctgaatgtcagtctatgactgtctcatgggtaccaataaacatactccccatggccctgtcccactctccacggccctgtcccactccccacggccctgtcatactccccacggccctgtcaaactccccacggccctgtcatactccccacggccctgtcaaactctccactgccctgttgcactccccacagccctgtcgcactccccacggccctgtcccactccccacggccctgtcacactccccacggccctgtcccactccccacggccctgtcccactccccacggccctgtcacactccccacggccctgtcccactccccacggccctgtcacactccccacggccctgtcccactccccacggccctgtcccactccccacggccctgtcccactccccacggccctgtcccactccccacggccctgtcatactccccacggccctgtcccactctccacggccctgtcccactccccacggccctgtcacactccccacggccctgtcacactccccacggccctgtcccactccccacggccctgtcaaactccccaaggccctgtcacactccccacggccctgtcacactccccacggccctgtcccactccctacagccctgtcgcactccccacatcccgtggcatctggctgtacatggaagtgaggaagctgctgtctcccccaaagaacattgctcccagccagggctcagccctgtggggcaggactcagaggctcctggttcagagaccagggcccttgtcacttgcagcgtgaacagcagggaactttgcccccgagtcccacaacagaggtggggaccttgtcacggtgggcccaggtgtgacaacacagggccagcgattcttcacccggcagcaaacactgcagcagacgacaaacattgcagcccttggcaaacaaaaagcacgcagcaaacagcgtggtcagcgaaaagaccctcccctccccggggatcagacagtgcaaggccatccccgggatgacctgcacccacccggctgcctgtgtgaccagccacagaacccactctgcattagcacccacggccaggacaggcagggtgctgcgcccgtggcttcctgcatctgccgacaccacccgaggctgccaggccacaacatgaagtcagctgtgccaggaaatcccaagcctcgcccacacctggccccgggctgttgctgcatgccaaggggttgcccacctggctgtggctgccttaccccatggaatccaggctccaactgacctcaccattctgtgggttaattttcattcttaaaaccttcatctaaagacctttgcttcctggaacacaggcctgggttttcccaacagtcgtgggcacccggcctggcacgtgctgctcagtggagggacctcacagcccgttctatgtgagctgtgcaggaaaagctccacggacaaactcactctccgtgacaatcaggaggtttcttctccaaccacaagaaggagctgggggagctcgtgaggccaggaagagaacagtcctaatcccatccttcccctcctcagcagtgaccccagggtctgctgtcctgccccaacccacacttcaaagaaggaaggacacctgccttcccctgctacctcacaccccgaagcatggggagcatggggacccttggcagagtccttttgtagtgaagaataacagactagtgtaaaatagcagaaaagaagctaatggccaaacacatccaagctggggaaaacacctgttaaatataatgacagaatatgctctcatcaaaacccaggaaactttaagaatacactaaacctcacaaaatgggggcgaaatacaatgatgaccacacgtatgagaaatggtcaatggtagaattgaaagaaatgcaagggaaatgaaagataaggggtcctttccaagcaaagtggcaacgccacaacagctcgcagtcagtcttggcgggacaagaatgctgggcagtgctggtttgcagggaggggtcaacttttctggaagcagcccagcaaagtgccccacgagccatcaattattcctgtgcttcgcagccacagcccacgaatgcaggtgcagccacagaagcgctggcagaggggaggctgagagtggcgctggttgaagatttctcacaggaaacaaaaggcacagcctccacgtggctcatggccatgaaaacccttgactcaaaactttccacgtcgtgaggaagacgcgggtcagctgccctagttgggtgatgatgatgctgtcagggaaagcgtctgtgcctatgtggggagagtaggggagtgagaaacaaagcaaagcgtggtggctctgtggctccagtgccccggaggccacggctcactttttcacaatgaacatgggctattttcattttttaaagtctactaatgtttctaaggagaccatacagaaccgaaaattctgaataaccttgtcttccataaggcagacttttcatttctgtcacctttccggaagggctggacacagagtctgtgggtctgtgatggaggcgccaccatctcaccccgagtccacggccctcagtctctgtgctccccgagccgaaggtgaggaatccatgccttatggttggcgagggctgctggggcacctgccatctcatctgcatcctgggaagcaggaaggagcacagaggaaaacacaagcctgctctggccagctcagtgtgctccttccagaaacaggtaaacacaaaattaccctgcgaagccgccattccattcctaggtctatccccaaaagaaatcaaagcagggactcaaatacttgcacagcccttgccacgacctggatgtagtcagtgcatctgttcccagcaaaactcttgttgaaacgggacccccagtgtggcagcgtagggaggtggggcctgaggggagggagacgtgtgggtcgtgggagtgactccctggggagtccgtggtgctgggagtgattctcctcttgtgatacagggtgagttcccatgggaatggatttgttcccatgagtggggcttgttctgaagccaagacatccctgagctttatctctcttcccgtgtctgcttcccctttgacctcctccagcagaagccagggccatgccattgaacttctcagccagcagaactgtgagcttgatgaattaccccatcacagaggttcttttatggctacacagaatggactcagacacccatgctcacagccgtgcagtcacaatagcccaaaggtggaaacaacccagcaggtgaggggatctgaaatggggtagacaaacacatcggggtcttacggagcctggaaaaggagtgtgctctgacgcctgcagcaacgccaccaaccttcacagcctcgtgccgagtgaagccagccagtcacaataggaccaatgctgtgaccccacagatggaaggcccccagaggagtcagattcaagaggaagatggcagaatggcagtcagcagggccagtgacagaggccgatgggagtgagtgattagtcaggacggagctccagtttcgcgcgatgaaaaggtgctggagctgcatggtggcgacagtggcacagccacgtgcaggttcccaatgccacggaactgtgcacttaccatggggatggtgggaactctcatgtacccgcatttgaccagagaggaaggaaggaagggaggggggagggaggagggagggaggtagcagagaaggaaggaaggaagggaagggggagggaggagggaggaggcagggagggaagaaggaaggaagtgagggagggaggaagggagagagggatggagggagggaagaaggaaggaaggacggaccagcctgttaggctgactgacagagtaccccctgtcctccaatgctgcccacggcaggcatgtggcagtggctgacagggagtgagtctggaagcgacccttgtcggggcagcctccttggtcctgtgattcaagacagggtgaaagtcagtggcggccattggtgcctctggccggggttcctcacaggggcccgcaaggggacagcgaatggagcgtggagggtggagggctccttctccagaccggagcgatgggttcgggagccattctgtgcctgtctttgctgctgggctgaggagctggatggcatgctgggagtagtgggagctgctgaggagtttggtcctggagcgaagaggctgaatccgcatgtctggagtcaccgtggagggcacagctagagggagcagcagggtgtcccagggagaagacaccagggctggaattagagggacatcaaggctgatacttagaggcatccaatatatggggcctgcctgatgggctgctctcaggtgggatttggggggtgtgagaggggtcagtgcccaaatgaccatggggtccgtggcctgtatgcccagtcaggtgacgacgccattcagaaagtagatctcatggggtgcccggctgctgagtctcaggccagatctgcagtgagtgtgctgccccaggcgtggaacactctggtgccatcgggacccaaggctgagtgcacccaagagctgtgggtctgaaacagcggtcagaggtcactgacatgtggaggaggcccctggagtgtgggagacagaatccccaggtgtcaggcttggcaggaggctttgcaggtggggaggaagggcaggtagcgtggctgccggaggagggagggcactggtaggaggagggtggcctgtcccgggcagaccagcctctttgggctgtgtggccccagctccctgagcccagagggaggtgagggtgagaaggcctggaccaggcaggacgcagcccccagggcccctgctgggaagaggtcagaacctcccaaggacccagaaggccaggtaactgagaacggggctgctctctgaatctccagggaggacaaaggcggccatggcagcaaggggacagggcagagggaaaggccggcaggtggatgttggaagccgcagattcccatccagtatcctagaggaggagacccagggctgtgtcctaggaggcccaggaagcctggtcagcctggaggctgagggcgggcccgggagatctggtaaggacatcagtgtctccacgaagagcagcagggtctcagcccatggcagccgcaggccccatgactggggccgcagcctccagagccgccacagcagcccgttgttctggggggtcaaaggtggaggctgtcagaggggcagtgcagggggctgctggggtgaagccccctgtagcagcagcacccagcctgctgtggctctgccctcctggaccccctgccctcctggaccccctgtcctcctggaccctctgccctcctagaccccctgccctccaggaccccctgccctcctggaccccctgtctgtggcccctgctcctctcctccttccccgacacatgactggaccccccgatctgcagccggggtctgggcactgggggtcctgtggacctctcggtgtctggggacaatcacaggttcccgtgcccacacccagcctctgcttccagaacacactagagggtcccggcatcctgatgagtccactgtccccgcgatggttttcagggatggagaaggctccctgtcctccgctggaaccctgcagccgggctgacggtacccccaccacccacccaggggccccagaccctccccatctccaccgccaacccaggccccggctgcgcacgcggggccaggccgtgagctgctgtccccggatggggccgccccgggctggcctggctcactccgtgtcacagatattcccacagagaccccagcgagacctgcagaacattacagcagaatgaaggagagccagaggaagaggcagatgtgctggcctgtaaacagtctgatttccaatgtaaaccagattcaggcccacgacatcaggtaaacatctgcatcagagcccccggccccccaccgcccgggaggccccggggtccacacggccgactctgggacccgtcacagtgaccgccgagacatttcgtaattaggcaaaattgatccttgcattccttccctaaatcccaaatctctgcaattttacttcttctcaaaaatgaaaacatttggcaattagctgatccaagtgaaaaaggtagagaatgtgctctcaactggaaaatgccaattaaggaagcagctctgacttcccacccgccctggctaagctgggagcttatcttccccgagaagaatctgctgggataagggggcttgggaaacaccgagggcagggctgcctcctcagcttcctctgagagcagattagccgtggccttgtgccagcagggcctgggtgccacacagggtggcaggggtggcagagccgggcccggctctggtactgggatttggggtggcgggacccagtggggcacccgcttgtgggcggcactgagggcggtgacgtaggcagcgggtgccggtgtctgcccctccatctggccgggctccccaccctgctcctgcagccctggacctcagggcccatttgcggtgcaaggcggctcttggccattttgcccgcagggccctaccttgggtcttgggagcttctgtcccttgccctctcttgtccaggtcagcatctcccactgtgggaatcctatgtggccccatcgtctggacagtgtgggtcaggtcactgtggctgttttgtgatgcgtgtgtgggctcatccctcagtgctcagaagctgcagacactatggaaccgcttttcaggccccgtggccgtcacccccgctctagagacttgattgcagggaccatgcccggccggcctaactgcacccctcactccaggtgggtggggggacccaggcctgctggcccctgtggtggtgcagcccagaaggtgtgaatcagtttacactgttcagtgcctgaataaaagtcacaggacaaagaggacttggttgcacaaactactgacatgaaattcacattttgtcctgaaggaaacgcaagatgaattgaactcatgttcagtttttatttctcatttctcccgcctcagtctcttctcacgtgcacgacctcacagcgctgtcacaaggcctgctgggcacacgcagctcatagagaagtgatggcttcctccttgccccctcacctccctccttcccctctccccctcacttcggagcacgcaggctgattgtggagacatctcccagccaggatgtgtcaacagggaatgtgctggggacagcgggagttcacagccacccccgcaggcgccttcctggagcacgtccacaggccatgtgcagctgcatcccccacgacggcagggacaagttccttccatagggcccgggtggcccccagagctgcaccatttatgatccggtcctttgcagaacgcaagggacagacacatgaaccctgacctaggttcttgtgcagaaatgttctctcatcggaatagaaaggtatgagtctcaggactggttctctgcaaagcagccatcggcctttcaagcagaaaccatggagcccccagaggctgagtcttccaaggcgctgggagacttggcgtttgcctcttttttaaatgcaatgaccgttgcagtgcatggaatcagagacatgtatctatgcgtagaaatgagtctgtaaacacgatcaaggtgtgatttctgtatgacaatgcagttggatcagaaattggagagtgctggccgggcgcggcggctcacgcctgtaatcccagcactttgggaggccgaggcggatggatcacttgaggtcaggagttcgagaccagcctgggcaacatggtgaaaccccatctctactgaaaacacagaaattagccgggtgtggtggcgtgtgcctgtagtcccagctactcgggaggctgacgtgggaggatcacttgagcccaggaggcagaggctgcagtgagtagagatagcaccactgaactccagcctgggcaacagactgagactccatctcaaaaaaataaataaataaataaataaataagaaagaaaagaagaaatagtggagtgctgtggtcactctggaaaaagaggagggaccccacccaaatgtggttcctccgtcaaccctgaagacgcccccacacaccgggacgagatgaaagggtctggtacttacctagctgggctttcacggggtgcacggtggcttcaggaagggagctggcgtggggctcttcttatgcctcgggggtggggtgatggcctcacatgggcaggagcctgcagggcttgagcctctcactggcaccaaagacacctgccctgctgtggggcacacgggaagagggatgggtgaggtgtcaaagcagtgagccgtcaaacatcataaaaacggagtcaggctctttattgcaggaaacaatttgcggctttctgtgcagagagcaggggggatttgaggtgggctttgtagagtgagggagttcaccagattgacagtgtgggctgggtcaccctgtgcaaagcagcgatttccatgttgcccctgagagaatgttttcctgtgatctccagcatcgagatttaaaaattatcatgttcatagtctgatgataaaacattaatttttaggaaggcagaggacctgcctgcttttcctgataagacctcgttccattgccctaggtcaggcatggattattaactctcagggttttgggggaccagcagccacagatgtggagtcctggggaaagggtgacagcctcctctgcctccggggatttgtccttcagtgacttgacgcccgcaagagtggatgctaattctcaccgtccccatgaaatccctgctgacgcatgctgcccaggagacatctccacaatcagcctgcctgctggagagaggaaggagggaagcgagggtgcaaggaggaagccagcccttctctgtgagctgcatgtgcccagcatgcctcatgacagccctgtgaggtgagaggagactaaggcgggagaaatgagaagcttgcccgagtcacgcaaccgaagcacagagccagggtctggcgccctgagaggtcctgggtgcattggatgctgtgcacgtacttcagcaaagaggcaggatgttgtcatcttccttcggagccagtaacattttctgctgccagcaaggaaagaacattggatcacgcgcctccatgcaggcagggtccttcagtggcgctgatcctgagcccagccctctcgtggtctgtgctgacgccagggcctctcgttggaaggcctcgtgctccacagttcccccacaaaggggaggatgctgaactctttacctgtaattctggcctcgaagcagctgttttctgcctggcttctcaccccagccatgcacagtggaggtgtcagcaaatccctggagagaaagcccggtggacacagggttcctttctctgaggctccctttccctgggatcacagtagctgagtcggggtctccagagaaacagaactgggggtaggggggtgcataaagtgagaaggagatttattataaggcggggactcatggggtaatggaggctgcaagtccagcatctgcagtgtgggcagtgtgggtagtgtgggcagtgtgggtagtgtgggcagtgtgggtagtgtgggcagtgtgggtagtgtgggtaatgtggatagtgtgggtagtgtgggcagtgtgggtagtgtgggcagtgtgggtagtgtggatagtgtggatagtgtgggtagtgtgggtagtgtgggtagtgtggatagtgtgggtagtgtgggtagtgtggatagtgtgggtagtgtgggcagtgtgggtagtgtggatagtgtgggcagtgtgggtagtgtgggtggtgtgggcagtgtggatggtgtgggtagtgtgggtaacatgggcagtgtgggtagtgtgggtagtgtggatagtgtgggtagtgtgggtagtgtggatagtgtgggtggtgtgggtactgtgggtagcgtggatagtgtgggcagtgtgggtaacgtgggcagtgcgggcagtgtgggtagtgtggatagtgtgggtagtgtggatagtgtgggcagtgtgggtaatgtgggcagtgtgggtagtgtgggtagtgtggatagagtgggtggtgtgggtagtgtggatagtgtaggtagtgtgggtagtgtgggcagtgtgggcagtgcaggcagtgtgggttggccagctgcagacccagcagagtccgtggagcggatgaagtcccaaggccgtccgctggagaatctctcttgctcaggaaggctggctttctgctgtattcaagactttaactgatcggaagaggccacccacattacagaaggcaacatgcttcacccaaagttcatccatttaaaagttaacctcaggctgggcgcagtggctcatgcctgtaatcccaacactttgggaggccgaggcaggcgggtcacctgaggtcaggagtttgagaccagcctggccaacatggggaaatcccgtctctactaaaaatacaaaaaattagccgggcatggtggcacacacctgtgataccagctactcgggaggctgaggcaggagaatcggttgaacccagaaggtagaggtggaggctgcagtgagccgagatcacaccactgcactccagcctggggaacagagccagactccgtctcaaaaaaaataaataaatgaagttaatgtcctctaaatacactttccaaattgacacataaaattaatcatcataagagagctgacattcattttttaatattcaaaataggatcttgcaacaagacagtcagctggaaagctaggcttgtcgagagaggcagacagagagaaagagagaaacagagagaaagacagagaggacttgctaagttccttcatcctatccagaagcaaacccgggagacttcgcccatagctgctgtgagcgttcgtgggcaaatgctttcatttctcttgctaaatacctaggtgtagaattggtcatatggaaagcgtggacctcaccgtttaagaacccaccaaactgtttttcaaagcggttgcgtcgtttaaaatcccctcctcatactgtatattttgttctgctgacccgtttgtctctcttgacaccaatccccttctgtctccatgactgtagcctcacggcgagtcttgaaatcacagatctttggtcctccaactgttttctctttttcaagattcttttggttattctaggtcctctgcatgtccttatattttttataatcaacatgggaatttctcttaagagaaaagaagcgcttctgggattctgattgcaatggtactgaattcattaacccatttgggaagacgtggcatcccgtcaatatcaagagtttgacccgtgaacgtggtgcgcacctccatttatttcattcaccttgactttctcccagccgtgctcttagcatatctcgtacatcttttgtgagatttattcgtaaggattcatgttctctctgtaattttaaatggcatttgagttcaatttctgctgtaatacagaaatgcaattgatttttagtggcctcatgaagataaaactcatatcacacacttcacccacttcaagtacacaattcggtggtttttcatatattcgcagagttgtccagccgtcaccatgctctaaccaccatcacaatgtaattctagaacatttttatcacctcaaagaagccatacccatcagcagtcactccctactcctcccgctgagcttctccgctggccttggccaccactgatctctcctccctctctgcggctttgcctctgctgaatacaaatcgggttctgctatgttcatccttctgtgtctggcctctttcacttagcgcaaggtttcaaggttcatgcacgtcatggtgaccagaacttcatttctttttatagctgagaaataccccattgtgtggctagtctgcgttttgtgaaaccatttattggtgctgggacacatgggctgctccctccatgtggctattagaacaatgccatggtggacatttgtgcacatgtttttgtgtggacacgttttcatttttcttgggtggagtagaattgctaaatcataggatacatctatgtttaacattttgaggaactgccaaactgttctccaaggcgattaaatcatgttgtgttcccgccaacaacataggagtgttcgaacttatccacgtcctcactaacacggattatcggcctcactgacgctgttccagagacagtgtggaatgatgcctcactgtgagtgtgttttgtgcttccctaatgagtagtgacatgccacaccttttcctgtgctatttgccatttgtatctcttctttggagacatgtctatcattttttaaatggggttaattatccctttattactgactactgattttgtatactgatcttatagcctactattttgcttaagtcactcattagttctagtagctttctagaagattctgttagattttctacagggatggccatgaccctgtcttacttcttcctctgcaatctatgttttgttttgttttgttttcctttccgtgcctcattgcaccaactagaatagagacgctttgagtaggcactgctgctggttccttctcttgggggaaagcgggcaatcttctgctaggaagcaagatgcctgctgcatctgcttcggagacgcccctttatcagactgggaacattcccttgtgctctcatttggcttgagtttttattataaatgcataacggatatcagatttttttctgtgtctatggagatgatcatatggcttttcttttttagcttgtgaatgtggtgaaatgcactgatctttcaaatattcagttgatcttgcgttactgggataaactccacgttgtcatcatgtattattattgtacatattactgtatccagtttgctaaatgtttgcctctatgttcatgaggggtattggcctgtagttctcttgtgatatctttgtttggttttggtatcaggataagcctcgtagaatgtgttaggaaatgttctctggtcttcggtttcctggaaaaagttgtacagagtcaggattctctatttgttgactgctgggtgaaatttaccagtgaaacaatttgacctgtcatttcctttgtcggaaggtttttgaactacaagtttaattttcttaacaaatacagggctctttggtttatctatttttttagtgactttaataattcgtgtctttcaaaaaaatgtatccatcacatctgagttgtcagatttattgacctgaatgttctgaatagtccctttcatccttttacatatttatagaatctccttctttcccaatcttgctaatttgtgcagtctctctctttagtgattagacaggggaaagattaatcaattttatggattttctgaaatcatgtgtgcagagcagccacgggatagcacggcctctgcacgctgtggggtgttcatcagctggacaggcagctgccacctggacagagtgaaacccaccgcctgagttctggagtaattgtcccaaggaggacctttccactctgggttgtcctggaaagaggctgctcctcgtctaggaagtgaggtcctgggcaaagacctcagtgggagggaggagacatgatcttcctgagtctcagccccaaggcaccagcctggatccctcggtgtgctgcccagagctcgtcaggcactgatgaggattgagaggagggcaggggggagcacccacgtacgacaggacacacacacacacacacacattcccctcctgagacatttgcatccagggaacatgcaggcaattccttgtttgtgcaactaaaactccagagtcccccaaagtgaaaacagcaggcggctccgaagtgaactgcaactaccacctcttccgagacagaaaacgctcagtactgggaggacagggtttccagatttttcttccccaagtaggttccaaaaataccaaggcactgagtttcagccagggcacgcctcgcacctggcctggtcccggggatcaggatgcactctccgcacggagccctcttcttggtggcctctgcggcctctgcaacggagcttgtcctgggacaacaaaggtcttaatctggcagctcctcaaatgaccagccctgggaagggaacatggtcatgaaaataataagaaagaaaaaggactacagcaaaacagaaaacctgatttaagacagcaggacttttgaatcctgatacaacaggttatcagaagaacgaataaattaaacttaccaattaaaagacacaagagtatggatggagttaaacgatgttacccgcgagagacacagaatagttgacaataacaggaagggaaaatgcaagccaattgtatgtggactgaaagaaggctacaaaaggattaaaacattaagccacaatgcagctttctgacagtcaaatgatcaacatacagaaatatattttccaaccacagggcaaaaaaaaaattagaaattaagtcacaaaagggatagtgcaaatattgtatgtttggaaaccaaatagtctattaccataaatttggggttaaagagataatcataattattaaaaagtaataaaaacattgcacattagaaggacggggcagagtgaagcagctgttactgagaggtgtacggtactaaatacatttctcacaaattatgaaattggatgtctacgcagatgttttgcctgtttctaacggagctgtttttgtcattaattttttagttccttttccattctgggttcaatctttcatcagtgatatggtttgcaaatacatcctccagatctgcgacttatcttccgatttcttgttagtgtcttttgaagcacacatttgaaaaaaattcgatgaagttcaccctatcaatgttttattttacgatcttatttttgatgtcatggctaaggaattgcacctggcccacagcttccttgactttctcccatgttttctacaagttttagttcccggttttcatgtaaccctctttgtgttaattcttgtggaggacatgagatagggttccaaacttctttctcatgtggctatccagatgtcccagcactatttgtggaaaagactgtctgtcccccgactgagttctgtttgttgcctttgtcaaaaatcaattgacaatctacataaaacgttttttttttttcctggacttttgatcctgtttcattgatctgtgtggctacagtgaaaccaatacgagactgtctttgttactaaattttgttcttttaaaaaattgttttatccataccgggtcctttaagttatttttgtcatgaagtttttagctcttttttctattctggatacaatcttttatcagttatatgatttgtcaatattttatcctaatcggtggctttcctttcattttcatttgtaaatattaggatcaatttgtcaaattttgcacaaatgcctgctggattttgacagggattatattggatttacaaattgccatgttaacgtgattgtgcctctggcccatgaacacgggcggcctccccagttgctcatgttttctttaattcctctcagcaggatttgggggttttagcatttaactcttatacttctttggttacgtatatgcttctgtattttattctattattatttaaaattttcttaatttcattttcagattgtctattactaatgtatagaaattcagtggatttttgtgtattgatactacactctgcacctttgctggattttttattagttctaacaggagtgtttgtgtttattctgcttagggctctccaaaattctcaaatatgtgattttttttgtctttgactagctttgggagactctcagccaccatctctccaagtagcttttcttccacgatttcttctttcctcttaggatcataagtggacattcactagagtgtgttgaagtgttttaaaggtcttggatgcttgatttagttctctctctttgtcttttttctctttgtgttcattttggatgacttctactcacctgtctcccagtttatggattctttccttagttctttccagtgtgttaattagcctatgataagaatgttgatattgttggtgggggggcggtggtggagaggctatttccatttgacttttgttttttttgagacagggccacgctctgttgcccaggcaggagtgcagtggttcgatcacagctcactgcagcctctaactcctgggctcaagagatcctcctgcctcagcctccaaagtagctgggactataatcccagcactttgggaggccaaggtgggtggatcacctgaggtcaggagttcaagaccagcctgaccaacatggtgaaaccccgtctctactaaaaatacaaaacatagttgggcatggtggcacacgcctgtaatcccagtactggggagtctgaggcaggagaatcactcgaacatgggaggcagaggttgcagtgagccaagatcacaccactgcactccagcctgggcaacagtgtgggactccatctcaaaaataaataaataaaaacagtgttctagtttttttcagttttcatttatctgttgaaattcctcacctgttaatgcatattgactaaacatacccatcacagttatttttatttatttatttgtttttttgagatggagtctagctctgtcacccaggctggagtacagtgatgtaatctcagctcactgcaagctctgcctcccgggttcgagcgattctcctgcctcagcctcccgagtaactgggaccacaggcacctgccaccatgcccagctaatttttgtatttttagtagagatggggtttcaccttgttggccaggctggtctcgaactcctgacctcatgatccgctcacctcggcctcccagagtgctgggattgcaggagtgagtcaccgcacctggcctgtgagttattttaaagtccctgtgcaacagtgtcaacattggagtcatctcaaagttggattctattaattgttttatcacatggccatggttcattttaccttccttccttgctatctcataaattttaattgaatttcagacactgtgtccagagaataatagagacggaggcaggtagcctttatgccccagatggctttggatccccttcttctgggtatgaatgtgggatctgtgccagcctgggccatgggtgggccgggtcagggtgaggtgtggccgccattacctcagggcgtcagagactgcgaggcctcctaggcaagctcacccttacctggtgctgaagcctggggctggggaccagggaggattttcttttttctttttttgagacagagttttgttctgtcgcccaggatggagtgcagtggcgtgatctcagctcactgcaagctccacctcccgggttcatgccatcctcctgtctcagcctcccaagtaggtgggactacaggcgtgtatcaccacgctgggctaatttttttgtatttttattagagatggggttttgccacgttggccaggctggtttcgaactcctgacctcgtgatctgcccgccttggcctcccaaagtgctgggattacaggtgtgagccaccacgcccggccccagggagggtttcctcagtgcccctacagctccattgcagcaggcccttcatgcctgaaccacagaggtggttttctccatgttcttgccccttcgttcattttacgcaacagatatctattgagcaactgccatgtgccagacactgagctcaagtatggtttattctagcgaggcaggaagagcagtgggtctatttatgtgattctggaaattcacaaaggatgaaacctatgactactcaagtattagctgcaaaagctggtaaagttcaacaaagttcgaaagcttgctatggttcagcattcgtttatgttagaaaaaaagaaaaacttgaaaagctattaatatctaacttctgaagaatatccctcgggaagtgatattaaaagtcacatagaaacattaggagaagcagctactacctgtcttattaaacattgttttgaatgatagcattgggacacactaaaaactaaatacagttcaaaatatttaaaaggaagaaatgaaacaactagaacaaaagctgagtaaagatacaacattataaatcaacggattttctagacactatgtagagaaaataccacatgacaacatttcccatttataattttaaaattatagaattctatgggcagccgggcacagtggctcacacctgtaatcccagtactttgggaggctgaggaggccaggtcacttgaggtcaagagttcgaaaccaccctggccaacatggcgaaacccagtctctactaaaaatacaaaaacttagctcggcatggtggctcatgcctataatcccaactgcttgggaggctgaggcaggggaatcacttgaacccaggaggcggaggttgcaatgtgccaagattacaccattgcactccagcctgggcaatgagagtgaaaccccatctcaaaaaaaaaaaaaaaaaaagcctcctacccataagatgtaaataaatggagagatataacaggcttcttgattgagaacacttacaacttcaggtctctaaaaatcaacctatggatttaattatattccaattaaaataaataattacttttatcttgccaagttttctctaaaattctcatcaaaatgtataggcaagtgtagccattaaattttggggggatgtctttataatttttttaaatttttatagccattaaaaatttaaaagcaaaatataaaggaagaagaatgagtggtgatttcccagacagctatcagaacagactataaagctacagttattaaaacagcactgccttgcttctggattacataaattgaaggaggaagtggagccgggccctggcagccttctcagtgtaactcaggaccccgtggacggggtgtctgagccagcaggaagagacagggcctgctgcagaggacgtaacaacagaaccacgcacctgcagcaaggcagtcccatctccgtctcagctgagacacagagcaaccacccagctaggcagtcccatctcagctggagcacatccacgaggaatccaaatgcacacaaaaaaataaaagtacaaaattcctggaaggacatgtggggaatgtattcccgatattgggggggccttaaagcatggcgcgaaacacaagcattgttaacggagtgtctgggagatttcactgtttcaaaaggaaacacttctttattgaaaatcacagtaaaaaaatgacatagtacagattcagagaaaatgtttcttacaaatataacaataaaaattaatatctctgatatccaaattgattatacaaatcaatagcagctcagtagaaaaatggactaaacgtatgaatattaattctcacactttttatggaataatgtttagaaaaagaaaaactttaaaattcacagaggggctaagttttagggaatagttttgagtgtcatctatatagtttttctcaataaatatattaatgtagtaaattacattgagtgcttttatattttaatttagtttttcctaaattgatctagatagattttttatcaaaaataccaggaatacatattaatcaacacaccaaaatatcaaaaatattttttattagataaattgattctaaaatgtgtacaaaggggcaaaggaactagaatagctaaatgataaaagaagaagaaaggaagaatcgtgcccctcaatgttaagagttactcaaaagctcccgtaatcaagagtgtcaccgtgggtgtgggcacagcagctcatgcatgtaatcctagcactttgggagcctgaggaaggaggatctcttgaggctagagttctagacctgcctgggctacatagtgagacctcatctctaaaattaaaaaaaaaaaaattaattaaaattaaaaaaatagaaaattgaaaaagagagtgtcaccccagggaagagagagagtggaggtaaaggggcgtgcagacccccaggatcacggccacctggcctcccacaagggaccaagagccgtcaatgccagaagagccgctttcccaacaagccatgctagagcagactcatgggttcaaaaatggccgtagacctacacgttcatatgaaaattaactcaaactggggctgggcacagtggctcatgcctgtaatcccagcactttgggaggccgaggctggcagatcacttgagatcgggagttcgaaaccagcctggccaacatggtgaaaccctgtctctatgaaaaatacaaaaattagctgggcgtggtggcaggcacctgtaatcccagctacttgggaggctgaggcaggagaatcgcttgaacccaggaggcagaggttgcagtgagccaagatcatgccactgcactccagtctgggcaacagagagagactcgtctcgaaataaataaatacattaataaacaaaaattatccaggcgtggtggcaggcacctgtaatcccagctacttgggaggctgagacatgagaatcatttaaacctgggggttggaggtcgcagtgagccaagatcacgccactgaactccagcctgggagacagagtaagactccgtccccccccaaaaaaaaaaaaaaagtaaaaataaaggaaattaactcaaattggatcaaaaacaataacacttttagaatagaagaaagtgtccaggacctggggcttggcaaggacttcctagatataacatcaaaagcatgattcatatatattttaaatcaatgaattagatctcattgaaattaaaaacttttatgccgtgaaagatcctgttaggatggatgaaaagataagctgtgggctgggagaaaatgtttgcaaaacccatgtctgacaaaggactcgtatctagaatataagaagaactctcaaaactcaacggaacagggccaaataatccaatgaaagaaggatcatggagacaaggtggagatggcagatgaagtcacaaaacggccttcaacccgcgtggccccagggaaacacaggctgggaccatgacccaatatttctccgtacctattagaacagctaacgcaaaatataataacaagaccaaatgctggcagagattcggagaaacggtatgacattcactgcgtgtggaatgtaacatggcgcacccaccatggaaaagagtttgacagtttcttaaaaaagcgaaacagactctgaccatttgacccagcagtcacactcctgggcatttgtcccagagaaagaaagatttatgttcacacaaacacctatacgtgattgctcatggcagcgctatttgtaatagtcaaaagcttcagtaggtgaatggtaaacaaagaggtcctttcctaccaggggaggctacttatcagtaaaaaggaactaactgttgacacaggaagcagcttagatggtctcaagggcatgttcctgagtgaagagctcatctgaaagggtcccacgcattccatttacatcacatttgcaaaatgacaaatttatagccataggaaaaggccagagggtgtgaggaggaaggaacggggacatgggcagtgagtctctgggatgaggcagccccggagatggccgtggcagtgggacagctctgtgtcctgttcctggtggtgtgtacacaaattcccacatcctacaacatggcaaaaacccagatacacacactgtagcacggtcagcttcctggcttagacacgcactccagctaagggagacgaagccgttgggaaaactggttgaggggcatgtggaaatctctgtactagttttgagacttcctgtgaatctgtaatgatttcaaaataaaatctttaaaagaaatcacgagcttgataaagagaatatacattgtatgctgccttttgaataaaaaaaaaattagacatgcaggtattccgttattgttgcaaacagaaaccacgggaagaaggagacagaactcatggactcggtgagtggagaacagaaagtttgagcgtctgaggttacttaacgatttcacatttaaaaattatttaaattaagtaaaaaaggatacagaacacataaatggaacacaagaaaacaaacaaatgggcattttcaacgcataaatgtttaggagtggagaccgaccaagagccgccttgcaccgcaaatgggccctgaggtccagggctgcaggagcagggtggggagcccggccagatggaggggcagacaccggcacccgctgcctacgtcaccgccctcagtgctgcccacaagcgggtgccccactgggtcccgccaccccaaatcccagtgccggagcggggcccggctctgccacccgctgccacccggtgtggcacccaggccctgctggcacaaggccacggctaatctgctctcagaggaagctgaggaggtgaggaggcagccctgccctcggtgtttcccaagcccccttatcccagcagattcttctcggggaagataagctcccagcttagccagggcgggtgggaagtcagagctgcttccttaattggcattttccagttgagagcacattctctacctttttcacttggatcagctaattgccaaatgttttcatttttgagaagaagtaaaattgcagagatttgggatttagggaaggaatgcaaggatcaattttgcctaattacgaaatgtctcggcggtcactgtgacgggtcccagagtcggccgtgtggaccccggggcctcccgggcggtggggggccgggggctctgatgcagatgtttacctgatgtcgtgggcctgaatctggtttacattggaaatcagactgtttacaggccagcacatctgcctcttcctctggctctccttcattctgctgtaatgttctgcaggtctcgctggggtctctgtgggaatatctgtgacacggagtgagccaggccagcccggggcggccccatccggggacagcagctcacggcctggccccgcgtgcgcagccggggcctgggttggcggtggagatggggagggtctgggggcccctgggtgggtggtgggggtaccgtcagcccggctgcagggttccagcggaggacagggagccttctccatccctgaaaaccatcgcggggacagtggactcatcaggatgccgggaccctctagtgtgttctggaagcagaggctgggtgtgggcacgggaacctgtgattgtccccagacaccgagaggcccacaggacccccagtgcccagaccccggctgcagatcggggggtccagtcatgtgtcggggaaggaggaggggagcaggggccacagacagggggtccaggagggcagggggtccaggagggcagaggacccaggacagcaaagggtccgggagggcagaggatccaggaggacagggggtccaggagggcagggggtccaggagggcccaggagggcagggggtccaggaggacagggggtcctggagggcagggggtccaggagggcagggggtccaggagggcagagggtccaggagggcagagggtccaggagggcccaggagggcagggggtccaggaggacagggggtcctggagggcagggggtccaggagggcagggggtccaggagggcagagggtccaggagggcccaggagggcagggggtccaggaggacagggggtcctggagggcagggggtcccggagggcagagggtcctggagggcagggggtcccggagggcagagggtcctggagggcagggggtccaggagggcagggggtccaggagggcagagggtcctggagggcagggggtccaggagggcagggggtccaggagggcccaggagggaagggggtccaggaggacagggggtccaggagggcagagccacagcaggctgggtgctgctgctacagggggcttcaccccagcagccccctgcactgcccctctgacagcctccacctttgaccccccagaacaatgggctgctgtggcggctctggaggctgcggccccagtcatggggcctgcggctgccatgggctgagaccctgctgctcttcgtggagacactgatgtccttaccagatctcccgggcccgccctcagcctccaggctgaccaggcttcctgggcctcctaggacacagccctgggtctcctcctctaggatactggatgggaatctgcggcttccaacatccacctgcccgccttcccctctgccctgtccccttgctgccatggccgcctttgtcctccctggagattcagagagcagccccgttctcagttacctggccttctgggtccttgggaggttctgacctcttcccagcaggggccctgggggctgcgtcctgcctggtccaggccttctcaccctcacctccctctgggctcagggagctggggccacacagcccagagaggctggtctgcccaggacaggccaccctcctcctgctcccaggagtgcctgcagccctgtcagtttccaagagtgtctccttcaagcagcctcgtcaggtcgagccacccccagtgccctctctcctctggcagccgcgctccctgcccttcctccccacctgctcagtcctgcaaagcctcctgcctagctggacacctgggggttctgtatcccacactccaggggcctccttcacatgtcggtgacctctgacactccaggggcctccttcacatgtcggtgacctctgaccgctgtttcagacccacagctcctgggtgcactcagccttgggtcccgatggcaccagagtgttccacgcctggggcagcgcactcattgcagatctggcctgagactcagcagccgggcaccccatgagatctactttctgaatggcgtcgtcacctgactgggcatacaggccacggaccccatggtcatttgggcactgacccctctcacaccccccaaatcccacctgagagcagcccatcaggcaggccccatatattggatgcctctaagtatcagccttgatgtccctctaattccagccctggtgtcttctccctgggacaccctgctgctccctctagctgtgccctccacggtgactccagacatgcggattcagcctcttcgctccaggaccaaactcctcagcagctcccactactcccagcatgccatccagctcctcagcccagcagcaaagacaggcacagaatggctcccgaacccatcgctccggtccggagaaggagccctccaccctccacgctccattcgctgtccccttgcgggcccctgtgaggaaccccagccagaggcaccaatggccgccactgactttcaccctgtcctgaatcacaggaccaaggaggctgccccgacaagggtcgcttccagactcactccctgtcagccactgccacatgcctgccgtgggcagcattggaggacagggggtactctgtcagtcagcctaacaggctggtccgtccttccttccttccttccttcttccctccctcacttccttccttcttccctccctgcctccctcccttccttctctgctccctccctccctcctccctccccctccttccctgcctccctcctccctccttctctgcctccttcctcccccttcccttccttccttccttctctgctccccccctccctctttccctccctccctctttccctcccttcctcctccctcctcctccctccctcccttccttccttctttctttccttccttccttcctgcttctctcccttcctccctccctcacttccttccttccttcttccctccctgcctccctcccttccttctctgctccctccctccccccttccctgcctccctcttccctccttctttgcctcctccctcccccttcccttccttccttccttctctgctacctccctccctcctccctcccccctcccttccttccttcctctctggtcaaatgcgggtacatgagagttcccaccatccccatggtaagtgcacagttccgtggcattgggaacctgcacgtggctgtgccactgtcgccaccatgcagctccagcaccttttcatcgcgcgaaactggagctccgtcctgactaatcactcactcccatcggcctctgtcactggccctgctgactaccattctgccatcttcctcttgaatctgactcctctgggggccttccatctgtggggtcacagcattggtcctattgtgactggctggcttcactcggcacgaggctgtgaaggttggtggcgttgctgcaggcgtcagagcacactccttttccaggctccgtaagaccccgatgtgtttgtctaccccatttcagatcccctcacctgctgggttgtttccacctttgggctattgtgactgcacggctgtgagcatgggtgtctgagtccattctgtgtagccataaaagaacctctgtgatggggtaattcatcaagctcacagttctgctggctgagaagttcaatggcatggccctggcttctgctggaggaggtcaaaggggaagcagacacgggaagagagataaagctcagggatgtcttggcttcagaacaagccccactcatgggaacaaatccattcccatgggaactcaccctgtatcacaagaggagaatcactcccagcaccacggactccccagggagtcactcccacgacccacacgtctccctcccctcaggccccacctccctacgctgccacactgggggtcccgtttcaacaagagttttgctgggaacagatgcactgactacatccaggtcgtggtaagggctgtgcaagtatttgagtccctgctttgatttcttttggggatagacctaggaatggaatggcggcttcgcagggtaattttgtgtttacctgtttctggaaggagcacactgagctggccagagcaggcttgtgttttcctctgtgctccttcctgcttcccaggatgcagatgagatggcaggtgccccagcagccctcgccaaccataaggcatggattcctcaccttcggctcggggagcacagagactgagggccgtggactcggggtgagatggtggcacctccatcacagacccacagtctctgtgtccagcccttccggaaagatgacagaaatgaaaagtctgccttatggaagacaaggttattcagaattttcggttctgtatggtctccttagaaacattagcagactttaaaaaatgaaaatagcccatgttcattgtgaaaaagtgagccatggcctccggggcaccggagccacagagccaccacgctttgcttttgtttctcactcccctactctccccacataggcaccgacgctttccctgacagcatcatcatcacccaactagggcagctgacccgcgtcttcctcacgacgtggaatggtttgagtcaagggttttcatggccatgagccacgtggaggctgtgccttttgtttcctgtgagaaatcttcaaccagcgccactctcagcctcccctctgccagcgcttctgtggctgcacctgcattcgtgggctgtggctgcgaagcacaggaataattgatggctctggggcactttgctgggctgcttccagaaaagttgacccctccctgcaaaccagcactgcccagcattcttgtcccgccaagcctgactgtgagctgttgtgacgttgccactttgctcggaaaggaccccttaccttttatttcccttgcatttctttcaattctaccattgaccatttctcatacgtgtggtcatcattgtatttcgcccccattttgtgaggtttagtgtattcttaaagtttcctgggttttgatgagagcatattctgtcattatatttaacaggtgttttccccagcttggatgtgtttggccattagcttcttttctgctattttacactagtctgttattcttcactacaaaaggactctgccgagggtccccatgctccccatgcttcggggtgtgaggtagcaggggaaggcaggtgtccttccttctttgaagtgcgggttggggcaggacagcagaccctggggtcactgctgaggaggggaaggatgggattaggactgttctcttcctggcctcatgagctcccccagctccttctggtggttggagaagaaacctcctgattgtcacggagagtgagtttgtccgtggagcttttcctgcacggctcacatagaacgggctgtgaggtccctccactgagcagcacgtgccaggccgggtgcccacgactgttgggaaaacccaggcctgtattccaggaagcaaaggtctttagatgaaggttttaagaatgaaaattaacccacagaatggtgaggtcagttggagcctggattccatggggtaagacagccacagccaggtgggcatcctgctccttccctttcccctgtccctgcccaccggccatgccctagagtaggggcacactcggaccccagcccagcgcccacccatgctgcctgcaggcctgcgaggtcccacaaccccttggcatgcagcgacagcccggggccaggtgtgggtgaggcttgggatttcctggcacagctgacttcatgttgtggcctggcagcctcgggtggtgtcggcagatgcaggaagccacgggcgcagctccctgcctgtcccggccgtgggtgctaatgcagagtgggttctgtggctggtcacacaggcagccgggtgggtgcaggtcatcccggggatggccttgcactgtctgatccccggggaggggagggtcttttcgctgaccacgctgtttgctgcgtgctttttgtttgccaagggctgcaatgtttgtcgtctgccgcagtgtttgctgccgggtgaagaatcgctggccctgtgttgtcacctgggcccaccgtgacaaggtccccacctctgttgtgggactcgggggcaaagttccctgctgttcacgctgcaagtgacaagggccttggtctctgaaccaggagcctctgagtcctgccccacagggctgagccctggctgggagcaatgttctttgggggagacagcagcttcctcacttccatgtacagccagatgccacgggatgtggggagtgcgacagggccgtggggagtgtgacaaggccttggggagtgtgacagggctgtggggagtgtgacagggccttggggagtttgacagggccgtggggagtgtgacagagccgtggggagtgggacaaggccgtggggagtgggacagggccgtggggaatgggacagggccgtggggagtgtgacagggccatggggagtttgacagggccgtggggagtgggacagggctgtggggagtgcgacaggtctgtggcgagtgtgacagggctgtggggagtgcgacagggctgtggggagttttgaaagggccatggggagttttgacagggctgtgcggagtgtgacagggctgtgcggagtgtgacagggatgtggggagtgcgacagggctgtggggagtgtgacagggctgtggggagtgtgacagggctgtgggaagtgcgacaggtctgtggcgagtgtgacagagctgtggggagtgcaacaggtctgtggcgagtgtgacagagctgtggggagttttgacacgtctgtggggagtgcaacagggctgtggggagtgtgacagggctgtggggagtgcgacagggctgtggggaatgtgacggggctgtgtgggagcaggtggtcctgtggggcatcccggggtctgtgctcaggctgtgggaggtggggctggcaggggatcctggagaaacacctttgggggctcaggtttggtggagctcccacttccacagtggctctgagtggggcctgagcaggttttcctggcagtggctgagggtgggtgggcctggtaggtactgggctgctcagaagccagccagctccatgttgcccacctcagcctcccaggcttctcagggcccagctgtgctctgtccctggggcccttccctccccggacactgctcacccctggcaagggctctgccctgggacacaccctgctagaccctcagatctgatcccagcccttcccatgtgactccctgggtgctcccagatgactgggatgtggggaaggatcaaagagcactttggttgtctctgtaactcttctagtgattagataagggctggatttaaggattacttctgcaatgcaaatagatgaaaggaacaagctaaataacaaactcttcccattcccagaacaaagtcagctctggcctggttccacgtgccctgtccagcacgtcccccaagcgcaggcatgggcccccggaccagccgcggacccctcctcgcgctttgcaacgcctcacagctggccccgcacccctggggcaggaccactccctcttcttattcttctctgtgtcaccttcccagactctgcacatagtcggcgctacataaatggtggctgcaaaaaggagacgagcagcagagcaatgccccagggaacaagaggggcgctgttgccaaggccagggccagggtatctgccctgaggcctgagccccacacgacccagggctccagagccccatggcccatctcactgctggggctgaacccccagggcccctgcagccactgcctcaggaggtcaggttggggtgtggagtaggagggacgggtgtttccagggaatccctgtgtaggtgggatccagagggcttgaaaccctcaagctaccagccagctccacgcctaggacaggccttattagagttcaggatctgccagctcccaggggcagcctcaatgtccggggtggatgggggtttctgtgggttcacttctgcccccagctgggatgcctggaaggagagctcagggacagtgtggccagaccctgacccagacagaagattctgtctgagagaccggggaccttcacagagggacagaggcccaggaagcagcggctgctgctgtaagcctacggcgagagccatggtcacagaagacccacttgttgccaggcgttttgccttcacaatggcaaagtctcccagtggcccaggagaaaagggaatgctcattccattctgcctgccagaaaacagaggctgaggcccagaggctcaggcaacctccccaggttcacctcatttggaaacagccccttcccatccccggttgctgccgcaatcttctaaggggacttcctcagaggtcattaaatgcattgaaaactggttctggtcctcgaccctaagctgctggaggagggggtgtgggagcagattcggggtgcacctgtgtgttcaggtgaaggcggagggaaattagtcatggagctaagctgaaccacctgctgggccccaggcaggcaaggccctgtgggcaggtgggaagccagaggccgcctctcaccccggggaggggcaggggctggagtgacggtgcagggtgagattttggccaggcacaactccatccatccctgcatccccaggaagccacagacacccaggttctgagagcccggctctcgaatgtccctcctcccccgacctccttcggtgcccctggccatgccagccctgagcatgaagccttcaactttcccacgcacccacttccactctccagggctgaggagcaggaaggagatggcttggaggggtgagcccctgtcctgttctcagagggtcacagctactcactacctgctacgaagacagggaagggtgggagccgttctaaaccagcatcagtgcatgccacaaaatagaagccgtgcattacaaactagaaacgagggcttggttgcaggcaccttccctagagaccctggctgagcagaggctggggtctggctgcgctgctctgacggtgtgcacgggcgggctaggcactcgccctgagtcccagaaagaggagcccacagatacaaaacttaaaggatgtgttattttattttttaatttaatttttgttttttcaaaagcatcaaagtcattgtgattggaaggaatgcgcaagttggtctggggtgctgtccctgggcgccgaaccagccggggacatggcccctggagagctgccgaccccggggctaggggagtggtcttgcgaggagcctttgcttcccactcgccggccgccccgcggggccctcctgccaccaggtggcgcttctcggccagcccgggccgcaggacctgcagtctcgtttccccaggaatggcgacggccctgttattcccatcacaattttacaggtcagaaaaggagactcggagtgcatatatagcaacttggagaaagtcgcaagggacgaaggacccttccccggacacaggaaccttctgggggatggggacagggactcaggtgcagagaaaaccagagctgctaccgtggggacagaaagggagtctacccagagacagcagaggcaggagctgccccccctctttgcccccagtggccccgagcgaggggttgccaccacctagagcctggggaccaggggccagtgcctggggacggaggccgtggtcgagacaggcgagggatgtggcggagacagggaggcccaggtcggctggcacagggcaaggagcaggcgagccgaccccagggccttgcccttgtcacgccccctgccatgttcctgctggcccccttcctgttctgtgaggtcaacacgcaggagaaaggggcagaagggaaggtctccccacaccgagggctctgcccgcttgggccaggggttggggggtggtcatggcaccagggctgctctgagctacagccccgagggggggccgggcgatgcctcctcctccgtgccagcctgtgccggggcccctaggaacccccaagtccctgcctgtgacctctgcagagcccagcaggcgcctccccgccctcggccacaggctcggagctcacggcccccagggggcgctcaaggactgctcatctgcgcttctgccgcgggcagctctgacccctcccgctgcgctcctccagccgcatccctgcagccttgggccctactggcccgggggaggaggcactgcgctttggggaggaagagagactaaaggggagaccgagaaccccgggtcaggaagcggagagctaaaacgacaaccgtgggtcagcggaggccggcaacttcatttcatgacctctggcctccaaagcagctctgcaaagtggtcaatgctcctctcgttgtgtagatgaagatactgagggccagggaggctgtggactgcctgatgtcacacgactggtggggcggcgggcgggtctgtccccaggcgattgtcctcgaggcacacggcggggcagagcttggaagcggccgaggtgggggtccctgggtgtggatgtagtgaccccggagccacgtggagccaccttcagacccagagctgaagcaggagggtgaccggtagagcaaggccgtgcacacccccgttgcagaattgaaaacgcgcctcaaaataaaaccccgtgtttcacaagaatgcactaattcccgaagatatccgggcgcacgggatgcagtggggattggagatgcaggggccatgcaagtgagaaggaccctgctcagcgtgaggctctgatggtcttgaattcctttgccatgctcggacaaggggcctgcgctgtcacgttgctttggaccctgaaaattcgggagcccgtcctgagcccacgctgccatagttgccaggtatccagcatatgcacaaaacacctccacgccggtgctctgccctgccctgctctggagacccacatccaaggacaggtctctcctatggcagccctgctccctgcccttcttccccacctgctcagtcctgcaaagccttcggccaagactgacacctgggggttctgtctcccacactctaggggcctcctccacatgtcggtgacctctgaccactgtttcagacccacagctcctgggtgcactcagcattgggtccctatggtatcagagtgttccaggcctggggcactgcactcactgcagacctggcctgagattcagcagctgggcaccctatgagatctagtttctgaatggcgtcgtcacctgactgggcatacaagccacaggccccgtggtctgtgggcggccattgtcctgtgtgtggggtggggcactgggaccctcccacagctttggctttctcagagtttctatccctgtgtcctcctctgtcagcaaagcccaaaggtggggggctcctgagctgccacctcctttgtttctccaactctgccggttcattggactatgcccttggtgcctcacagtgtgctgactgacagcatctctaagccctaaaccactgagcctggagtcatccagctccagggaaatgactctgcagggtcacgattcctgggtctgcactcaggccccctctttccaaccaagacagcaggatcccaggtatcctgagacctgtcctgatcctgaatcctgtcctgatcctgagtcctgtcttgatcttgggtcctgacctgatcctgccctgagtcctgtcctgatcctgggtcctaccctgatcctgtgtcctgccctgatcctgagacctgccctgatcctgggtcctgtcctgatcctgattcctgccctgatcctgtggtcctgccctgatactgagacctgccctgatcctgggttctgccctgatcctgagtcctgtcctgatcctgggtcctgtcctgatcctgagacctgccccgatcctgagtcctgtcctgatcctgccctgatcctgagtcctattgtgattcaaagtgctgtcttgatcctgcgtcctgccctgatcctgagtcctgtcctgatcctgccctgatcctgggtcctgccctgattctgagtcctgtcctgatcctgggtcctgcctgatcctgagacctgccctaatgctgagtcctgttctgatcctgagtcctgttttgatcctgagtcctgtcttgatcctggttcctgccctgtttctgagtcctgtcctgagcctgccctgatcctgagtcctattctgatcctgagtatttcctgatcctggctcttatgagatcctgggtttcatcctgttctacccacgggtgatagcccaggatggggtcacctgctctagggtgtctccatgcgtggtctccctgtgccttctgtaaacttcccctgagactttcggagtcaagtcagcatcagcatcagcatagaagtgggttgaataggaccccctcattcctgtccacctggaaactctgaatgtgatcttatttggacactgggtctttgcagatgtaatcaagttaagatgaggttgtactggagtagggtgggccctgatccaatgtctggtgtccctgtaagagaaaggaggggaggaggtcagacacagacactcagtggagaagcccacttgaggatggaggcagagacgggggatgcagccacaagccaagaatgtctggccaccaccagaagctggaagacgcagaaaggatccttccctggagccttcagagagtgtgtggcccacggagaacttgatcttgaacttctgtctgcctgaaccgcgaggcaccaatgtccgctttaaggctcccgttgggggccatttgttatggcagccccaggaaatgaacactggtagcaaagatgagcgcagcatcaaagccaagtccctgctcccgttgcccttactaacacagaaggacaggggccttgtcatttttcagaggacatgtgagggaaatcatgaactaaagaaaaagtgcaaaactatgtacaccactgaggttattttaagattaagcaaacaaacacagtttccctaaggaaatggcacaaacaggaaccaggaaatgactgtgtgtccagcatcacacctgatcctgggcagggatataaagggcccaggctcagggagctccatacctgcacacctccctctcacctgctcctctacctgctccaccctcaatccaccagaaccatgggctgctgtggctgctctggaggctgtggctccggctgtgggggctgtggctctggctgtgggggctgtgggtccagctgctgtgtgcccatctgctgctgcaagcccgtgtgctgctgtgtgccagcctgttcctgcaccagctgtggctcttgtgggggctccaaggggtgctgtggctcttgtgggggctccaaagggggctgtggctcttgtgggggctccaagggaggctgtggctcttgtggctgctcccagtgcagttgctgcaagccctgctactgttcctcaggctgtgggtcatcctgctgccagtccagctgctgcaagccctgctgttcccaggccagctgctgtgtccccatttgctgccagtgcaaaatctgaggctctgactttggacctcaggtgagtccagcatatccacaccacccaagaagtgaccagtgctgcatttcagttctggctgtcccacagctccaggagttgtgtcccctgaattttgcagaaggtgatgactccaggttcttggcctttcctgactccctttctggtcattcttcatgagaactctcttcctctctcctggtgcccaacaccttcccagttcccagagccctgcaatctcctccaacaagctccctgccaggtcctgctgcgacagggccctccctgtccatcagtcctcctgtcctccttctctagagcagctgcaggtcggggaggcagtggagatctgcccccatccccaaaggctccaaaccttcctccccaggagacggccactctcgcggcttctctctcagttaaggttcagcaggacctgagaccctttaaataaacacatttcccacccatgaggcttgctctcactgtggctttaaaacaaacaaacaaacaaacaaaaaaaacttttatttgaggttcagggagcatgtgcagatttgttacacaggtaaactcgtgtcatgggggtttgttgtacaaattatttcatcactaaaccaagtacccattagttatttttcctgatcctctccctcctcccaccgtccaccctccgataggccccagtgtgttgctcccctctgtgtgtccatgtgctctcctcattccacccccacttgtaagtgagaatatccagtatttggttttctgttcctgagttagtttgctaaggataatagcctccagctccatccatgttcctgccaataacacgatctcattctttgttatggctgcatagtattccatggtgtatatgtgccacattttctttatccagtctacaattgatgggcattttggttgattccttgtttttactgttgtgaattgggctgtaataaacgtgtgcatgtgtgtttatgatagaatgatttatgagtccagcagcacatcaaaaagcttatccaccacgatcaagtaggccttacccctatgatgcaaggttggttcaacctacacaaatgaataaatgtgattcattacataaacggaactaaagacaaaagccacatgatcatctcaatacaggcagaaaaggcttttgttaaaattcaacatcccttcattttattttttatttttttgagatggagtctcgctctgttgcccaggctggagtgcagtggtgtgatcttggctcactgcaaactccatctcccaggttcaagtgattctcctgcctcagcctcccgagtagctgggattacaggtttctgccaccatgcccggctaatttttgtatttttagtacagacggggtttcttttttttttttttttgagacggagtctcactctgtcgcccaggctggagtacagtggtgcaatctcggctcactgcaagctccacctcccgggttcacaccattctcctgcctcagcctcctgagtagctgggactacaggcacctgccaccacgcccggctaatttttttttatatttttaatagagacggggtttcaccatgttagccaggatggtctcgatctcctgaccttgtgatccacccgtctctgcctcccaaagtgctgggattacaggcataagccaccgcgcccagcagagacggggtttcaccatgttggccaggctggtctcaaactcctgacctcaagtgatccgcccgccttgctctcccaaagtgctgggagtataggcgtgagccgctgtgcctggctgacatcccttcatgccagaaactctgaataaactaggtcctgaaggaacacacctcaaaataacaagcaccgcctaccactgcatctctttccctgcagctcttgcctgagtgaatctgcctgcagggtcagcccattcccggcccgtcactgaatgtgtgtttactgagctcctcctgcatcccacgtgctcacagctgacagggaatcagaaccctcccctgcagctcaggtcctgggtggagacagcctatccagtcctccagggaccacaaggtgggtgtcctttttcttgactcccatagcagctgtgactgagatgcagagctggcacacacctgggcatggccccacacgcaggtggcatgggtgcagttctaacctctcagtccgactgcaaatgctgctcataaccacaacagaacatttggccagagactgctctcctctcgggagccacactcagggacatcaccaggaagatacctcctatcccaggccccgtctcaccatggctctgacagcaaatgtgggggcagaggtagtgcagggcaggccctggggaggaccttggccagtcagtggcgccttttcctgaggccccagtatggctgccttgccagtccttcctgactgtctctgccctcagcccctgagccccaggccatcagtgacttggtggccctggggagcagcctctcatctttctgcctggccatccttggccaggaggtctccctgctgaccactccattcgggtctaatttggtgcttccagtgtgtccatggatgcattatgattcaaaaataatcatcgcactcatactcacggagtctgtatcatgttgccaggctctgagttcaatgctttgcatcctctatcccggttacggaagtgaaaaccacagagccagaatctcagcccatgtcacttggtccccaaggcctgatgctaccctgattttcttggatgccggctgcctcacccaaaaagtgtggattatgttagagtgaaagttccccaggaataaaaccacccaaaaaagaccagaaagggtagaagagacatcgatatcatggcatccagatccaggaaaatgacaaccagagagcccagcctttaatgtgagctccctagcagtcagagcaaaaagggaaagaggggacacataggcttcatcacctggaggagggagcagcacagtttacagcagaaatacgctctgtcacgtttcagagtgaagagtcagttggggtgacagctgtggaatagaggtgcccctcagggaagagggtccctcgctgctgttgccacattgtattaaaataaaactataaaaaagtggacaaggtatccatgtagaactcaataagtttccacaaaagctgaacaccttcctagaactggccctcagaacaagaaatagaacattccggcaccccagaagcacccatttctaattgctacccactccccaccaagagtaaccatgagcttgaattatcccatcagacaccagttttgtctgttactggacttcataaaacgccatcgtaggccgtgtcctctcatggccagctcctttggccccagactatgttggcgaggttcatccactgtgttgcatggaatttgccccgttcgcggctgttgctgggtcctgaattgtaagagtgcagcgcagcatgcacacgcactcagaggatttggttttaagagctgcgtgggagggtgcaatgcagaagacaagtctttgttctgcacagtgggtggttggagctcagagctgctgcccaaagcagagatcccggaagggactgtgccctctgatgggggtggctagaaggcaacccagccgctgccagaaggaagggactgtgccctctcatgggggcagctagaaggcaacccagccactgccagaaggagacagcagagaaatacgtttgctgagtctgagatgggtgataaaaacatttcctttgagaagtgacaacttcaggcccaccattatccaggtgggaggcacacattggcatcagttttgtggtccagaaaaccacaagctgagcaagtcacttaaagtggtcctgaattgataggacccagagcagcccggtggaaggaagtgcagcaaaacttcagacaaagtctgtgtcctcagccaaggccctgagctccccacctacagccgaggcaaacatgagctcacagcagaaaaccacaagcacacaaggaaagcagccaccgtgggcaagagccagcacccgcagtcagagacacatggagacaccaagggccatgaatgaggacatgaggagataaaataccagctaaatatttaaaacaatgggctcacccactgtcttgggaccacgaaggctcttctgagagagaaagtttcctatcctcagagttttaggtgaacatatgggtaaatctaatgggttattctcttcaaaatgtgtttgatgttgtaaacaaaaatcacaccattctctggtggggttttcaaaatgagtatttgtcatttatgagacaagtggtctctattgcgggaagattcctggattccacctaaattagtgaaatatcgattctaagtacacagtgcaaaagtaagcaatatacccgtactctagaacaaccattaaaaagatataaacaaagaatatagtcaagctggttctttgaaaagatcaacatattttttaaattttagcaagactggcaagatgaaaaagaaagaagatgcaaattaccaatatcaggaatgagaaaagggatatcacttcgggtcccacggacattaaaaggataatgcaggaatactgcacgccgcatacatttggaaactaagaggaaagggaccaattgctcgaaagacatgaaccaccaaactcaagaaggaagagggagcctgaatatctctatcaagaaacagaatttgtagttaaaagccttcccacacaaaaaaacccttcaaggccagatggtttcattggttaattctacataaccttcaaggaacaaataatctgaaagcaagcaggaaaaaatatataaatttatggataagtgtgtatgtatgcatataaaattagaaatcaatgcaatagaaaatagcaaaacaacggagaaaatttattcaaccagccaggcgtggtgattcacgcctataatcccagcacttcgggaggccgaggtgggtggatcacttgaggtcaggtgttcgagaccagcctggccaacacggcaaaaccccatctccactaaaagtacaaaaattagcctgacgtggtggcccatgattgtaatgtaagctacttgggaggctgaggcaggagaatagctgaacccaggaggcagaggttgcagagaactgagctgagatcgtgccaccacactccagcccgggcaacagagtgaaattccatctcaaaaaaataaaaaaaataaaacaagaaaattaattaaaccaaaatctggttctttgaaaagatcaataaagatcaataaataaagatcaaaaaagataagcctgtagcaagacagacaagaaaaaagagcagacacacatgaccgaggtgtgtgtgggatatcaccatgttggccaggctggtctcaaactcctgacctcaggtgatccacctgccttggcctcccaaagtgctgggattacaggagtgagcgtgcccggcccaaaactgttctatatgatactgtgatggtgaataaatggcattccacgttcatcatttgtgttgtagaacgtacaacatgaagagtggaggtgaaggttaggtctggactttgggtgctcaccacgtgtcaatgttggctcatcaatgatgacaaatgggccaccctagtgtaggatgctaacagcaggggacgttatgtaggtgtggcagcaggtgaaatacggtaattttctatacattcaactcaattttgctgtgaacctaaaactgccctaaaacatagtgtgttttctgaaatacgtccaaaaataaaaagttataaatctaacaaaatatgtacagaatgcacatgttataaatacaaaacactgatgaaaggaatcaaaaaatacctaaataagtggagagagtcgtgcattcatagatttgaagacacaaaataataaagacgtcaacttccccaaaactgatgtgcagatttaattggattccaacaacaatcttagcaggattttttggtagatattcataagctgtttatgaaatttatgaggaaaggcaaaagaaaatagaataacctcaaggatctagaactagaaataccatttcacccagccatcccattactgggtatatacccaaaggattataaatcatgctgctataaagacacatgcacacgtatgtttattgcagcactattcacaatagcaaagacttggagccaacccaaatatccatcaatgatagactggattaagaaaatgtggcacatatacaccatggaatactatgcagctataaaaaatgatgagttcatgtcctttgtagggacatggatgaaactgaaaaccatcattctcagcaaactatcgcaaggacagaaaaccaaacaccacatgttctcactcataggtgggaactgaacaatgagaacacttggacacaggaaggggaacatcacacactggggcctgtcgtggggtggggggaggggggagggagagcattaggagatatacctaatgtaaatgacgagttaacgggtacagcacaccaacatggcacatgtatacatatgtaacaaacctgcacgttgtgcacatgtaccctagaacttaaagtgtaataagaaaacatttaaaaaagaaaagaaaatagaatagccaaaacaattttgaaacaagaaatatagttggaagaatgacattagctgactttgagacattccataaagcgacagcaatgtagacagtgtggtatgggcagaggggtagacacacagatcaagggaaaagcacggagttgagatgtcactcgcacacacaagactgcgctaatttatgacaaaggggcaagacaactaaatggagaagtgtctgctgcaatcacaaaatacctgtgactgggtattttacaaacaatagaagtacatttctcacagttttggaggctagacgtccccagatcaaggtgccagtattctgcatctggtggaggctctttgctgtgtccttttggtggaaaacataaggggcaaaaaggacccaagctcatcccccccagccctttaatgaggcactaatctatgcctgagagcaaagccctgacttgatcacttctcaagagaccccacctcttagtaacaccataacaggggttaagttacagcgcatgaattttggggaacgcattcataccagcgcgcgaaaggagaaccgtttccaaaaaatggcattggaacaattgaaccgccgtagacaaaacgaaaacaaaacctcaacctcaacctcatactttatataaaattaactctatgcccatcatagacctaaatgttgaatataaaacaataaaacatttggaataaaacaggagaaagtcttagtgaccttgaataataaaaacacactgtgtaagaaataataatgtgagtgaaattcagtgtcctttaaagataaaaggtcacgtcataaggagagagacacacttggcagtgctcctggttgctggtggaggaccaagtgagtccttatttagaagggacattttttttttctgtgccattttcttcatcgaacatttagtcctttgaaagcttgtgattatcttatgttcaaatgctatgaaataataaagtcacagggcagtcccactgcagcgtgacaatgagggggaactccagagatccacttccatgtgaaactggtgaagactttaaaaacaaaaacaaacgaaaccccacccccaacaaccatttaaagcatctgcaaatggccctgtagccatttcaaatagagaaacatttattcaagaaaatcgactaaagcttagtgagaactgtgtgagtctgtggtatctgagccaatgcgtgtgccctctcccagcccagtgagacagaagctccactccaggctgtacagccaggaatgcaagactatctctcctccagtttctgtaattgcccgacaggctcttcccgcccgctgcacagacaaaaccagttcactctgagaacatggtattgcagtaaatgaaatgtttaattaacgcaaggcctgccaggtggaagaactggaatgatcactcaaacccgtctccctgaaggcttgaaggttagggtttttccaggacagtgtggtgggtggggggctggggaatgggtgctcctcattggttgcgggggcaatcacaggggtgtggaaaatggtccttgtgccctgaatctgcctctgggtggataacaaccccaaagtgaaagcaacccagacatccttcaacgggtgaacggttaaacaagtcgtgagtcacgagtctgcatggggtcagttggaaaaccacctcaaaagaccaatcttaattctaccacagtgatattatctataggagcaactggggaagccacaaatcttgtgatctctggacaaatgactcctaagcagagggggattatagaaactatgcctatattttagcagaactcatgccctcctgtaattctaatcttgtggtctttcattagtcctataaaggcagtttcagctccccaaaaaggaggggatttgttttagggcgggaccgttatcatccttgcttacaagttaaactataaactaaattcctcccatggatataatagaggcaggaggcagacaaatcccaggcagatgggggtgggtccccagtgaaacctcaccttcaagccaaaacatcctgaaacctgcagcccagagtgaaaacttctattcttgtttgcctgctcgctccggattggttcattttgaataatgcctttttaaccaatcaaatactgccttttccaatactacctatggcctggcctgcccccgtcctgggcctataaagactccagactcagttggtagagagagagagaaggcctgacttcaaggaagagatctcctgactttggggaagacgacctgccctccctgtcccctttccagttcccctctctgctgagagctgttttcattgctcagtaaaagtctccactttcaccatccttcaatcaccagcatgacctcattcttcttggacgctggacaagagctcaggacccacagagtgcaggtacctagaaaggatgtcacccgggccctttgccctcgccagcagagggcagctgccccacgcgatgaggccaggggccgaccgagctgctaacacattgccctccattgggatgtggatggtggaactataagagctgattagagcactaacaccccctctggggcttcggggttgcgggcacccttgtctgggcactgccatgttctcctcgaggtgacacacctggtctggctgtgggccccacgtggagtttgctcccgtgtcagcgttcagagtggctggccagatcccacacttgctcgctcatgcactccctcccgcaaggggctgagcatgctgggccaagtagatgaggagcctctgctgtgagtccagcaaagaggctgagaaaaaatcctgcatcagttagcttggcctgagtccaggaataagcaaggacaaccagcctatgagccagaagcaagatggagtcagccatgctagacctctctcgctgtcaaaaggtagtttcacttccagttggtgaggctctcttcctgtgagggtcagtgtgctagcatcctgcccccagctacctgtgtctcaggctgaattctgagtgagtgtgtccgagaggtgagggtcccttcctctactcagcctcaggtctcactcatgcagcaaaggctgccctgggttcatcatgctgagaatcctgggtctcgggtctctggtcacctttgctccagcttatgggaggggttcatgctgagagaggcaagctgaggacacctggagctgctgcccatcactcaagtgtccagcttctaaagtaggcatgacaccagtgagccaagatccctgccgtcagttccagagctgtggcttagagattttgtccagggagaatggcaggatgtagaacagaggatctcctagtctctcccaaaaggaactgacttcatttgcaacagagtatgaagttcaaacctaagggtgctctcagagtcagtggcggttgtggtgaagggcaactgggagaagattgatagattctttagagacgtagcctaactctaagatggctagttttctggagagaaatggagaaagagagagctgggaagagactttctgggttagtaagaaatctcaagcactggcctttcctttcaaaggagtcagaatttgattggattagtctgtgaagcaatttattccctagggtgatgtcaaaaacaatcgagcaaccagcttgcaatgacgaatttagcagctgggtttggtcagggaaagagacgaagagagccttcccacacccccatcatatcaaggtggacctgcccactacttctcaggggaaacagactttactgcagtattccagtcattgcagctttcacctaaaagctttcacacaattgctttgggctattcataatagccccacactgaaaatccaggcgtccttcaatgggcgaacagttaaataagttggggctcgttcagcttatggaatatgtttagcaagaaaaaggaatgaactattgatacataccacagcctgctaatctccagagaatcatgctgaatgaaaaataaaaagccaattcaaaaggttacatgctgttttatttcagttacataacatccttgaaatgaaaactttatagaaatggataaccaattagtgtctcctagggtttatcgcccagggttccggcagtgatgaatgtggtctgtgttttgaaaatatcgatgccaatattctgattgtgatattgttccgtagttttgcaaggagttaccattgagggaactggataaagggttcatgatattctattatttcttacaactgcatgcaaacctaaaataatctcaaaataaaaagattaatatattaaaaaaagaattaggatacttctgctttgggtcaagatagagcaacagagaataaatatacaattgtaaatgtaaaacaacaacaacaaaaccaagacaaacacattattctcaagaggtagacaacagacaagaaaggactgggaggtgagccctgggacgtgagcccttcagtggccccaggtttcagccctcagagtgtttccaggtcatggcgcagggagaggagaccccggggaagctcagtgtattccttgagttgagcatttgtgaagaccaaggcagcccgaggtcacagggcagagcatcggagagtggagcgctgcacagggagctgggagacatgcggagggtcccctcttcagtcctcagcagggcactgaatggcacatgcgtgggagagaactacttgaagccagggaaagaaccagcagagaggaccaaagggaactgtgccaggcgcgcacacagggctggggacagtgactgaccccagcagaaaggctggaaaattccacaattcatggagcatgtgggtggaatattgagaagggtctcaacagtggagaataaataaccttctactaagaatcttccctccataattgctagaaaaagcagatggaaactaaataagaacacagggccgggtgcggtggctcactcctgtaatcccagcacattgggaggccgaggcgggcggatcacgaggtcaggagatcgagaccatcctggctaacacggtgaaaccccgtctctactaaaaatacaaaaaattagccaggcgtggtggcgggtgcctgtaatcccagcacattgggaggccgaggcaggcagatcatgaggtcaggagatcgagaccatcctggctaacacggtgaaaccccgtctccactaaaaatacaaaaaattagccgagcgtggtggcgggcgcctgtagtcccagctactcgggaggctgaggcaggagaatggtgtgaacccgggaggcagagcttgcagtgagccgagatcgcgccactgagttccagcctgggcgacagagcgagactccgtctcaaaaaaaaaaaaaaaaaaaaaaaagaacacagaaggcttgaacaacgctttaaaccagcaggatgtagtcagcgtttagaggtcactccacccaataacagcagaatacacactctcttcaagtgcacagggaacatttaccaacatagaccatattctgggccagaaaaaaagtctcaacagattttaagaggtccaagtcccacagagtatattatctgaccctatggaattcaatcccacatatttggaaactaaatagcatactgctaagtaatccacgggccaaagaataattaaaagagaaacccaaaattatttcaaactaaaagaaaatcaaagctacatctaaatttgtgttttcacaaatttatagcattaaatgtccatgttagaaaagaagttttccaggttggacatggtagctcatgcctataattccagcatttgggaggctgaggagagaggattgcttgagctcaggagttcgagaccagtctgggaaatatagtgagcccttgtctgtactaaaaatcaaaaatattagctgggtgcagtggtgcatgcctgtagtcccagctactcaggaggctgaaggtgggagggtcactggagcctaggttgttgaggctatagtgagccgtgattgtgccactgtactacagcctgggtcacagagcaagaccgcatctggaaaaaaaaaaaaagaaaagaacagcaacaaaaataagttttccaattcatgacctcagttttcaccttaagtaatgagagaaaggagcaaataattaaaaaaaaagaaaaaaagtacatttaaaggatcagagtgaacaatcaatgaaacacagaacaaaaatagagaaaatcagtgacgccaaatctcattctttgagatcaataaaactgataaattcttagctagactcatcaaggggaaaaagggagagaaaagacacaaattactaacatcaggaatgacaacagcataatcatcgtaggttctactaagtgttaaaagaattgagaaggaataatatgagcaatttaatgttgatgcatttaacagcttagattaaatggacaaaatttatgaaaggcacaaactttcaaagcttactcaagaagaaaaagataaccagagtagccctgtatttatttaatacgtaaaatttggctttaaaaaacaaaaacaaaagcaaaaacaaaacttcccacaaagaaacctcctggcccaggcagctttacaggcaaattctaccaaacatgcaaagaagacttaacaccaaatccacactcatgtttgcaggaaattgaagaggaaagaacattcccaactcattctaaaatatgcacagaaatgaaaaaaaaaagtcacatctgaaaaaggaaaagtctaccctacttgattttaaaaaatgtaaacctgcctgggcacggtggcttacgcctgtgatcccaacactgtgggagactgaggtgggcagactgcttgaggccaggagttcaagaccagcctggccaacacagtgaaatctcgcctctaccaaaaatacaaaaatttgtccaggcgccacggctcacgcctgtaagcccagcactttgggatcttggacttctgaccgctagaactgcgagaaattgaatttctattgtttaggtcacgcaatctgtggcactctgttctgtcagccccttgttgactgaggcagccatatctcaagatattttgtttgttaaacttgtggggagggtgctgctggcattggatgggcagcggccagggatgccgctgaatactttatgatgcacaggacggctccacaccaaagaatggtctggccccaaatgctgataatgtcaagattgaggaaccatgagataaataaataaaccagtgaaacaggatagagagtttggaaacagagccgcacataaatggacaactcctggtctctgtaacaaacgctgctggaataactgcgtatctgtgtgcaaaaagtgaacttcaaggtacacatcatgccacagaacactacctccaaacaaatcataggtttacattcaaatttaggagaaagtctttgtggcctcgtattgggcaaacatgtcttagacatgaggccaaaagcacacttcataaaatacaaaaagtgatgagttgaacttcatcacaattaagaaattctgtgtttggagaggcactgttaggagagtgaaaatgcaagccacagatggagagaaaacatttgaaaacatattatctgataaaagacatgtatcagtctttaaggaattcttgaagtctggctgggcaaaatggctcacgcctgtaatcccagcagtttgagaggctgaggcaggaagagcaattgaacccaggtgttcgagaccagcctgggcaacatagcaagaccccgactcattttgttttaaaaaaataaagctaaaaaaagacttcttaaaaatcatgactgggcaagtggctcatgcctgtaatcctagcatttggggaggtctaggcgggtggatcacttgaggtcaggagtttgagaccagcctggccaacatggtgaaaacctatctgtaccaaaaaatacaaaaattagctgggtgcggtggtgcacgcctatattcccagctacttgagaggctgaggtgggtgaatcacttgaacctgggaggcggaggttgcagtgagccaagatcgcaccaccacactccagcctgggcgacagagcaagaccctgtctcaaaaaaaaaaaaaaaaaaaaaaaaaaaaaaccaataagaagaaaacaactaagtatggaaaatgggcaaaatatttattatttattttgttatttattttattaatttttatttcaatagcttttggggtacaagtgatttttttgttacatcgatgaattctatggtggtgaattctgagattttggtgcacgtgtcacctgagtagtgtacatcgtacctaaaagtgtcattttaaaaatctccagccccctctcgccgcccctcttctgagtctctgaagtccgttacatcactctgtatgcctctgtatactcacagcttagctctcacttaaaagtgagaacatacggttttttattttccactcctgtgttacttcacttagaataatggcctccagctccatctaagttgatgcaaaaggcattattttgctccgtttttatggctgagcagtattccatggtgtatctgtgccgcattttctttagccactcgttagtcgatgggcacttaggttggttccagatctttgcaattgtgaactgtgctggaataaacatacccgtgcaagggtctttttcatagaatgacttcttttcctttgggtagatacccaggagtgggattgctggatcgaatggtaggtctacttttagctctgtaaggaatctccacactgttttccatagaggttacactgatttacattaaaaatgggcaaaaggggccgggagcatggcccacacctgcagtcccagtactttggaaggctgaggcaggtggatcacttgaggtcaggagtttgagaccagcctgaccaacacggtgaaaccccatctctgctaaaaaaaaaaaaaaaaaatacaaaaattagctgggcgtggtggcacacgcctgtaatcccagctattcaggaggctgcggcaagagaattgcttgaacctgggaggcggaggttgcagtgagctgagatcatgccattgcagtccagcctgggcaacagagcaagattccatctgaaaaaaaaaaagaaagggcaaaagatttaaacagacacttcatatatatatatatatatatatatatatatatatagcaaataagtgcatgaaaatgtgctccgcataattagtaattaggaaaatgtaaattaaaacccacgaagtaacactatatactccttggaatggcaacagtttccatgtcgagtgctggcaggggtggcagaaatggaactctgtacaccactggtgggagagaaaatggtatggcccctggggaaatcggcgtggcagtttcttataaaattaagcgtacacttagcataagactcagcaatcctactcaaagacatttatccaagtgaaataaaaatctgtgttcacacaaaaacctgcataggaatgtttgtttgtaattgccaaaagccagagaaagcccaaactgcccctcaacttgggataaagtgtggataaaagtggataaactgtggcacatctgtaattgggagtcctacctcgcaaagcaaggggcaaaccatagaggcacacaacacgaacgaatctcaaggcatcagcctacgtgaaagaagccaggcttggaagattccctgttgtatgatcccagaacgtacggcattctggaaaaagcaatattacagaaacaagaaaaagatcactggttgccagggcctgggagtggggaaagaacgtttgaccacaaaatggcaccggggatttgagtggaggtgacacgactgtatggttgctaaaaactcatagagctgtgaatgttaccttatcatcatcattattattattattttgagatggagtctcgctctgtcacacaggctggagtgcagtggcacgatcttggcttactgcaacctccaccttgtttgggttcaagcaattctcctgcctcagccttcctagcagcagggattacaggtgcctgccaccacgcccggctaattttttggtagttttagtacagatggggtttcaccatgttggccaggctggtctcgaactcctgacctcaaatgattggcccacctcggcctcccaaagtgctgggattacagacttgagccaccatgcccggtctattgtttaataggggaaatacgtcccatcccaagtgtgtccctggcccctcctggtccttgccagctggttcttgggagtcttcaggtgtgttgtgtctttctcacctcaccaggtcccatctgtcactgaccaagttaggctggcatttaacctcagttacctggaagtcaggtgaaaagatgaggggcagctttcaaagggcacctgttgtcctgtgtgagaaaggtttcagcagctcgctcaaacgtgacagcagtgttagctctgcctgggaagggccgacctcccgctaagttctgagagtccaggtgggttgcagagtccacatctttggggacacatatccgcatgtttctgtctctgttttcagggcctgacttcacgtccctggtcttccttggctgagcagtccaacctctctgtgactctgggactgtcacaatcaggtcatcagtctgccactcagctgggtctgccttccatggaggggggcaggggcttctttgtgagctggcaccaagccccctggctctgtgcttagtccaggactcttcattggcagccgtccatgtttcattatccttgggctgggctgccgtgcagctcagcggtgccacccaaccctgctgaccttgttggcattgtccccttttgctttgcaaatgcctacgtcatcgtactgccacaggcctctcctccacctagaccttccctgcaaatcatcaccagcaaagattttaacaatgggggctccacctcgtgtcaaggactgtccatgccccacccaacagccagaggggtggttccagtgcctcctgaccagtaggtgggcccgtcccaagtgctcatcccagcacccgccttctcagaacactctcagcactacttgctttcgtcaggggccttctaaggagcaggcccaaagatgggatcaaatgcaggggatttcagcagggaaatgtctacgtggaggaaatggggaggagccataagggctgggggagccatgtccctgctgcaagtgtgaccctgaatgaagggcgaggggaagcagcatgggagaccgccatgctatcaaagaaacattggatgaggcctccggggatccctacgccaacgtctttcatcagaggggtgtcgggtctcccaggagcaagcccgcatagcaccccagtctctggaagcagcccatggctttggcgtaaatgcggtgctggatgcagagtgcacctgccggggcctgggaaagccactgtctgcacggcaaagtcaattcgtatgcaggagagcagaacatcacaacgaatacacagcccacaagtcctctaaggaacccagcaccaacacggaaaaggacataatttttctcaaggacatgtgacacattcacaaaagatttaccgtaaagtcagtattgaaaaatttgaaaagattgaaatcatacggtgagtattctctgcaattatgctacaactccatgaataaaatgtaaatagaacattctgggccgggcactgtggctcacgcctgtaatcccagcactttggttggccaaggcgggcggatcacctgaggtcaggagtttgagaccagcctggccaacatggtgaaaccccgtctctactaaaaatgcaaaattagccagacatggtggcacgcgcctatggtaccagctgcttgggaggctgagggaggagaatcgtttgaacccgggaggcggaggttgcagtgagtggagatcacgtccatgccacttgagcccaggagaccaccctgggcaaaatagaaagattccatctctacaaatataggtacacacacacatatatacgtatacaaaaattaacctggtatagtggtgtacacctatagtcccagctactccagaggctgaggtgggaggacggtttcagcccaggaagttgaggctgcagtgaatcatgatcacacctctgaactccagcctggatggcagagtgagaccctgcctctaaaaaaaaattaaaattaaaaaaatacattaattaaaaaaaatttttttttttgaaatggagtctcactccgtcacccaggctggagtgcagtggcacgatctcagctcactgcaagctccgcctcctgggttcacgtcgttctcctgcctcagcctccctagtagctgggactacaggcgcccgccagcacgcccggctaatttttttttgtatttttagtggagacggggtttcaccgtgttaaccaggatggtctcgatctcctgacctcatgatccaccagcctcggcctcccaaagtgctgagattacaggtgtgagcaaccgcgcctggcccctaattaaaatgttttaacaaaggttcattttaccccttcttgttttttttgtttgtttattttttgttttttttttgagatggagtttcgctcttggtgcccaggcctgagtgcagtggcgccatcttggctcactgcaacctccgcctccgggattcaagtgattctcctgcctcagcctcctgagtagctgggattgcaggtgctcaccaccacgcctggctgattttgtatttttaatagagatagggtttcactttgttggtcaggctggtcttgaactcctgatgtcaggtgatccacccacctcggcctcccaaagtactgggattacaggcgtgagccactgcacccggcctaccccttcttttattctgcattttcttcaccaatttgtcaaccagccaatttgtcaccaacttgccacagttaccttgcactcaaactacacttaaaaataaaattagaaaacatgaaaacatctgaagggaaaaatcgaagctcatcgtcatagcatttttacacagatatatactagatgaaagagctgcagaaaatgctgcctctatggccctcttgtttgctgtttgtgcaccagttaaaacaactgaggttcgctggaatatggtgcatacttcagactgtggaatataatattctctgactaaaaactgttgcgttgagtaaaacaaacaaacaaaaaagtattttttcccagctactcaggaggttgaagcacaagaatcgcttgagcccgggaggtggaggttgcagtgagctaagattgtggccactgcactccagcctggacgacagagtaagaccctgcctcaaaaaaaaaaaaaaaaaaaattaatgaattaagcattcggtgcaagatattggagagagaaggacataaataggatagcaaataaagcaataactattaaaggaattcaaactaaattaaaaccttcctacaaagaaagctccagggtcatgtggcctcaccagctgctgcaccaaatataaaatgcagaggcaaaaaccctgttaagcaactcgaggccaagcaggccaaatcttggcacccaagccccaggggggcggcgggcacaaggaagcctgggagtccagcgcacacttgcttctggaacaaagaggcatgacaaaaatagcagcgtttcaaaacacaaatacacaatgaacattttaggcccagtccaggcacgcgagcctgttttaacattagacaaaatgtccaagaatgtcatttgctgcattaacttccttgaatacacgaaagaaaatcacataaatgatgtagaaacgtcattccataatatttcataggaatttaataaaacggggtcatttctgccagaatgcattgtgtaaaatgcaaaccagctcaaaagcaactggcaaataaagtaatatcagtatgacactagaattattctcctttagacacctttccccccagcatattaatgatgtaaaaggactgaggtaagcattttcacaattaagacaggcgcttctctccacgcgggccatggctggcttggtgtccgcagggactgctgctgcacctgccccgatgagccatctgaagaagctgggggcacacatgaaaaggctgagaagtgctgggcaaggtggctcacacctgtagtcccagcactccggtaggctgaggtgggcggatcacctgaagtcaggagttcaagaccagcctggccaacatggcgaaaccccgtctctactaaaaatacaaaaattaaccaggcgtggtagcgggcgcctgtaatcccagctacgcaggaggttgaggcatgagaatcgcctgaatccgggaggcagaggttgcagagatcgtgccattgcactctagcctgggtgacagagcgagactctgtctccaaaaaaaaaaaaatgcatttcacccatggtgaaaaaaaatcatgaaaatgcctacaatctgaagcacacgtttaaatttgggaaaatctgaagtgagtgcctgtcagggcctctttgttgaaatgagaatcctgagccaggattgaaggctgagaaggggcagttaacaggtgctgggtggacgtgatgacggggactgaactttgctaacgcttgtcatttactccagtcccaaaattacacagctttggaacaaaactgccgcccagatctatttttccatcagctctgttagtttttagtccatgctttcttttgcagaataaaaagtctttcctatttatggcattatagcaaaaatgtaaatattagcatattataaatgatagggaagttctttaagttaatagaggatgtctgcaaatacccagaacaaatatcacacaagtcctacaaacttcaaagatttatctttgagataaggattataaaagaaaagcctgctatcaccacctgttttacattgaaattgaggtcctagaaaatgcagttagtcaagaaaaacacataaaatgtatgtgaattagaaaggaagaaataaaactctaattattcatatgataaggtgccatgattatatatataacaaatccagataaagctacaaaacattattaaaataagaaatgcatttagtaaggatcctggctatatgattactctttaatagtcaatagtatttcttcacattagtaataaaaacttagaaaagaaaatgtttcaaatggtgtgacatttacagtagcataaaaatcaaatatctagaaataaatttaacaaactgtgtaagactacacagagaacaataaagcgtttttttttgggagaaattaaagaaggcttacataaatggaaggttatagcatgcttggagatttggaaaacccttgcctattataaaaatatgtaaagaaaaacttacatattataaaaatgtaaattcattaacggcaaaaaccacagttgtttttgcaccagcctaatatttggggagaatttacgtttttacaatgtgtgagagtttttgtttacatatgtttataatacgtaagggttttccaaatctccaagcatgctatatggcatacttttaatggcaaaaaccgcaattaattttgcaccaacaaaaatatatctatagatttaatcaaaattccgataggcttaaaaaaatttggataaactggctctaaaattaagtgaaaatctaaagtaaaataatcgagaaattcttggagagtgacaatatgaggggtggagtggacatgtgggcttattctcaagctacggtaagtaagatgatctggcatcggtacagcaacagacagaagagcaaatagagagccgagcactagaccctgcatccaggaacacttgaggtccagctaaggtgtctcagcagaacaatgaagaaaggacgggttttcaaaacagcagagaggcggaactcacctctgcctgtctccatgcgcagggagattatccatctaaatgtgaaaaacaacataataaagaccctagaagatcatcaagggtgatatcttttattttattattattatttttttgagatggagtcttgctcttgtcacccaggctggagtgcagtggcatcatctcagctcactgcaacctccacctccgggttcaagtgattctcgtgcttcagcctcccgagtagctgggataacaggcgcacgccaccacccccggctaattttgtatttttagtagagatggggtttcaccatcttggccaggctggtctcgaactcttgacctcaggtgatccacccaccttggtttcccaaagtgctgggattacaggtgtgaaccaccgcacctggccggtgatctcctttatatctggttaaatcaagaactggtaataaagaaaaggacaaccactgaagacccctgcttcgttgagatgtcgtgtatcactttaggaaacaacgctacgaccactagaaaaaatgcagatgacaagtacacacaggacattcaagagccataaaagcaaagaagactagagcaactcaacttccaaagaataaccttttctagatagttgctctaaatggctgattttctcctgggggcccatcttgggagagggctgagggttgggtttggcctgggtgttgggattctgctaggggaagagaagccagtggagacattgctgagtctcgtggggctggaagggagtggcgggaggcgcagggcagagccggttgtggccgctggacacttgtccaggtctagggtggtccgcagagcggggatgttgggttggtaactgttaagaggctgagtgggccagacgcggtggctcaagcctgtaatcccagcactttgggaggccgaggcgggcagatcacgaggtcagtaaatcgagaccatcctggctagcacggtgaaacccgtctctactaaaagtacaaaaaattagccgggcgtggtggcaggtgcctgtagtcccagctactcgggaggctgagggaggagaatggcgtgaacccaggaggcagagcttgcagtgagccgagatggggtttcaccatgttggccaggttggtctcaaactcctgacatcaggtgatccacccaccttggcctcccaaagtgctgggagtacaggcttgagccagcgcacctggtttaaccagatttaaaagatatcaccggccaggtgcgctggctcaggcctgtaattccagctctgggcgacagagcaagactccgtctcaaaaaaaaaaaaaaaaaaaaaagaggctgagtgaactcctctcttgcggccccatgattcgtgagtccctctggagacagtggcttgcccccagtgctcgaggcccccaggattcccacccagatctccagccagagcgaagagcaaagagcaaaacctctgccgggaagacggaatctgcatcctctttcacggcttaggagaaacatttaagggctcaggagggttctgccccaaatcggtaacaaactaaaagcgactgactcagaaaatctcaaatccaatcctgagcaaacgcagtcaaacgaattcctcaaacaaactgggttgaaaccgtcaagccctcccatgcgatccacctagcaggagaaaatcttcttcacgagaaaacaacaatttgtctttaataaattaatacataatgtttagcctctgaagttcttttatgcataatgtatgaaatgcaaaaataaatagagacatgaaaagaagataaatacatccaatatcaagaaaataaacttagcaggatggttacctgttgtaaagaacgaaaaaagaaaagaaagccagacagtaagaggcaaccacttataatctgtatgttggagttatgcattaaaagaactattatacatatgttttgaagatagaggaaaagatgaacaaaatgcatgagaaggtgaagaatctcatcagaaaattggaatctaaaaaacaatggtataagcattgttaaactaacattatatctaaaatttgaaaatgcattggatgaaaaaacagaatatagctgtgctatgcccacatatactttctgagagtagatcctgagatatttacacaagttatatcctaaggtagtatttcttaaagtgtttggcaataatcaagatataattaaattttgcttaaaatacacaatgtatagaaaatgttggattaagcaacactcaatagatttccaagcaacatgtcttttgtgagttttattttacctagctaatatgcattatgaatcttcagagaagggttcttaacatattcttttgttttccttcacacaagccaagagtcctaatcaagattttctgcaatcaactatgattcttctaaaaacatgttgggtatattcaatcatatgctgaacagagcagaagactgaattagcaaatttaaagaaagatgaatagaaaatatacaaatcaaagacagtctttcaagggacaatcggtcagcgtaactgactgattttatgagttagttgatttctcattagaaacaatggaagccgtaagagaacgggatgacagtgtggtggtggtgtttttttaaaagaaaaaaatggccaacctagaattctataggcaacaaaaatatccttcaaaaataaaagcaaagaccatttcagaccagccaggctgttgcaggaaacactcaagggagatttttgtgctgaaaaaaaattgtcccagatagaatgcggaacttcaaaacagaatacagtgtcctggaaaggctgagtaagtatgcaagtcactacatggaaaaagagaaagagaaagagagagagagagagagagagactgcgtatttaaaacaaagagattacagatgtttataacatatatagaggtaaaatataaaatgacaatagcacaaagggcaggaggaggtagacatggttaaattcctgtaaaatgtctgtactgtttctgggaagtggtaaaagcacaactttctttagaccgtaacaagccagtaactcctgttgtcatattatcactcctaagagattaatacaaaagtatatagctaaagatctaatggagataaaatgaaataaaaacatttgatttggccgggcgcggtggctcatgtctgtgatcccagcactttgggaggccaaggtggatggatcactaggtcaggagatcgagaccagcctggccagcatggtgaaaccccatctctactgaaagtacaaaaaattagctgggcgtagtggcactcgcctgtagtcccagctgcttgggagactgaggcaggagaattgcttgaacccggcaggtagaggtttcagtgagctgagatcccgccactgcagttcagcctgggcaacagaaagactccctctcaaacaaacaaacaaacaaaaatttgattcatctaacaaaaggcagaaaagaaataaggaggaaaaacaagtgagtcgaggaaaacattgcaaaacaaaggtagatttaaatgtaactatatcataattattttcaatgttacaataagtggataatcactgcagataaaagtcaaattagtcaatacaactttaaaaaaaacaaatgttgtttacagcagggcacagcggctcacgcctgtaatcccaacactttgggaagctgagatgggtggagcgcttgaagctcagaagttcgagaccagcctaggcgacattgcaagaccccatctgtaccccaaaaaaaaaaaaaaaaaaattagccaggcttggtggcatgtgcctgtgttcccagctactcaggaggctgaggtgggaggatcgctgaagctcgggaagtcgaggctacagtgagccatgattgtgccactgcactccagcctgggtgacagagcaagacccagtctcaaaaataaataaatacagcctggccaacatggctaaaccccatctctactagaaatacaaaaactagctgggcgtggtggcacacgcctgtgatcccagctactcgggaggctgaggcaggggaatcgcttgaacctgagaggcggaggttgcagtgagccgagatggcaccactgcactccagcctgggtgacagagcaagattccatctaaataaatacataaatagttttttataaaagatataattaaaggatatgcacagattggaatcgaaatatgatatagcttacaaacattacccaaaagaaagcagaggtagttaaataaacatcagaaaggaagtagacttaataaaagaaatattgctaccaataaaatgaatcacttgataatttcaaaaagatcaatcaaaaagacacgacaattctaaacttccattcatctgatagcgttgcttaaaatacgcaaaagcaaagcttgacagtggcaaggagacatagacaaatctacaatcagagttggaggccgtaatgcacgtctctcagcaactgataggacaattagactgaaaatgaaatcagtaaggcaggagaagatttcaacaacataattaaccactggaaataattaaaatttacagccaataactggaaaataaacatcttttcaagtgcacatagacacagttacaggaacagaccaaaatctgcttcaaaaagaagcctcatgcattgttaaagtattgaaatgatctagggaatgttccctgacaatagtaaaaataaagccagatactgagaacagaaggataactacaggccgggcgtggtggctcacgcctttaatcccagcactttgggaggccgaggcgggcagatgacctgaggccaggagtttgagaccagcctggccaacatggtctctactaaaaatgcaaaaaattagctgggcgtagtggtgggtgcctgtagtcctacctactcgggacgctgaggcaggagaatcgcttgaacctggaaggcggaagtcgcagtgagctgagattgcgccactgcactccagtgggggcgagtgtagagcgaaactctgtctcaaagaaaaaaacaataataatcactataaaaatctgaatgtctgccgggcacggtggctcacgtctgtaatcccagcactttgggaggccgaggtgggcagatcacgagatcaggagatcgagaccatcctggctaacacggtgaaaccccgtctctactaaaaatacaaaacaattagccgggcgaggtgacaggcgcctgtagtcccagctactcgggaggctgaggcaggagaatggtgtgaacccgggaggcggagcttgcagtgagccgagatggtggtgccactgcactccagcctgggtgacagagcgaggctccgtctcagaaaaaaaaaaatctgaatgtctgcaaattaaccaagtgtctatgtaatcaaggattcaaaaaagaaatcaggatagaactcagaaactatattgaaacaaatgataataaaacatatataatatcaaaacttgtaggatatttatggatttaaattaattcattatattatgaaaaaagaaagttaaaaagaattattcaccaaagaggctggagggaaaaacagcaatttaaacccaaagaaattacaagaaagggaataataaagttaggaacaaaaattaatgaaatgaaaagcagacacacaatggaaagacccacaggcaaacttttcttttttaaataagtatattgataattatctacaagactgaccaagaataaagagaatcaaaagttgtcaagagtatgaaataggatgatcagaaatgaaaatgtgggtacagacatccaaaatggaataaaaatatactatgaacaactttatgtcaatacatctggcagcttcaatgaaatggaaaaattccttgaaaaacattaccagttatgaagacttaatacagatagtattcccacaggaatggagacagtctgatgctgctgtaaagtcagataaatagaccagtgggacagactgaagtccagaaacacatgcaccacgtctctacggccacccaacaaaccactgagggcccctgcaacttagtgggggaaagatggtcttctccatgagggacatggcagcactgggacgtctctatgggaagaataaaaatactaacattgccccggagttggttcaggttctccggcagcagaaccagaagtgagaagatctccatgtctgtaatttactggggacatgctcctaggaaaatgggggaagggaagtaagatttcaggagagtgggggtttctgtgcaggcccagcttctgcctaatcaatggcaactcttgatcatagatcataagtttatcttgatgcagacaggggagcttggctttggggctccagccggaaacagcagtgactaaagactgtgaaagggatatgaagtccagatacagggtcttcccaagtaccatctcagtcgtggactcttggagacagatgcacactgaggctgggggtggggcacagaggaacagtggtatgacccaagcagacctgggtggaggacctacagtgtcctcagctcccccgacctcccacctcacatcatacacaaaaattcatccaaggtggagcacagacctagatccaaaaggcagaacaataaagctattaagagaaaagcttcatgaccctgaagtgagtaaaaaaaaaataaagaaaaaagaaattaaaaattaacaggacatgaaaaacatcagtcatacaagataaaaattataaatggaatttaataaaaaataacttagttatcagaatataacattaagacagtgaaaagacaaactgcagagtgagagtgtgcctaattacatttgtctggaatggttcctcaatctttccttgacgttcatgacctcgacacttctgattataggccagatctattctcacgatccctcagtttgggtctgcctggtgtttggctgtgcgtttttggcaggatattagtcacctcaggctgccacagctaatatgactgggtggctgaaacaaaaaaaattattctttctcatttctggaggctggaagtacaagaccaagatcaaggtgctggcagatttgggtcctagtgagggctctcttcctggcttgcaaacggccgccttgtcactgtgtcttcacaggctgtgggagagagagaacaagccctctggtgtcttttctcataaggacactaacctcatcatgggggtcccatcctcacgacctcatctaaccctgatcagctcccagaggccctgccgtcaataccatcacagtggaggtgacacaaacattcagtccttaaccggcagaaatatcacagaaacgactccgttcttatcagtgcatcccatcaggtggtgaacagtttcaatttatctggttgttgatgacattcactttgatcatttgatcaaggtgatgcctgctgggcttccccacctgtaaagttacctctgaaggcataaagtcataaagtttctttgtgattgcgatgactctttaggaaatttctttggaactaaagatcactgtggttgttcaactaccagtttattgatgtattaacatcagtgtattaaactcgggttcctattttatgcaataaactgtaatcttgactaacattattggctttgatgctcaagttgtctctggcgtggccggtgggaagcgactcctgcgtgttttctgcatgtcctcgccctggctcatcctgcccctgacctgtctcagcctggaatcagctgcttccccagggagccccgggtcctgtcggtggtgagtggtatttaggggccagggtctgccactggggggttgctgctttcagagcctcttagaggaaggagctggagaataaatggattcctccaactccaatccaacaccacaggctgcgttctagtttcatccctttcaatatttgtcactctctttgcccacagtgagaaagcagactcccatttacttcaatatctttacttcttctaccgaccccctgggtgtaatcacctccctcccattgccactgcccatctccccgcagatgcccttctcatcaggcatggctctggccccctccttgcagcccctcctctccgtgcccagcctcctgcccccctcctcgagtgccttccccacagggatgcccccacattctcctctctgtgcagcttagttcacaataaaaattactaatcaccactgctcactttccattcccagagccacttttcttctggagatattctttctatgcattggaattacttatgaataaatataaggctaatttctctcagagatattacttgaacccaaagatgttcatagttatttattttattttcatatgcatatgaaaatatgtcagtagacatttgagttatttcccattgatggcatttatacataacactgcaatatataaaagacataaatattatacagaaaactacatcaagcataaatgtacaacttaatgacttttataaagcaaatagtcatgcaaccaccaccagcatcagaaaacggaaccttcccagcaacccagaagttgccccacctgtgctcagatttgtcaaatgcatcaacgtttttcattatgatcactctatttgtgtcttgccgagaaaagcagtaaccaaatggaagatgttggtaattgtgactatattaaaattggaaacttctgtctataaaaagatgccactaggagagcgaagaggaaagcctccgagcggaagaaattatctgcactgcgtagaaccatcagaggacgtggacacgctgtcctgagagaacccctagaatcacggagaaactgacagcctggtaggaaagaaatggtcaagacactgaaatagtcatttcacaaacaggaaaaccaaatggccagtctgtgcgcagaaaagacgctcgacttcctcacccatctgggaaacacaaaccaaacccaccacgagatactaccacatgttcccctgagtggcaaaaattaaaaaaaaaaaaaaaaaaaaaagactgacagcaggtgcactggggaggaaatgaaacggtgggaacacacactgctgggggaggcgcagccatcttggagggcgggcgtcgcctgctgaggtggaggatcagcagacttcataattcggcaatcccactactaaggatctgcccgagagacatgggttctgggggccccgagcagcacacacaaggatgcttgcagcagtggtacccctaaatgccaagacggaaaccgcccaagcgtttgtcggtggtaaaatggatatgtacgctgtggtacatgatgcaatggatgtcagtctgcaatgaaaattcataggcaccccagtgaatcgccgggggtgactcagcgcaaaacaccaagcacaaaagagtgcatggcccggttccattcataaaaagttccaaaagtcaggagcctgtttaacagatgacggcgctgagggatgcactcttaggtcgtaaaaatgtacacaaggacttggaattgattgctgggtgttgatcagtcagggtggtgggtcccagctgggaacgaaggggtggtcagaaggagcccccgggggcttccaggggtctggacaaagtgctctttcttgatattgtatggttaaattgatgggtgattgctttgtgaagattcatcaagctgtacattttcaaaaattttacttttaattgactttgggcactattctgtgcgttatatttcacatttaagaagtttttgtttaaagaaatcctttctttcccataggtcatgaacagcccattaattttggctaaaagtcatcgttgctgctttgaaaataatcggttttctctggctgcttttaaggcattttcctctgtgtctctggtgctgtgcagttccactgtgatgtactcagccggggatttactgttctatcgtgtgggcttcactggtctcaaattggtgggttgatggagcttatcagctgtgggccattttcagatgctgtttccagtgactacttctgcttcttccaccatcacagcctctctggccagtctcccaagagcacatctcccgtcctggctgcgagcggccccgaccacccctgcaaagcctccagctcagcaggtggatgtgaagtcggggtggggaggagattcctgtcccttttctgtctcagaacagttcccctctccgcccagtccctgtcaaggacagttcctctcatcctgaggttcagtgggccctgtggttttgtggggtcagagacttccctggccccttgtgcccccatccatctgagctagtcagctgcatgctatgggaggaggaccccagggagcgtatattgctggtctctaaagcccccgtgggacagctgagcacatgcaattaggaaagaatgttatgcggatttccagtgtctggagaagaggcatcaagctccaccacctgcaggaatgggcagtggcttggcaagggcaggggagcctggagagctctggaccactgtggtcaggggaagggaggctgggggatgaccctatagcacctcctccccaatgcacacacatcttacacatgcacacacacacaatacacacatgcagacatacacaacacacacatgcacacagccacacgcagcacatatacacaatacacacatgcacagtcacatacatgcacacatgtacacaaaacacacacatgtgaagacacacacatgcacatatacataatacacacatgcacacagtcacacacacatgcacacagccacacacagcatatacacaatacacacatgcacacacatcttacacatgcacacagccacacacagcacacatacacaatacacacatgcacacagccacacacagcacacacacacaatacacacatgcagacatacacaacacacacatgcacacagccacacgcagcacatatacacaatacacacgcacacacatcttacacatgcacacagccacacacagcacatatacacaatacacacatgaacagtcacatacatgcacacatgtacacacaacacacacatgtgcagtcacacacatgcacatatacataatacacacatgcacacagtcacacacacatgcacacagccacacacagcacatatacacttatgcacggccacacacgtacacacaacacacacacacatacatagtcacacacatgcacacagtcacaaacatgcacatacaacacatccacatgcatgcatacacatgtacacacaacacatccacatgcatgcatacacatgtatacacaacacatccacatgcatgcagtcacacacactcacacaaagcacatttacacacatgcacacagtcatacatgcacacccttgtacacacaacacacacacatgcacacaggcacacacacatgcacacataacgtgaatatcacgtgcagtcacacacatgcaaacacacacacagttacatacattcaaacacatgtgcacataatacatgcatgcatagagtcacacacacatgcagtcacacacaacacatacatgcacacagtcacacagaagcagtcacacacacatgcaccacatacacagacaaaagcacacaggcacacacactacacacacacacgaacacatatgcacacagtctcacacacacacacacacacacacagatgcacagtgaggctcagcctttacagtcccctcagtcttgatcctttatttatttatttattgagacagggtctcactctgtcacccaggctggagtgcagtggtgcaatcacggctcactgcagccttgagctcctgggcacaagcaatcctcctgcctcagtctcccaaagcactgggattataagcatgagccactgagccaagccccaatccttttaaactggcctgttgggctggggtcccaagggcagtgaccagggcagcatggggagaggggagggtagggaaagtcacctgactccccaaagatgcacaaatatatggaggcacacagggagaaggacagagagagtgagagggggattgattctttcgttcgtacaatgtttattgaatgtcaaatgtctgccaggcactgtgcaaaatcacataaaaatgaggtgggaggagtgcagtggacagggagcgccagcaggtcaggcatgagtacagacaggcaaagacacagacttcgaagccagagaccagcgccggagctgatgcctgcttgcctgcctgctgagggcgagaatgcacctgctgtgggggcctgacctcaccgtggacacccaccgcgggagcaccagccctcccccggtccccagggtatggaagccaggggcctttgtagccccacattgcccggagttggatacaaacatcccaagagctaggggtgcctttactggctggaaggtgaccgttccatttccccaacatgaactcagaaagcttcagccaggcgcaggaacatcccagggaaaagctggctgagggcttccctaatgcaggggtgtttcctcctggcccctgtcccaggcagccaccagcactgccaccaaatgtttaaggaaaataggcaaagaaagcatttgcccctctactttcttccctcccaggcataacatggaagacacctggacactggggttggccttagctgccccaggaactagaagccaggaccctctctcttccaaggcccagcagcctctgccatcctcttccagcccaggcttgtccaggaagcctctgggtctaatggtgcaagcatccgaagtgcccacaaccaggctgcccacagtctcggcaaggctttcagccgcccctggcacttctcccaccatcctccaagaggctcaatgacagctccgtgcagccccgcatcagcctcgcagcccgccgcctcctgccctcccatcccaccactgcctgggttcaagggtcagtgctcaagagtcccacatggtccccaccctgtcccctctctcgactctgacccccaagccctcccattttgaggtcacacactcccctcccctcttccctgagcaccccctccatccacctctgcctgggctgcaccccaggcccacgggcaggtgctggccaccctcccttcctctgcaggtttctgggtcaggactgtgaccagaatcttgctcgctgcactcctgccacggctgtgccctgtcccctgcgtttgtcccatctgctgctagctcaaggtcctcccttctgaggcaccccacgtctccagcccagaaggctcttcccttctctgcttggtatcttaaagtcaacatcttcttctccctggtttcctgcccttggtacacagccctctccactgggctgtccaagtcaagggacaggaatcctccgggcttctcccccaccttaccttccaaaccagtcaaccccactgactgcacagctgccacgcaggcgccctgctgtccagccctctgctgccagccccagcccaggctcagctccctccacttgcatccacctctgtccactggactcccctccaagctggcctcgctaccccagagggcacgagcttcccaaaacatgaggcgcacggccatgccccttccctgggaaggtttgcctgccttcccacggaatagcaagtccttcccactgcgcacctgagctgcgggatttcctgcggtttcccagaccagctgggcacccacagcgcgaagctccacacccatggccactgcctcggcttcttctccatcttcacctccccacctccttcgtgtgcctcgccgatgccctgcacttttcctagtgcaccctcatcagcttgtcttcagggctgaccggcacccccatgactgtgcctgagttccaaggggacagagcccatccctgcatcctgcctcccacattgtggactgcacatgccatgggccgtcagggcgctggcctcggcctttgaaaggcatcttccgttcattttcacagtgattatagaagtgaaaggccattttcctattttacagctaaggagatgggcacgagagaggtaaaggggcctgtccaggtcccagagccctccaggagggacaggggttagccaggcgtctatcgtctctgcctgctgcttccttccgagtgaatttgtggtttcctttgctctgatttggccaatgcaggcagctgaggctgtgccccacccccttccgtccccccaggaggctgcctgaccctctaagtgactcgagtttggggtacctccaccaaatgcccccccttcccattcactgtctggcacagctgtgatggagcagaccgtcccctgcagtctgttgggacacagcacccggggccctgaccgccaggcagttcctgagggaggattgcaaagcctccagacttctccaggccctgccagggacacaaagtagaaggctgggctggagctgcatgggtatttcattgaaagttcacagacacaagggctctgagcggggtcacatcgtggaggaggcagggtcggggagcacagagtgagtcctcccaacctgggacaattttgcataagcccttcctgctaggtgtcaggtccaaggggccccaggagcctgggaaggggcacgtgagggcagggacacagacgctggaagccagggtgcagcagcgaggggagaagcccccaggccccagacacaggcagggtggaggccaggaggcggagggggtggactgagggccaagctcactgcccccttgctgtactcagcttctgatggccttgctgcccagttcacagctcaagggggccccaggacaagaagccctgccctgccccaacctcatgggatcctgcgtttcagggaccatgagaataaacatgtctcagtgcttgtctccgccagcagccgtgcctggcgggccttagtagtcggtgagggggtaccgcaggaagatgaagacgaggatgatgcaggaggctgccagggcagaactggtgatgttgaacagccgggccgtctttgcatcctccacggctccattcaggtcattgagaagcttcttgtctcgcacctgaagccgggaggaggacaggaaatgggcagtcagccagggagcagggccttggagcatccaggagcccagcagagccggtgccacagtgctcagcacagtaccagtgctttgtttccgagagctgacgaatgaacgatggttctagaggaacatgtctctgccctggggcactgtacacggatgaacttggggcacgggggcgtcatgtctgaaacctctcagccctcaactggtttataaagtaggtgagatgtatttatatatatagagaaaagcaaatatggtaaaatgttaaaaaattggggcaactgggtgaaggatataaagaaattccttgttttttctttttgcaagttttaaatgattaaaataaaagaagttggcctcagagaggatataattggaggatggggcgacacaactgtctcctaatttgattggttctgcctcgtttaaaattaactgggatgccttgaggatgagcgttgtgcattggcaggagagacagcagtccacagggcctttggggaggaatattaaggcgaaaggagtgggctggcactcaggaagtcttggggaggcagtggactgagctggactcatttccaagaggcaaccttcattcagaatgaattatagggccctcccctcctcagcactctttccttctatcacatccacaaatatgtgcgtgtttgctgtaagaagaaaccaagttctaggatgaggaagggaaggagaatggaaagagaggaagacaggaaggggcaaaaagtctttgccttagtagattggagctgggctgaaagaaggaaggtgggcagatagatactggggctgactaatgcctggatccctcagtgtgcaggttaggcagatggacaggagacctaggtcggaagactggatggacagaggatagatgtgtggtcagggtgatggatgtgtaattgagtgggagaatggaagcataaatggattggcctgtgggtggatggatggaggaggcagaatactggaaagaacaaagggagaggagagaaaaaagaagatagagggagtggggaagggaaagctagaacgcaattcagtggagtggaatggaatggaatgaagtggagcaaatgcagtgaagtgaaatagagtggagtggatggagtggagtggatggaatggatggagtgaatgcagtgaagtggatggaatggatggagtgaagtgggtggaatggatggagtgaagtgggtggaatggatggagtgcagtgggtggaatggatggagtggagtgggtggaatggatggagtggagtggatggaatggatggagtggagtcaatggaatggatagagtggatggagtggagtgaatggaacggatagagtggatggatggaatggatggagtggagtcaatggagtggagctggaaaaaagttggagagggaagggaagggagggaacaagggcaaatgggcaagtaggtgacttggaagataaattgtacagaacgtgctatcaaaatggagagattgaagatgggaagaagcaggtattgaggattcagggtaaggaaggaggcaggaagaaagtctatgctcttatcgggttcttatgctagtggttttggaggaaactgacatctgcaatgaaatttgtattcctttataaggactgaatgtgtcacccacttattgaggtcttatttgatgcctttgctaaaataaagttgtataactttctccagaaagagctattacatcttttgttagacttagtcttagtctatttattgtttttattataatgtaaaagtatattttaaaattgcatgtctaactgattttgtatccagctaaactatcatattgtactaactgaccacgtgttcttaataataaatcatatctacagcaaatactagtatttctatttcctccttgcagtctactcctagacagcacagcatagaggttaaagcacagatgcagaaacactgactggatttcaatcctgattctgcgggtcgtagactgtacagccttaggccagctaacaacttactcttctgctcctcatttcctcatctgtaacatgaagatgacgacagcgctgcctcccagggttgtgggaaaggcttaatgaattgatggatgtgaaactccaccacagtgcctgggccaaagtaagctcctctcatggaggcaaagaagattccagagcgtttccagacagcagcaatgaggacaagcagctgagtctcattcttgacctcaaggtaccaggaaggataatgctcatcttatcattagaggtctatgattgcgttagaatttccacaagataaactattgtttccttctctaattcattaatatggtagattatatttattgattttcttatatcaagacaactctgaattcctaaaaaaacttttggtcttgatttctttgttggatacttggagtgaggaataacgtggcagagggaggatgaaacactgggtgtcaaaagcggatggagcggagggcaggaggctgaggcagctggggtattgggtgcatagaaaatggcggccacagctaaagaagatagggaagaggagggtgggggagtgatctaatgatcgggaaggtgggtggatgaagctgaggggttatacggatggagactgggtgtatgggacagagaaatggatgtagaaacttgtgctgggtggggaggagggctggacggatataaaatgtacgttggatgagtgggacagggagagagctgaatttatgaatacaatgcttcttgatgtacaatggggctacagtccaacaaacccatcataagtttaaagtgtcataaggtaaaagtttcatacgcattttcgtatgatgtgtttttcacaagcctggtaagctgaggagtgtactgggtgcctatggctttcctgccattgtgaagttgaaaaagcatacgtcgaaccgtcataagatggggaccgtctgtatatgctgggtggggtaacaggtgcatagacgaacatatgaatatatgtccaagtggacagatggatatgcaagtgtatgccacatgggtggggcatctgggtaagcgggtaagtgaacggctgctggatgggaggtgatgtgtggatatgtaagagcatgttcggtgggcaggacaggcaaataggtgaatacacgagaatgtgtgctcatgtgtccatgatggcttggaccagggcagcggcagagaaggtgatgagacagagccaacttctggacatgtgttgaaggtggagctgacagtgtttgctgggatcaggcttgcagtgtgataaaaagaatggaggccaggcatggtggctcacgcctgtaatcccagcactttgggaggccgaggcgggtggatcatgaggtcaggagttcaagaccagcctggccaagatggtgaaaccccgtctctactaaaaatacaaaaaaattagcaggggcaggcacctgtaattccagctacttgggaggctgaggcaggagaatcgcttgaactcggagggcagaggttgcagtgagctgagatcgtgccactgcactccagcctgggtgacagagtgagactccgtctcaaaaaaaaaaaaaaaaaaaaaaaaaaaagaatggaactccacgtggtttgaatgaatggacaggtggttacaggaatataggaacggatgccagactggaagggcaggtgcacagatgggtttctgaatgcacgctggatggctggagcaggtccatggctggatatagtaacggatgctggatggctgggacagatccatatgctgaatgggtggaacaggtagatcaatgaatttatgatgtgttttggatggctaagattggtggataagagaaaggaaggagggttgttggtgtagtgtagaccactggatggtagatgggtagacagattccttaatcaatcaatcatcaatcaatatttacttagtgtctgctctgagtagttgctgttctaggtcctgcgtatatcacaaggaataaaacagagtctctgtcctcacgcagcttacattgtagggagaagatacagaaaataaacacgataaataagtcaaatatgtaatgtgctcagtgtgctaaaaagaaacctgaagaggctcaggggaacagagagtgctgtgggaggtgcaagtctagcttggtggccaggctcaggggaacagagagtgctgtaggaggtgcaagtctagctcggtggccagggaagaccttgtggggtgggaggtatttgaggaaagatcggaagaatgtgacagactcggccatgtgttcatctgcagggaggcatgtcctgggagcatagagctgtctgtgcagggcccggtgcttctgaggactaggtgcagagtaggggcagcagatcacagagagagaaggggaggacatacggtcagaggagaccatccaggagcacggtgcaggctctgtgggtgctttttagtcatttagagccggaaagatgaacgtgatatgacatatgtgaacgaggcagtgctggccgctgtgtaagaacagatggcaggggccaggcatggtggctcacgcctgtaatcccagcactttgggaggccaaggcaggcagatcatgaggtcagaagtttgagatcagcctgaccaacatggtgaaaccctgtctctactaaaaatacaaaaattatccaggtgtggtagtgtgtacctgtaatcccagctactcaagaggctgaggcaggagaatcgcttgaactcaggaggcgtaggttgcagtgagccaacattgtgccactgcactccagcctgggcaacagagcaagactccatctcaaaaaaaaaaaaaaaaaaaaaaaaagaacagatagttgaacaggcagagagaggtggattgaatggtccaggggagggtgagggtggcttggaccagggcagcagtggtgaaggtagtgagacctgaccagctcctggacaggcgtggaaggtgaagctgatggtgtttgctgggatcaggtgtagaatgtgataaaaagcatggaacttgacatgatctcaaggtttttggggtttgatcaactgaacagggagttgtagaaggctgcaaaaggaagactcgtttagcagttcaatttctgacatgtcaaggtaggaatgccctttagatatatagcagatatttggcatagcaatttgtgtgagtctggagttcagagatgaggtctagggcagagatataaatttgagaagcatcggcaaaaagatggtatttaaaactgatatagtttgaacacatgtccctgccaaatctatgttgcagcgatccccagtggtggagagggcctggtgggaggtgtttggctcatgcgtgtagatctcatggcttgatgctgtcctcaccatagtgagtgaattcctgagagctggttgctttaaagtgtgaggtgcctcccccttatccctcccttgtgaggtgcctcccctttatctctcccttgctcccactcttgccatgtgagatgcctgctcccactttgccctccaccatgactggaagcctcctgaggcttccccagaagcagataccagcaccatgctgcctgtacagcctgccgaaccatgagccaattaaacctcttttcttataaattactctctctcaggtatttctttacagctgtgcaagaacggcctaatactaaaaccatgggactggatggggcaccaagggagtgaacatgaaggaaggagaggatggagagctgagccctggagccctgcagtgtcagaaggttagggagtcaaaagcaattaggaaacgggcccgagaagagtgggccaagaagcagggaaggcaaaggggcaccagggtgctaggtggcggaatgggctgaaaagtacaagcagaggtgggacatagaggatgaggcagccatgtgggggcaggggagatggatggtgctgggtgggtagaggagagggaggaggagagcgggagagagaacaggctgatggctgggagttgggtgagtccatcgaagcaagcaaggaaggaaaatggaaggacattctgatgatgaattgagggctaggtggccaggcagttcttctatgactgtgaatattgatggatgacagatgggtgaatgtgtgaaggaaaaagagcaggggtgggcagatgtgggtacagagaggaactggctctggctatagagatggatggaacaggtcactggaggaacaggggagaggaaacacaaggaagggatgacatataagtggatgaaagggcaatgttatggtttgactgttcatgtcccccaaattcctgtatggaaatcctaacccctaaagtgatggtaggaggtggggctcttgagaggattaggtcatgcgtgggattggcacccttataaaaggggccccagggaggccctcggccctactggcaaatgaggacacagaagttgacagcctgcaacccagaagagggtcctgatcagaacctgactatgctggcaccctgatctcagacttcgagcctccggaacagtgagaagtaaatacccagtgtttataaaccaactaatctatgataattcattagagcaggctggacaggctcatgccactcaacttggaggcaggtgaatgggatacctgaataaagccaaggaaggaaagatgggatggatgtgcctggaaggtcagatggtcaacgagatgagtggtggggtgggtggacacatgcctgagaggaaacaagagagaatggacattttacagctgaatgattagctatattagtaaagcacgtaggcggatggtagaaagaatgaaggggatagaaggggagaatgcatggccgaaaagtggggcaaaagaaaggaaaagaaaaaaatgagagggaaaagaagaacgtgagaaatttatgcatgagcggttagagacaaggtggatgaggaaggagggaatagagaaagtgacagtggctggattgagctgacagttggggtgagctgaggcacgctgagtatgaaggaggcactcagtgaatgggtgagtgtgactcagctaggggagcagcaggaggaagggcgggtggatgtcttgaagggtgaatagatgtgttgccacatgaggtcacaggatggagggatgattgggtctattgacaggtagggcttggaaggaaagtgggcaattactgagaaagtgagactagatgaatagtttagtgggttgatgcataaggttggtggggacaggatgggagagcagggcagggaggggagcctgaatgatcatgtgtgaacacaggtggatggaaggttgggtggctatttggaggggttgaaggaaatgtgggaggatggattgaatataagtttgggtggatggacggagggaggatgaacagatgatggatggatggatggacagatggaggatggatagatggatggaggatggatggatagatggatggaggatggacagatggaggatggatggatggatggacatatggatggatgaaagataaatggatggatggattgagggtggatggatggatggatgaaggatggatggagggcggatggatggatggatggaggatggatggaggatggatggatagatggatggaggatgaatagatggatggatatggatggatggacagatggaggatggatggatggacagatgaagaatggacaaatggaagatggatggatggacagatgaagaatggacaaatggaagatggatggatggaggatgaatagatgaatggatatggatggatggacagatggaggatggatggatggacagatgaagaatggacaaacggaagatggatggatggatggatggatggaggatggacagatggaggatggatggatgaatggatggaagatggatagacggatggatggagggtggatggatagatgaaggacagatggaggatggctgaatggaggatggatggatggatgcatatggatggatggacagatggagaatggatggatggaagatggatgaatgatagatggatggaggatgggaaagataaatgtgtgatgctgatattcagaaaggagtgagtgggtgagtgtgtacatccaaaacccaacgcagaacccacccacctaacctgttctttctgaccgccctgtcactggaaggtctcacagcctcctgggctcacatctagcagctgctgtgtcctagccacacctgttcctcctctcccacccccatccccagctcgcaagctctcccacctggaccaccacactgggacttgaaccttctgcctcgaggcttgtcttgtctccttcccctacactggttgcagatttcatggccctgatcatatccttctctttccatggctcctacagatgagagcccagcccctcacgaggttttcaaacccgttcaccgcactgcctcaggcactcttccaggaatgtcttccatctcccattgaggacaggggccttgccgaccccctagactgccccacctacgtgtcttagtttatgccattttccccgcctgaaacacctttcccctcaccaagcttcaaggcccagtgaaattgctgcctccttctagaagttttccagcctcaccccaaactgggaatgaagtattccttttctgaaacactgtggtgcttcttccgtctcaccatgtgtcctctgtccacccacccattagacccacatgtcctgacccatctgttggccagctctgccttgggcacagattggctggggtgagcagatgtggctggggcaggactgtctctggaggctttgcagaagagagacccagatctcacaaaagctctccaggccgaggatgtgcacatcgctcacatcacatttgccgagtgaccggggcggggaaccgctgaggccagaagggttaaaaaggcagcttggatgctgagatgagacgtttggccatcatccagctgaccgcgggagccagtggtcatcaggagacagtgtgtggaggcggcatgaatggagaattgactttttgtatctctgccttccccggacaccaggctgtgcaaaataaggcttcaatctctgcgctgcagatccagcctgcgttgagccgaattggcccatgtgggtggggggggtggatggatggctggacgggtggatggacacgtgggggcaggcaaggacacactgtctagttcataccactgcatgcgggcctccgccctgctcacgtgtgctggcttgaatgttgttttgtttctatttgttttgtgaacagatgagggaacaggggctcagtgaggcaagatggcttgtctgtcccaagagctcggattttagccaagaccttctgaacctagggccaccccgcgtccttggtgtagggtgcaggtcaggagacctgcagctgggtgaccagatggatgcattcccaggcgtggggtccacagccagccagttccgtcctcccttctgcccaggatggagacaggtcaccttgcacccactcccaggtatgccccaaagcctctctgccctggctgcccccgcccaccgcaggaaggacacaggaggagcaggcttgggaggaggtgtaatgagccgtccctgaccctcagaagggtcaacctcacaccacccccaacccctgcagaaacccggcaccatccagaaatccctgacctacctacaacccgagccagatgggcctgccccatgccagccggccagccacagcctgagccaagcgggaggagggacagcttccggacgggagcccaggcagccagacccatgtccgcaggctgttggcagggcacagagagaggggaggcagagctccaccagctgcagcttcagccccccaacactggagctttctgctcaggattggtctggggagccacagctggagctggtcggaagcatgacctccaattccaggggcccttttcctttgttgcttctacacacacacacacacgcaggaatactcaccaccacacacacatgctctcacacacttgtgcacacacatttacacgtaccatgcacactcacgtatgattacacacgcatgcacagtcaggtacatacatcacacatgcacacactcacacacacttgtgcacacacatttacatgaaccacacacgtgtgattacacacatgcacatgcaggtacagacaacacacaggcacacaccctcacacacttgtgtacacacatttacacgtgccatgcacactcgtgcgattacacacacatgcacacactcaggtacatacacacagcacacatgcacacaccctcacacacccgtgcacacacatttatacgtgctatgcacactcacgtgtgattacacacacgtgcacactcaggtacatacagacagtacacaggcacaccccacacacacttgtgcacacacatttatacgtgccatgcacactcatgtgtgattacacacacgtgcacactcaggtacatacagacagtacacaggcacaccccacacacttgtgcacacacatttacatgtgccatgcacactcacgtgtgattacacacgtgcacacaggtacatacagcgcacatgcacataccctcacacattgtgcacacacatttacacacaccatgcacacatgcaattacacacacatgcacacaggtacacacaccacacatgcacacacgccctcacacacttgtgcacacacatttacacacaccatgcccacccacgtaattacacacatgcacacatatgcattcacatgtacacacatgcaaatacactcctgcctacacacagtcatacacatgcacacacatgcacacacaaaaatatatgtacacactcatgcacacaatgcattcacatgcacacatagttacactcacagtacatgcccacttatgcaattacacgtgagtacacacatacactgacacgtgctggctcacacacaggcccctgtgtcagagcccagggatggatccgcaggcccgaggttgaaggtgcccgtgccagtgggcaacgccggggttggcaatcatgatgagtcaggagcaggaggggaacgccgaccgcagttgcgatgccgggcggggtggggctcgagctcaaggatggagcagaggcgaagctggccaggcgtccttcctcccagccagcctctgcccagcctcttctctccctgcatcccctgtcttctcccccacccggcagggcagctgcattggtggagtacatctggccttggccactcaagtctgggctggggaaatgtgatgatgaggctaaacgtgagccaagcccttccttccggtgcgtcggggtggggaggagggcaccggggcctgccctcgccctcacgctcccttccccaggaagggctccagcaccagacacattgacacacggctgcccctctcactgtgagcccatcacagcctccctcccaccatctcagtccctgctgctccaccttgccctcagggggacagggtcatgtctgcccagcacctgctctgctaccagccagctcttctcgcagccctgagctggggaggtgcaggacctgtttacacccctcttccctgggctgccctggccacccaggtctggtctccacgcagggcttggcagagctgtgtaagcacctgcccttgggctccgggtgaggagctggataagaaggtggcccctcttcctttccataggggtaggattccaagccctcttcagccccacgctggccccatccctgcacacggagaagtggctgctgcccaggtctacgtcccatgtcccctgagcctgagcaaccccgcccccctcaacccccgctcccagcccctcctgcaggttccgctgagctggctgagcagaaagccaggccctgatggctcaggagagggaagggcagacccctgcccgcccagacctagccagtaccccgacctctctgggacccaccatcaggacccctcactgtcctttgatcccttggcccctcaactgcacctgttctacccgtgtgctcccctgagagggagaggggccgagcgcccacagccagggactgtcctgccggcaccacctctctagcccgcccttgccccctgccaccgcccgggctcactttgagggagtaggccaaggcgatgaagcccaggcagcagaagttgaggtagacgaagttgaagatggaccacaggtaatagtcgttcacctcggtggtgtccgggtagacctcgatgacggtcgtggggttggtcatcgtcttcttctcggctaggtgcttgcaggcagggggcgcgccggcagcccgcacgctgtcggtcttgctgctcttggactccatggggaacagtgtgggcgccatcgggggagaggccgagggctcaggggcaggggccgccggagcctgcagggcagggggcttggacacgcaagcgaagcagcccttgggcgaacctgccgggggcctcggaatccagaaggccccgtccagggggactcgggcttcctgggcgccgtccgtggtgctggccgggtctcccagcggggctgggcactggccggggccctgggcctggagaggagaaagtgagagcaagctgggcccggcctaccggccagcacccaccctcacgcccagcagctccgagaacagccccagtggagacggaaatccctgcgggggccgccagctgccagcctgccacctgcctcccccacccgccccgggcctcggcggccacggacgatgccaaagcccttcgcagcagccttggcagggacctggggctttcatcacttcgccatctgcgcataaacactcacccactgacacacacaacagcaccccccgccccgaagcacaccaacgctgagactgacactgttgcaaaacacagagtgccccagcaccccaaacaaccccgcacacacggggcgccggacccacagcgacgctgcctcagccgccaaccggcagagctagcagagcggccaaagcacctgcccacggcgcccgcggacacccgataccgccacgggcaccgccacgggctccaccgcgggctgcaccgcgggctctccagaccccggggcgcacccgcgggcgcgctcagagccattgacgagtaaacaactccccacacaaggcgatgcaggctcagccacgagcaccaagaaccggcacaggtgcggggtctccaactcgtgcgcaccgccccccacctccaacctggggaccccaagcgcgcacacttgcccggagccacgcacccccgggccatacatagacgcacaataacaggctgtgaaatgaacacttctccaacgaggcaccaagtcgctcgcgctctgcgccaccccgcgttcccagctcccgtgcggcgctcgccggggggtctgcggccgaggctctgcagcccccagccccatccgggtctgccgcagccccccggacggcgcctcctcacctacaagcgactcctcggcgcgcggccggaccccctgagcctcggtgcgcgcgtccttccgccgtcccgcgggccgctgtctgtccactgatccgcctcccagcggcccaaccttgagggggtggggagcgcgcggggctcggcggcggcgccgctgcctcccccgccgcctgcgctccctccgcagcgccagaccggccgcgcggctgcagcccagagcctgactcacggcggcagcgggcacagccacctccccgcctccgcctcctcctgccaggagggtgggggcctcggaagccgcgaccctggggagttgcaaggtcccgcagggatgggacccctacagcccccgaccagggtgtccgcgccacctccatctccccggacccactgcgtcttcctccccaccccacccggccccatccctctcgcggagcccccagccccgtggaagactggacgctcccggaaccctccccatctgcctccccaagagagaccctcttcctcttcccactctccccatggcgctccaccccagcgcctgggccctgctgcctccagggacccccgcccctgggtcctgcccttctggcctgttgactctcagttccagcagctcagtcccctcctgacgaagctccagtcccctgagccccagcaggccccctacctgactgcccgtctctgccccatcctgtccctaaccaagtccacaaggcccccaagaccaccctccagtcccttccctccttagcccaccaagtccaggccttccggtaagtttcagcaccccctactctgttccttcctggctgagcccactcctgcccatcggagctcctgccccctttcctggagtctgacttcacccagccggggccccactccagttcactcccagagtctgggagaatgtggcctctcctgcgcagaccccaggtcatgctccatctgctcgcagggcaaagtgtcccgttccgagctctggtcctgtgctgaggtcctggctgctaaggacacttgtctccctggaggctggtttactcacctgcccacagcctctctgtgatccctaccagcccttctgagcctggtcccctgaggatactttgttccctgtgaatcatttttcctgaccaatgcctgtcctcccagcctcagccgcctccgctaccccaccacatcctcactctcacggtatgcttgacgccagctgatcttccatccccataacagtccccatgagttcctccccatggagaaaactccagccttccctccctccctccaagtcccccacttcaccacgcaggttccctgagctgggtcctcttcaccaacctccagctcccactgagcctcgaccctctccaaagtcccccggaagctgaggatgcatggcggcccccgttttccctccctcatctctctccaagccccatcctcccatgaaactcctttctcctctgccactctcaactggcctcctgtgtctccgcaaccctctttcctgtctggaaggccagtcctgcttggggtcctgtctgcctgcctgtgcctgactctgaaccctttctctccccaaacctctgttctgaaccctaatcccctggaaaagcccagccctctgcaagcccctcctctttccagcctagtccccgcccctcatgcctgggctgacccgggcacagtgttatccacagcacgccaggaacccacagcacaaggctgatcttaaatgatgttgataaaccctaacgagcaggaggggtcatgaagcatgaggagcctcctcctcgtctccttgggcaccctggccatgctctccctggagcccacaggccgtgggtggatggggcctgtcggagaaccagggttccgttctccctccccaactccctcctcctttccaagggcctggcccagggaaaactggacccggtgtcctcagacggggcctgatcccaggctgagtgtggcctgtgtgccatgcccccatgtctccccagcatctgagctgggcttacccggccagccaccaccttctgggagaccctggcctgccacacagcctctgcccagtgctgccccaccccagtttgccctgaaggcctcaggcagtgaggaggcctccatagcaggagagggttgcctgggcccgagggtccagggcctgcccagggtcactgggtaggtgacaggggagccagggcctgctcccggcctcaggccaccttggggctgcctctgaggccaggaaacaccactgagagggagccaggggtcgcagggcagagccagggccgagccaaacttggcacagccagcattcatgtgactgttggtgggctccccaagggcctgggctccagcttcccctttgctaggggtttctggttacaacccacagtctagacagggggggactccaggctcagggtccagtcaccagctagaaaaccacggaggaacccggggtcagactccagggccccgagaatcctgccgggctggagggagccctcggagcaaccccagggcagcagccatgaagatgggagctggacggagctgacaagctgcagaaggagggagatggggagagtgggacagggcagggacaacagggtatggctgcctccttgtacctctctgccctcccaggcctcagtgcacaaagcatctgatgacaggacatttgtctccccagaagccctgccaggccctgcagagttctgcccagctctgctcagatttcaggcatgccaaacgccaggcatgtgtttccaagcctccgtgccaccctgggtaaatgttcttgctccaggtgtctgccgtagcatggctctggggtgaaagccctgcagccccttgggaggaaggccaaggcagccaccaccctcaggcagaggcatcaagataatggcaaatgtcacatctgcctcatcttctaacctgttggggtggggctcgagggggctctaagtgactccagagctactgatcccaaaaggaactctgctcccaccaccacatgcccacaaactcctacttacctattagaaccccaggggctgctaccactgcatccgggcacacgctcccaacccctcccctcccagcggaacaagcgcaccgcgttatcagcccggggatccgtgactgtggcagctgtggctggaggggacttctgagtccaatccctgcaaccagggaccctgggcaggcttgcttggtgccagctcagctcactgcacacaaaaccgcttctagggcctgggaggcaagaaggcccagctaggccagcccccccacgccacctggggccatttatttcccgggacaagagggctgaggagggtgactggtaggcctgctctgagggtccccgagagcagaaatagcctctgttcgagtgccgtggctgcctggctgggccacctccctgaaatcactcctcaaggctggcactcacactagacaccctgaaaccccagccaaggccacatcctgccggctactgctccagacctgggaacaagtcagtccccgctggccgaccaggctggagcccatgggctgggcagggcagggcagggggccataggcccggggcaccccaaatgcttgtcccggtgctgccgagtcagctgccgtgctggcttcgcactacccaccctccttccccatcccaagttggagccacccctgaccaggcacaagagcacaccagcacagaggggaggccggaggccaacaactgtatttccatgtcagctggggctctcagccgcccaaggggaggacaacagaggtcagctgcagaggaaggctggcaccagcccccaatcccaaccccacctccaggccaatacatgcccctgggactggctcagtcccagcaccaccctgcaggctccaacaaggtgggttttgtcccctctcactccttccagctcatcctcaggcctctagcggcctcatcctcaacgggcccgggacactgaacaggtagggtggcagagcccagctgggcccaagctgggcagaggggccctcaggcagggcaggtttccaagggagggcccgggaggacggcctggtgtggggtaggggctcagcccagcgggcgctggtagggccggggaggggactccctggagatgaagggagccccaggatacacgagctcggctgccaagcttgggtggggtcttccaatgcacgaaacagatctgtgctctggatcagctctacccccaccaaacagatggagagacagacaggcaggcagcatttctgaacccagggaggggaaaaccacagaacaaaacagcaagtcgggcttgggccgccggcttccagggcgcccaggacagtgggcgggcgagtgtgtgggtgtgtgtgggaggggccgctgggccaggggcctcctgctctgggactctcctctgtttctgtgctggcgcgcggacgccttgggaactagaggcgggcagcctcggcgaagcccaccctgttgttgtcacggtcaaacacagtgtagtagcggccgatgaagacgtcgcccaggatccagagtggcccgctgggtggcgggatgtccatgcccatgaagccgctcaggcagagggtcttcccggcctgcgacacctgggacggccctggtggtcagtacccaggcctagcaccacccgcccccccacctgttgcccgctcacctggagcgtgcgccccctcaccgcccgctcacctggggcgtgcggcaccccattgcccgctcaccttgagcgtgtagtcctctggggacagcttgtagcctttgcctcccagcttcagtgtgatcgcgggcagggtggacaccttctcacaggggatcatgtactaagaggggtcacagcagtgtcagggtggtagtggtggccttggggctccccctgccagccccagccccagccccagcccccggcgctcacctcgccctgaatcagcggcacggccccgatggccttctgcagctcgcgcacctcatccaccgggcccaccatgagggaagtgcctgtgtccacaatggcctcacagccctccttgcacagggtcagcccgctggccacctccaccctgcggggagtcagggcgtgaagcccctgccgggactggagtgtgccctgggggcccagtgcccctccctgggagcccctcccctggctgggctgcactctcctcccctcagggctcctggaagcacagccggctgtaagccctccagggaagagggtgggagaggagacacagagtggtagagggggtgggagaccctcaggtggtggtgaggggcatggagggatggaggggatggaggggcatagagggatggaggggatggaggggatgaagggatggaggggcatggagggatggagggatggagggatagacagatggaggggatggagggtcatggagagtcacagagggatgtggggatggagggatggagggatggaggggatggagggatggagggatggaggggatggagggatggaggagatggagggtcatgaagagtcacagagggatgaggggatggaggggatggagggcatggagggatggacagaagggatggtgggtcatggagagtcacagaggcatggaggaaatggagggatggagggatagagggaatagaggggatggaggtgatggggagcatggaggggcaaggaggggcatggagggctggtctgaccccatctctttcttgcccagctcccactactccccacatgcaacccccacctgcagaaccggggtcctccagggtctccgcacaccgcccccgcccacagaacccaggggagccgactgcagccactactcactggtccaggtggacctgccagtaggccttgcgggtgacattcaggtaggacagagaacccttgtaatacttggagtctgtgccacccagcatcagctcacccccaggctgcgcatctgggtccctaggaggaaaagggaggagtcagctgccacgccaccccccaagcacaagagtgccaggtcaggagtaagagggtgaatgtggcaatcagggagagcttcctgaaggaggggcctttctgaaactgcagggatggaaaggcccagaaggcaggaggagggacagactcccttcttcccggggtagggctgctctgcgtgggcccagcctggcccagaagaggttttcctcaaccctcaggttctcctggtctgctcaggagccaaggttcagccagacatcagggtcaaggctagcggcagacaaggaagtgagtgccaggagctccactggggaggaccctgtctgtctgtctggaagaaaaaaccaaagaaggcttccaggagggagtgatggcacaatctgggaagttgggatggctggttctggccgcagggcctctgcactggctgctcctgggaacaccctccacctgcatccccgagccacgtccgctcatctccccctcatccagaccactgatggccagccaaggtgctcctgggcaggagcgcactgcacttcctaggacctgcaacccatgtcgcccgggtttgtttctaaacattgctcaagtacagctttcaacgcagcaaatcctgccggtcctggtagagaagctctctgtgtctggggcggttctgccatcccgccagagcgtctgcagctaagctggccaccatcccactgcctgtcactcgaggcagtgccaggcctgacccagtcctcccaacaccgattggggcctccgccctcctccagcctcctccgcctttgcctcttgtcaacacctctgcaatcccaagtgtagaaacctgatcagcgcctcccacccctcctctcctcaccaaacatgctttcagaagccctcagaccctccctcctgcctggctccacttcctgcccaagctgctgccttgagactacacctgggcactcacaaccatgtgcacctcccccacctgggcactcactctgtgtgcccctccttccacctggcactcatgcctgtgtatgcctcccccgacctgggtactcataccgtgtgcccctcccccacatgggcactcatgctgtgtgcccctcccccacatgggcattcatgcctgtgtccccctccctgacctgggtactcaggctgtgtgccccctccccatgtgggcactcatgcctgcatgccctcttgccctcaggggaccccttttcacctggctgcctcccctgtgccccaaggctcctggggaaatggcccagccggttcacctgtgtcctggcctctagtgagcagcttagccctgggtgttgctaaggagtattcactgcccaggcaaggggcagagcaaagaggcccagccagccctacagccggaattctgccggaagcgatccaaggttaggggtcaggcccagagactccaagtgccaagtgagccacgtgaggtaaacctgcccctgtcagccctggagagtgtggggcagtgaccaggcgcagctcagggcaggaggccgccggctgacacgctgcccacccccaaaacaaaagcccccaacccccagtcacccctcttatgtggaaccctccactcaggtctgccccgagaagaggaaactaactgagtccgacgtccccttcccaaggtcacctgaccatgggtcacccaagctggagcagcggctgcaggtgggggccctgggggagaacccttttcccagaaggaagggccccctatgttcctcctcgagggcagccggcacctgctggggacgcccacagagctgctcgcagcgtggtgccggggacccatacgcacccaaggtcacctccccggggatccccggtcccctgggcaccatgaccctctccaccatcagcaaccccgggaccaggaccacatgtgcccatcaccaggtctggggaccgacgggccgactgaaccaagaggaactgccacgacccctgacctgggtccattctcataggagggaggcccagctgccaaggtcccaggacccacagcctggcccgagcccctcccactgggagaccccggccaaacagctttctctgtgctgccgcttactcctctgcagaagggcggccaacccccgcctcccggatgccctgaggtcagaggtcaggagctctggcacagcagcagggagggggcagcactgagagggggtgcctagaaggctccccgtccagccccgccctgcctcccagcaacgcggagcgagagggaacccacacgcccacctgctcaggtagaaggagaagatgttctggtccaccagcttctgctgcatcaggttgtcgaagacgggcagcacgttgttgacggagatgcgggggtaggccatgcccaggatgccatcgaacttggctgcgatgaaggtgatgcctggctgcttggtggcctccccaaagacctgcctctccactttgacaccgcccagggcagaggctgacgacgctgactggcagggcacctgcaggccagggcagagtcagtgggcagcagacaggctgagccctacaccactccctgagcatgaggctacaaaacccagttcaatggatgcccatcccacacacgatggggcccagagggcccagaagaaagggctggaaaccctgagctgaacaccgctggggatggggacacggggtatggcggggccctcttcgtggaagtcatcagggctcggtttacacgagatgggaaccaggcaggagcacagacgggcaggccccttgctccgctccctgctccgacctcttactcccaccaccaatgacaggcaggtcctgctcctgccctcagcgctgggaacaagacacagcctgggccaggagcccgagagatggggaacctgccgaccccatcccaagctcacagccatactgcccccttccccttctctgcctgtcccctcccccagccctggatgaggctgcagagagagaacacggccagagcaggatgtgggaagggaacgacagcttgaggctgacacggggcggagggggcagaagagggcggaagagggcagacggggcaatttcctgttcaggctgagcagggtccagacaggagggctctgaggagcccccagtacagactggactccagcccagcagggaactgttaggagcagcttcagctggaggaaggggccctcttcccgggtccctgggcctgcaggggggctctgctgccctcctggcccgctccagagctgggggctgtgtcaccatcccgtaactcctgaaccccttgtggcctggtccacccccagcagacagctccgaggtgagaactcactgaggcccaggcagggtgacaagggccagctcaccctctcctagggcagggagttgctctgcacagggccctgaggatggtggatgcaggcggggcccccaacagccactgctgctccccctcccttgccctcccaggctcctgccggtgactctccgccagcagcccccacagcgggttcctggtacatcctcccaaccccaagcctccccaagccctcggcctgctgcagggaccctgtgcagccccaggtccagccctcaacacctgctggcacctcaaacccaatgtgccaaaaagagcccgatcgatctgccctgtcctccctcccactcattgtggcctgactccggggacccctgcccctgtaccccctgggtttgaggctgtccctccagcctgcacacaaccaggcccattcccagacccctcctcaccctgctgactgccccggccacctgagggctggggttgggctgggatcaccgagccctccctttcaaccacatacccacggtgggtgaaccccacaccctggcaccctcgagtcctgggaaaggccccagagggactcaccgacacagtgtcctggctcaggtacccggagaggctgcccgagccatagtggatgtcaaacgaggtaccattcttcacgtaggtgctggacttgtcgctgttgtacttgtggtggatccctgccccgggcgacaagggggcccgccggtcatcccgcagcccacgccacggccttagccctcccatccccctacaatctaccatggagcccgcaccccccaagctgcctccccagggtgggatttggaggggatctgaggcccaccatcatgccagagccccgggactgtgggctgtgaccccgggcctccctcccagccacagccggctccctctgtggccaccccagccccagccctgctgagagcaagaccacagctggtggttcacccagaaagtcagtggctggagcagggtggagggctggcctggctcacggggccaagaggcaggagaattgcgttgcccaagtgattcctgaggcagccctgcagcgacatcccggaagggcaggacctgggcgacggggccagggttcgtgactcacagcaagcgatgtccagcagtttgcagtggatggaggggacccacaggttggaggagcccgtgtcgaagacgactgtgaagcactgggggggcgtcccgatgccaatctccccgtagtactgggcctggcaggggacagggtccgtcagggatgggagagggggccccatctccccactgggcctcagaaggcccggctgtccccagagccaaggcccatactggagggaggggcatcacggggcccacagctgccaacagccacccactcccacctgctcagcctgcagggaagatgggccaggtccccagccctcggtcctaatgcccacgggtacttggggtctctagacccctggcttctgtcacctacccctgctcaatacatggtgaggctgaggacttccccacggaaaagacaaggccagaggtcaagccagggtggggacagacgtggccctcagcctgagccccgggtgcaggaaagcccggcctggaagactcccctggtggcccgcagtccaaggtctgagaaaggaagtgacttcctccccaggttggggccatgtcaaggtctgattctgggtgtctcagtgcctgccctgccctccagggtgaaccccaggcttggagggcttccaggcagaggggttcagctggtcaaggggagaaggtaagccttacaatcactgcctgcccagcaaccctgccttaatggcccagggcctcagtttccccgtgtgtacacagggatagcaggcgcaggtgggggtgctgactcagggatcaggcaagtacaaggggtcccatgccgccgagcctctcaggaggcagagagtaagagggtcctggagtttggggtcgcctgggcgcccgcttcccccaggattggagcctgggccaccgtcagccaccagattcctggcaccagcccagcccaatgtttctccaaccgcctggcttcacggagcagcagcagctgctgactcatggccccacagaagtgaccactggcagggggacactcagcaaatttccatgtgtgtgtgtgcatgtgtgcgcatgcgtgcatctgcttgctcgcgcgctaggacaatcaggaactggccagtcgggaccaggcacacggcgcctggttccccccagggcccccctggcccagtcacatgcctgtgagtcttgggcttcctgtcacagccaggactcgggccaagcaggacagagggcaaggctcccccacagtgggccagagccccgaggctggacagtaggccctggcctcgaactgaccccatagagctgggaccaggctgaccaagccccagcttgctaggtggcttccagagtgctccaccttggatcctgcttccccctgaaggagtagtgggcacaggaggggctgttgcgagaggaagaagatggggaggggctggggaggccacgagtcaccacaggcctcccagcaggacagcagtgaaaggctccaggtcagccggccacactcaggcaggcccaaggaccgccccctcaggcgagctggcaccaaggcccgaggccactcccaatcaccctcccaggccctagcaggaccaagaccctgcaatgacaggggccagtggcaggaggttccagaatggggaagaaaggagtgtggctgagccgggacgccaccgtggccaggtgagccactcaaactgcgctgctgagaacaggaggtgggaatgttccccatactgccacggagctctcctgacagtggctccgcttgcagcagggctaagacctcatactcacgtccatgtagttcttgagcacctcgggaatgggcccctcggtcacggctggcaccgcctgggagtactttgagacggggcctttggcaatcaggtcctccacagagcccccaacctccgacatggtccggcggatggacgtgaacttgtgcagcgggatcctgtcaaccacgggtcggggcatatcagggaggccctcccgcctgccggccgacgctgccaatgctgcacatccacctggaggcccctggggaatctcagagtcgccacagccaaaaccaaactcctgcctgtcacctggaaactgctggcccagctcccccaagtcagtgaatggcaacccattgccccccgccaggttgcacaggccacagtcctaagaagtggtcacccgccacccacctcagccccacacacccaacctgggggccagtgtgcccaaccctcctctcctcagccattctggaggctccaaagcccccaagggtctcccgtcctccctctgcacctgcgctggtctcttccaggatggtggccagcatggctgctcagggtgctggcgggtacctgtcactcctgcccaaagtgctctgaggcagcccactgtacccagcccccatcacacctgctctccacccccagacacctgcacgaaggtggccccacctccaggctggcactggcagctctgcctggcctcctctggccatcagatgggccctccacaccacctccagaagccctccttgactacctgtcctcctccacatggaccctgtggctgcccagtgccctcatcccacatctgtttctgggcatccgcacctctcctcactccatgcggctccacgaggtccaggactgcacctggggccttagaggcttctgtgctgccccccccaccgccctgcctcctccgacagctgcactcagggtacccctccagagtcctgtcacccagcacaccgccagccagggtgcaggagggagctccagactgagatcggggtcctgagttctaaacccaggaagcgagtaagagagagaggggtccctgctcctcccccagggccactggccttccccttggtgtgaacccactccttgttccaaggaagctcccctgggcttttaatcacttaaataaaacctcttccctgccccagggacttgagagtacaaggtcatagctggcttttcctggcttgtcaggggcgtgatcccggaagatgagattattgcctaagagctggtgggctggaagagctccaggttttgtcctgggggagggacacgccctccagggaccaggaagcaggtgtaatagtatcagtcgcacaagagctggaatcgggtgagggcttggattcagctacccttccctccaagaagccccaggatcgtttcccctctgctgtgtctgtcctccttggagaggggaggcctgtggataggctggcaaggtcaaggcaggctcaggcttgtggctactcccccacaacgactttaattggggctacccgcccccgggccattccccacagcctttggtgaggctcagtcctacccagctggcccagccagctccagcccctgcagccttctgacctcacccacctgccaaaaggcagtggacccatcgcagatcccaggtctcccacaaaggcccagagcaagggtggggcaggtgcccaatgggatgggtcagcatacccctcctgggaatgcgggctgccttgcaagggctggggagggggtcaagaaagcagactgcagcatggccctcctctgcccagctggtcaggcatggccgggccccatcccatccaggcccaatcggtggcctcacctggcacaggggatcggcctgaggagcgtgtgggcctcactacagcacaaccccaggcccggggtgggtgagccgacccactccccatgcctcctcctctctcagggacatgggaactcctagggtctcgaggggtctcccagcccagggcctgtgataagagccgctggagcaaacttttaaagcccccagttcacaggtggtaaaggggtccctaaggaaatggactcgcccagactcgggggctctgaggcctgacctaggtctccagcaacaagggcgctcagtacagaccccaattccacctgccccgaatgagcactacctccccccgccccgccccgtctccagggaggctgcggtcagtctgcagtcctcaaggtacaacccagggtggcatatgggggagaggcatctggcgcctctgccccgggtcccctgcacctccggagcccggcgccccgtaggcgggtggtccgtgcaggaggccgcgcagggcggcacaggtgcattccagcgcggggggcgcaaggggctcgtgggggccacaggggagcgcgaaagtcaccacaggccccgggacctcggcgccgcgacccctgcccgtccctgagccccggcccctgaggcttcacctgacgagcgcggaggcgggtgcagccagcaggcagagggcgagcggcagaaggctggagggctgcatggcggcggcggccgggtcggagagggtcgccgaggccgtgcgcttatagccgggatgacgccgcagttgggccggatcagctgacccgcgtgtttgcacccggaccggtcacgtgggcgcggccggcgtgcgcggggcggggcggagcggggcctggcctgggcggggcaacctcggcgcacgcgcacagcgcccgggcggggggcggggtggtggtgcgcctgccgcgcctacagttcccgccgctcgcgcccgcggggtcagcccggcccagcttctggggtctggaggattcccgtttcggcctggcctggggtcgtggggcggcccaccctggagggccccgcggggtgacccctgtcccggccgccgcggccgtccccgcgtccaggcctgcgcggggcgctgcgcc

SEQ ID NO: 1375 - DNA, 17264 bp, Homo sapiens
tctgacctgagagaattctttttattacgagtgaacagatgaactaaggtaagcgggtctcagccttccgctggtgcagcatctccacgcagggcctcagccccgtcctggccttgcctgaggactgcaccatgggtgttccttgggcatggaggaggcagcaggaaggggtgacaggagcaggagcaggtgcagggcacctcacaccacaggcctcccccacctctgagctgccaacagccaagactcctggcgaggccgggagaggaggggtgagagggaaggagggtctctgtgaaagcaagccccacccccagagcagagcagagacccaggtctgcaaatcacaccctccccccacgagttcctcctttgaggccagcagcacccgagggagggcaggggctgcacggagaccagagaaaggaaaaccccacagaagaaaactcaaagcatcagtcccatgcgtgtctgctgaacgagtgaatgggcccaaaggctcttctctacaaacggcacgcatccatccgacagggggccacaggacacggccggggccgtctgcgtctgtgcctgtgcagcccacaccagtgcagcccggggccctctcagacctcaccacacgcgtgcccagcacatgtgtgcacacgcagatgcaggagagaacacacaccaccgtctctttgcacacgtgtgcccctgtccggcccggggggctcatctctccttcacgtggttctgtgctcccgggcccccgctgccggccccatccccactgcccccactgtggaccccgccggccccgctgcatagcacctcggtgaggtcgtccatgatggcggtctctttggggtccagcaggttgaactcccgagcaaagaggatgaagtggacgtagagcgtgttcaagtgtccgtgcagctccagggccagcgtctccttgaagtgggcccagtagatgtgtgccagcacgtggaacaggtgtctgcagatcttcctcaccagggactcaaaggagctggggaattctctgcctggggaaggccaccgtgtcacaagctgcagacatcccttggccccaacagaggccaggcccctggcacccagcctggtgggtctggtacctgccacccacaccttgaccctgccaccctcagggcctacaaagccccagcagcaacagcttctgcccatcagcaggcaccacagggacttgccaaccccgggtctgggctgctgagacctccctgcgtgctcaggctccggaggctgcacctgccctgagggctgggagctcgttgggccatcctggccacctcctcaggaaggggcctgtgatcgggcactcgggcccccgtggtgtctccctgatggacacttggggccatctcccgggccaggacggaggtggcgatggtggcacaggcctctcctgttgtcccctgccgtccctctggcagcacgggagtggcgtggagccccaccacatcccaccaaaatctggacacaggcttggcggctgatacccagcccaagtgcccacaagctggacggtgagagcagcatgagcggcagaaaccaagaggggcccagtgcagccgcatggcccagagggccagggagatggcccttggccctggctgggctgacccctgcccaagggctccggcctcaccccacagcccaggtggctccatgctaagcagggactggggtggtgcagctgccgccctccgtgcctctgcccctcccggcacaggagcttggtcacttgcagacacgtcctgaatgctccctgccccactgtgaggatgaccgcccagtgctgggggagacgaaccgtattttgtggggaacacgtcctcatccgtcaccagcttctgcacggagctcatgacgaagtcaacgtactgtggggccgtgcacttgaccttcttcccccgctcgtcataccagtagtactgtctgtggagacagagacacggtcagggcatgcgcccgctgcacacccacccagccactgggtcccacccgctcaggtcatctgcgggcagaggtggcgccagcagcggaggtgtggcagacccaggtgtctccctccctggacatgcacactgtccccacacactgtctgcggggaccacactgcactctatggaggggtctgcctgcgctgacttagaactacgccaggatcacgctggggagcctgccagccacatggctgtacaggtgtgtgattaaatgaaggggtcatcttcgttttctccgcttctacatggcttcagttgtattcgtttacacaagtgcgtgctgctgtttttctgttgtattttgaaagcacacagaggctccttctcttcccaggaagctgtgctgtggctcgccggccaggccccaccctttgggagagccctgctctgactgctagaagccaagcccctctccggggaaagcagaggagggcggtggtctctgtgggtacctgcggctaacagcctggccaggacagggacctggccccctcttgcccctgtacacaagggcggccagtcctcatgtgagactcgtggccccagagcaggctggagcatcctagggacatggacaccctgggtttgcctcttactgttgggtccagccatgacaagggtgtgctctagttcatgttaatataaggtgacccccagcccctaacacccctcctcccccagcacaacaccaaaacccagggcacccacctggcagccaccacccctctccccctgccacggtgctgggtctcagtcctccaaggccatgcccacagcggccgcccccgcaggcctgaaccagggcatgctggggccgatgccgcagccccacccacaggcagtggagagtgctgtggtgggagtgctcacacctgagacacagccaacactatgggtcgggatttcctccctgagagccagctcccagctcaccacaggtgggaatgggccacacagcacagagcagtactggccactgagcaaacgccccctccacaccatggccacaaccaccatcgcctccactgccccagctagaccaacaggcagtctgccagtaccaggctccacatgaaccgctcccaccctcctcatccagtcacggttcctcttggaatggccctgggtggggcagtgctgaaaaggatggacccaggctccactctggaggccactcttctcttggccagctccaagcatcgtgccctgggttccagagcccaccaaggcacctggggagacgccccaagggctgagacagggccacggggggctcgcccacttcctgcgcagccagagaagccatcctcccagctgggcacagggcctccagtgtctccgggcacagggcctccagcgtctccgggcacagggcctccagcatctctgggcacagggcctccagcgtctctgggcacccctctgctgtgtccaagaagcccctcagcctgtgcactgcagatcccggggggagtcaccagagttaccaagaagctagaggatgacactgcaagccctgcatgctggcaccctgccctctgcaacagaaacagccatcaggccacctcccagcaccaccagggccctaggacaaccccctcccagcacccacctccagaatgcaaaccaggagctctcatgtgtgccctgtgcggggctgactcagcccacccgaaggggaagtgcagccccaaaatggacaggccatgaggacggggatgcagtgcccacacctgcctctcaggtgctgtcctccccctgggacagctctgcatgaccttcacgcccaccttcccaggctgcaggcctcaccgtgggcatcgccaccaggctgtcagaccctctgagaatgcagagacaacagtcctttcagcatctgctcctcgagaatgatgtagaggacgcacgtatccccactgtcctggggttcccagatggtgtaggggaggcccagcccctaagggccaggctgaggcccatgtttccagggcgaggacccagccaggatggctcagcactctgcaggagtcagacactggctccaggtaccctgacactgcaagctgacatctgatgcacctggccacaggtgtgcgacaggtctcaaaacagtggaggttagagacggaaacccttttccacaatgcaaacccagagaaagcagtaactcagggacactgtggattgtcccatctgttctgaaagatggaacaccactgtttcctgtacttcttcaattatcagtaaaccgtttctggtatatagttctaagatttttatccacatgtggactcacgcattcataaccacaatcaggacacgcggcggcttacgtggcccctcacacccgtgctgctgtgcccccagcaccccggggatggctcctcagggatgggccgcgggaaggaatcgcaccgcgcggatcctcccgatctgggcccctcttgcacggaggcccctgggatgcagtcacgtggcagacgtgtcggaagtccacggctcctcactgcccagacactgcccctgcagagatggacatggcgtgctcatctattcacctgtgtccctgccagcagaacagagtcccaggtggccacatcctggccagcaccagtgtcccgaccggcatgtgggcaggtggacatgggtctgcccatggtttcggcttgcctttctctaattgctaacaacacaggatagccccagctgccatccttacaccctctttggcaaactgtctgctcatttcttttgctgacagttaactggactgttttgttttcttactgctgagttgtgtatgttctttatgtattctggatatcagtcctttgtgggatgtgtgatttgcaaatgttttctctcccagcctggagtttgtcttctttctcttaaaagtgtcttgaagcaaaagttctgaattttgctgcctagtgtcaggtcataaggatttcctatggtttcttccaaaagctttggagttttagatgtttgcacgaggcatgagggataggtcagcgtttggtttttgacacaaatgactgcttttcccagcagcatttttgaacagactaccctttctcccttgaatttattttgctctttgtcaaaactctgatggccccgtttgtgtgggtctatctccggactctccatccacacgtttgtgtggggctgtctccggactctccatccacacgtttgtgtgggtctatctccggactctccatccacacgtttgtgtggggctgtctccggactctccgtccacacgtttgtgtggggctatctctggactctactgtgttccatggagctctgtatccattccttcaacactgcacactgtcttaattactagagtttcacagtaagtctcaaaagtgtgagattcctcttattttttcaaaatcattgtagctatttcagttaatttgtccctccatataaattttagaactaactggtctatacttgaactctgctgggatttggattgagactgcactaaatcaacagatcagtttgggggagaatttgtgtttggagtcatcttccaggtgataaacgcagtgcgtctctccatttatgtagaccttcgattttctgtaacagcatttcgtagtttccagggtgcagatcctgggaatgtcttgttaagtttataactaaggatcgcattatttttggagctattataaatggcatgttaaatattaatttcagttttaaatttcacattgctaatatacagacctatgactgatttgtgcgtgttgacctcactaaatttatattattatttgctacaatccttgaggttttcccaatcacacgtgtgcacagggatacagcaatcccccccatccacaggggatgcactgcaagacccccaggggatgcctgaagccacagagagcaccaaaccctatatatgctgcgctttctcctatacatacattactaaaataaagacaggcagacttgattgattgactgagatagggtctcgctgtgttgctaagttagtctcgaactcctgaagtgatccaccgcctcagcctcctgagtagccaggattacaggtgtgagccaccacacccagtgtaattcataaactgaggacaatcagttgcagtgagtggctggggtcgcatatcagggggtcccttgctggcctcctgcaggctcaatggcaacacgctgctgctcccatcctctcacctcctccacccacagatccaagtactcaacacgcactgtggctgtcacttttgcaatttcagatgtaacagcgaaattaaagggactttttttccctttttcacaatttcataaagaagagatttgttcttaccttagatcttagcaacctcacacacaatctgtttctttctagtcaggaactttcaccttttcatctttaggtcaaggaagtgctttctgtcttctctttggcatatctgaattgccagcatcacgctcttgcgctttgggccgcctcatgtcacataagagcaacctgagcacgagcaccctggcactgcggcagtggatccacacgggggccgaggcacagctgggccgagggaggaggaggcacacctggagcaggacggtggagaccgcatcacactgctcagaacagcatgcagttgaaaacttattaactgtttatttcgggaattttccattaactattttcagaccatagttgactgtgggtaacggaaactgtagataaggggggcttattgttttatttcttttccaatttggatgccttttattctttcttcttaccttatggcactgcctatcttaggcgagttctgatatactgcgctttccaaagagttggtccatttaacccaagccatagaattcatgtgcacagagggtttttttccaatacttccttattatccttttaacatccactgggtctacagtgatactcctctttacatccacagggtttagtgacactcactcctttttattgatcattgcatcttctctcttatctttgtacctactaaaggcttaccaatttattacctttcaaagtcatcacattttgatttcactcatttcccctattgttttaaaaatcaatctcagtgctttctgttcttatttactttcttgtccttgattttgacttattttgctctttttctagtttaagttggaaacgtagattactgaaagtcatcttctttttctaagaaagcattaatcctataaatcccctctaggcactgcttgagttatgtctcacaaattctgacatgctgtattttcctgtgtacagtttgttaaagtttttttgttgaggcatcctctcggacccatggactactcagaattgtattagtctgcaagtgtttggagactttcctgttctctgttactgatttctaatttaaccccaccatggtcagaaaacttacttcgtatggttttgattttttaaaatttgttaagggctcttttgtgacaggtatgctccatcttggtggctaatctttgtgaagttgaaaagatgggtgttctgctgttgaggctgcagtgcatgtgtcatttcaatccaacccacgggtggggtcatcgggctccgtgctctcgctgactgtctatgaggctccatcactgaggagagggctgcaatccccggcgatcatgtgatttctacacaggccgtccgtttgctttgtgtggaaagccctgttgtctggcgcacacacatttatggcaggatttcttcaagagctgctccttttctaattagataaccttcttattcctggtcacttccttcctcggagtctcctttggcactgacatagccacttccgcttccttctgatgggtgttttctcagcacatcttgtcctcttacttctcacccgcctgcaccacagcacctagagtggtgtgacacacagggtgcttatgccccacattcctatgttgaaagcttaaccccagacgcaagggtatctggagatggggcctttgggaggcgatgaggttgcaagggtagaacgctcatgaacagaactggtggctccgtcgccctgccttccttccagcaagaaggtgctgtctgtggaccaggaaagggaccctcaccagacactgaatctggctaatcagatccagtgacgtggtcagtgcccccttcctggtccacagtggatcttcaccttggactttcagcttccagaaccgcaagaaataagattctgttgttcacaagccacctagcctatcatgtttcgtgacagcatcccgaatgaaatacaacaaatgagcttcttgtaaacaccagagagttggttattttaaaaatacattctcataagctgcccagtcccgtctgttcatctgttagcatttaggttttccactatttgctgtttgttgcctctgtttctcattccttatggtatttcttctttcctgctttctcttgggccactgaaatgtttttgtatttcatttaaatttacctattctgattctgactgcgtctcttcacataagctctgcaaggcctgctcaaagggctgtaacacgcaactcaaccccacatgctctccatggcacccacacatgtgcttccactggagcatagcagctctcttgcccacagccccaccgccgccaggccccacagccgccacagccccaccgccaccacaggccccacggccgccctggaaatggcactgcacaggccccacggccgccctgggaacggcactgcacaggcactgccggacactactcttgtcttcttgcaccatcactggcgtctccacaaacactcagtgggaggaggccctcctgttgggagaactctgcagggagcctctggaacaggtctgctggctgtgagggctcttggttttgagtgactttggacactgactggatgtggaattctgggatgacctttcttttctcccagcactggaagatgtgtggggcttccttcttccttctggcctcctgggtttctaaaagtgccacggtcattcactgcggcatctgttgtcagtaccaggccaccgccgtctgactgctgacagaggatggctgccaagggctttttctttgcccccagttctcagcatttggttgcatgcatctgcacgtgtctgtgagccttatttggggtttgcttagcttcttaagtctgcaggtttgtgtctttgtgggaagttctcagccattattgctgcaatgtgtttccggccccgccccctttctcgtctccctaggagtcagacatcagcctttttgggactgtcctacaggccctagcagggaggagacgcgcctcaatcccagagccctcacacgacccaggcagacttgctggtcttttgggtggcaagtggccctgaggccctctgagaagtctccatgtttctcttagtttgagtggatttctgtcccttggtttgaaaggattcctggaaaggcattacatgcaattaattcacacacatctactaccaccatgatgccagctccagatgagaaggaccaagaggcaaatctgggtggcctaggccctccaaggggacataggtctgcccaacaccacatcctacactcctccaaggaccccttttccaaaccaacccagtaccacagaacatgcaggagcagagcctctgggaagggtgccaggccccgtctgcccaggagcagaggcgctgagccagcacttggccacaggtggctccagagccacagtggacacaaggctctcgagtagctctcgggtgctgccctgccacctcaggacccatctccatgcctgatccatggaggccaccgccgtctcacattgagcttgctcccctcaaagccataagcactgtccccatcttcctgggccatgcctggctgtgacacctcattttcctggggaattaagacagtgaagccagctgttgtctgtacctgccccggtgtcacccataaccaaaccaagctgtgacccatcatggccatgagggcagggcccagcaggactgaagccaaggggacgcctgccagctgcctgtgcagaagctccccttggcttcttgaaggcagaactcagctttgtctggggaccacgtctccctgtgccagggccaggaaagccatgtctgtgggcaggatgactttcaggacgcactcacaggcacacattctgtccctgacctgtgtgcactgacaacaacgggacatcagggaaaagcttccgccctcctcagccgcacatgtcccaggctaagcccagcagacccagcctcctcctgcctgcagcctccaaggctgctttcagcaacccaggcctggcggcgctccttcccatgctacgcaagtgaggtgctcagggccactaacggacacccatttactgaggaaatcagggtgcagtgcttccaggagagagctaccagcaccaggcatgttggatggtcacggagaaggtaactgagcccccatgaaatgaatggccgagcaaggacctgtggcctgcccagcccagccctcactgtcccatccagagctgtcacgggagccagcggagaagggctctctgcaatcttagggcattccttctggaaacgtctctgtccctagaaacatagcccatcaacccccaccagctcctgcaccttctgggccccactggggacctgggtagctgggccactggcccagcctgtggcctttccacaggaaggtggatgttgtggaaggcctgtgccaagacttctcagggtctccaggtgagaacggaatctgagaggacaggagcctggggcagcgggggctcagagccccaccgagtctcccaagagaaagtgggctgtagccaggcagcactcacgtgttgcacacggccatcgtctgacacgtctctcctgtgcagaactcggagatggtgctatactgcaggttgatgtggtggaaaaacgtcgtggctggaagagaagagaaggagccagatgtgaaaaacgccagagctgagccgccccgtccacccctgcttccagcaacaggtgcaggagctcggctgggtgagctctgcccgtccacgggccacattctcccctcgcggcagggggctgctgagcaccagccgtgggggtcccccttgaggaggggcttcgaggaggagcagggaggagggagggggcccgcccccaggcccccgcgcactgttgctggccagccactcgttaaggtcaatctcgcggggcagcaccaccagctccttgaactggaagtcggtgatcctggccttggtgtgctcaggctccaggtaggccttcctctcctccgcagcgggcttcttgccattaggcttggctttggacttcctgccaagagaggagacgcggtgtggtcactacacgcccatcagacccagggtctgcccggggggtcagttgtggccagcgcaggtgtagagggagctgcccgagcccatcggggcgacactgcctccctgccaggctcaaaggacaccaacgggacaccaacggtgaggctgctccgcagaggggccagtggagctgccttgcgtggcacctcctgggaagaagggctggcgctcccacttgccacacgggcccctgcacggagggcatcctcacccctcaccaagtcctccaaccagggaggggcccagggtttagggcccccagcgcccaccttccagttttccagtgctcttggaaggaaaggagaagcaaaccctctcactcctggcttcttttgagttggccagcctgtccctgcccctgccgctggtggccccggtgaaaacataccacaggccttgtgcagggcacctgccttcctggccagcctgagagcacggggcccctggcatcaggcggcagcctggcctgcagctccagtatccctgttgtccaccaggcctggggaggccacagggtgatgaggatgggggccaaaggtctttgtggcaacctgaccctgtccttattttttttctttcttgttttgaaaagttgctaatggtttatttaagagaaagagaaaggaaaaatgctccctgaatgccagggaaatgtttccctttcagcttctcacagcagatcttcgccttaaaaggagaccagcgcaggcctctgggggcagtgctgggagtagccagagccaggcagggagcaggggcaggagcaggggcaggggcaggggcaggggcagggaggggcaggggcaggggcagggaggggcaggggcagggcccctgggccctggcactcccactctgccatctctccagagcacagggcgtggggtctgaggaagaggaagcacaggtgtggatgggccacatgcagcgtgggcacttggggtcctcacagtacaggggtgggacagacagggtgagcttccgtgtagcctgcagcccctcgccccagcacagcgaggcacccagactccacaccagcctgtgccaggccatgcccagcgtgtccaccacagggaaggctctccccatgacgctgggcctggccctgaccaccggcaggtgggcctgcacctccctgccctgtgctctcacagcacagcacaccacaccccacccgggcagctacagcctgggctcggccttcccatttggaggggtgggttgcagtggcccaggctgccaagcgggctacaagccgtctccctgctctgtgtcttaggagctgtgtcaactggcaagctccaggtggcagttacctggtggtcggtcacgcagggctgccagcaggagcagctgtcagcgcgctcactctcagggtgtgccccagggcccactcagggaggctgccctactggcagttcctgcccccttgccagccttccaggctggggctaccttccacctccggtcctcagagagggctgggcaggggcagaacctggagacctggcttccctctcccaggctctggctgtggtcaggaggtagtgagcagccgccactccggcactggcacctcagcctccctgcctcttcccgtccacacctgctctcctagaacacagaagaaaagtacgcacgaggccctccaggctgggcctccccgagctgctcccccagtctcaccctgtccccagcacccagggctggccgggccccggagcttagtgcactgtgagacaagcctcctgcaagcctaccttctttggaccgggtcactcattcccatggggcaggtggacgggcactggcccaaaggtagtaggaccaaggggacgcgcaggacatggcctctgctccaggaacggctgtgcgggcaccaacagagggacttccatgggaaagccccgaacgcctggcagcacccacgtctccctgacctcaagtgccctccttcccagaagggcaggctctcagcgaaggcccaggcctgggcaggaagcagtcactctgaggcagcccattgctcggtccaagccagcggcagctaccgaggaggcctcagagcacacgacacctccatggcactcttctcgtccttagtcattcttggctttgcccagtggagaaaacacctctgcggcgccccccgcaggctcacaggctctgaaacaggctctgtgccgtccaggcccagaggtctgcccagtcactgcctcagtggcccagctgcccctcacccagggaagtgccgaggccctgcgccctgctcccagctccccctgtgctgctggctaggagccccggggcacagaaagaccaagtccttcgatgtggagggaggactgtgggagcaggccccggccgcaggcaggacagagatggcgctgaagggactggggagtggaccctggacctcagcccacccacagggcttccgtgaccacttggaagaagcagaagggcagatgctgtgtgcacagcccccaaaacaaagtccctcacactattccaacaggtgggctctgagcctgggtcctgcctggcaggcaccatgcacttaggagggccgggccagatggaaccacctccttcctgcctcccacacactcaccagcctcacctccctcctccctgctctagatgacctgtcctgcctgccacaggggtctgcaccctgtttgtgggcaccagctgctgctctgccaacttgcccatcttacaccaggcctagcaaacttctcctggtcctttaagagcctgtcaaatgccaccctccccattctcgccagtggtacccatgacgtgccagtcggcctccttggcacccagcacgtaactgatccctactgggaagtgaggcaatccctgctagacacaaatttggtgggcaagggaaggggcacagggaggcatcagagctgctgggctcccgtggaaaacttagacaaccacacagtcaacacacagggggtctcaccctgcccacagcaggtgcacactgcttcacaggcagggggagctggggagtgggctgggagccgcccactcctcatccgccctgagggacgaggacagcacaaccgagtgccctgcacctttgccacgagtgtcaacttcattatcacagggatggaatcctggccaggccccacggcccacaggaatggggtgctccaggctcagagacccccactcgcccagagcacgcttgctatggaagtcgagcctgtagaccctgaggtgagtgggcagcagcaggaggtggccctcatctggcacttcccaccacaggtcaacgccaaggggtggggcaggcacgaggggcccagaaatacaagtccccaagcccaggcctggaaaatacggtgaccaggcagcgtgtggggtgcaggagaaaggcccgcaggtgacgcctctgaggagggcatggtccttggaccccactcagccatctgcaccgggcccctcatgctccttggttcgggtgaatgtcagtgctggttggtccacccagagcctgaaagtcaaggctcccagtgaccccttcccccaagacccggccaggcagagcccccagtagccacccggtacagagcctgggtctcagcacaccttgctgcccagggtgcacgccacgggcacctcctgtcaccccaacatgcagggagggcaccacatgctggggtgcttggcgccacccccacccctacatttctgatgtggccttctgggtgttgagggggggcctgaaaactgcatttctaacaccgtgttctaacccgagttctccctgggtgctgatcccacttctgtcacacggcctcaggctgaggggtgggaaggcctccggagcccctgtccatctctcagcacagcctgcactgcccacaggcttcagccagctggaagctgtggagtgtggcttcttttcttctgagtttaattgtctgcccccccaaacaggtcagcagccccagacaaagcgagcttttaccagcctactgtgccctctgcagaggcccattgagaaggaaaaagccaagatggcacaaggaacgcccgcagacatcccagaccaaacgtccaaacaggcaggtgctgctgctgtcctagaacctcagccccacgtggccaccatgctccactgcgcctcggcccctccatgcatccagctcccagccaaggtggcttcctcatcgcttcctttgaaaccttcctgagccccagggaagggactccgcccgtcttccttagggcctggctgggctccaggcctgcctctgtgtctcctgtggagctgccttcggcatttggcctcagacacacaagcacacactggcacaggcacacacacacacacgccagtcccctcacaccactgatgtcaggcaccattcctgatttgaactcacgagtactgccaacttgcccacacatttccaaaacctcacagtttcaccttaagataggacatcctaggcagggtcaccggccggcactcttgtgtctacttgtggagccctccctgttgaatgcacaggtgatcgggagatagggaaggagcctatgaagagaaagatggagccgggtgcccagggacaggcagaggcacggagatgcacacgggtgccgcagcccccggcccttggagggcacgtccagcaggccacgctcgcctcacacccccaccaggcaaccccacccgggaggacacactcactgctgcagctggctgtgcctgccccactcccccggcccctcatgcccacacacgggtgcacactcccacacacacgggtgcacgctcccacacacttgggcgcacactcccacacacgcccctgcacacaccgagctgagtggtgtgggcagggaggcacccccgcagcaggtcagagaaagtacaggtgagaaaaatgtcaaaaatggattttccggcaacatccctatggcagccagcacaaaaataggcacccgggaaccccatgccacttctctggacaaggccacacaaggacagactccgggtcacctctgcctgggtggctgaagcccctgcccagggcacaaacagccgcacgctgggacaaagacaggcacacctgctggcggctgaggaaccacaccctgtgggttgcgggaggacaaggcaggctcctgtgccggcaaggtggggtcaaccccgaaggtcgaggacaccaagacccgctcctctcccacagagcaacaggaagtgcaggcggctaaggaaagccccactgggcagggctccagagcaaacccgccaggctggcccgggactgcacagccgcctctgccctggacagcttgcgtgtggcccagcacagctcgctgcacagccgccggccacactgggagggcagccacggacacagtccgccgcctccccaccctgacctccttcctgggggcaagaacagggcagacagatgtgctacacacccctcccccagccaggctggcaggtgttacctgagcactttgctgacagcctgaagcaccattttgcagcagagtccactttgcagggactggccgggccgggcttggtcttcagggagactgcagtggtctcccagcatgagtgggcgacgggaaggtggggaggagaagcggggcggggtgccggctggccagcactcgcaaatgcctgctgccgggccctccagcctcactccctggccaatgggacgcctggcagagacaaacagctgccccctttccagaggcaagggctggccaag

SEQ ID NO: 1376 - DNA, 158530 bp, Homo sapiens
ccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggttccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggtaaagccccacctactttatttgacggtcctttggatcccaaatttggctcggcgaagccagttgatcgagttcacccttcacttggcattctctgttggactccgagtgggacggggaggccaacttttgaaaggggctgaaattaggagaatgtggagcatgtgcctaggtgttgggataggataagaattattggtagccagagggatttgctaccgggcagcggtggtgaaggtcatcttagtacaaacgaattgtctcctggtttagagtctggcaggaaacttggaatgagtggggaagttgaaagtacagatgcttcttcttctgtgcatttcaatctcatcaaaggctctgcagtgatgagctgcgtctgggtgtagaagcgtgttttcattcctgagatcaggctgttctttttaaatgagaacaaccttgtacctttggatgtattttgcttgatggttgcacaggcatttagtataaaataattattaaaaaaagactcttctctgccccttttggatgtttgatgttgttctacctaatgatgcttaagccttacagtagcagcattgctctgacgttcattaaactaatgtctttcagcccattcactatacagcgaatagtataggagcccatgcaaaattgtgtaagtgctttgagagtcgtaatgtcatcatcattgttttaatcttataaaatatctttaagctgaactttcccaagagtccgaaggagtcgcagcacttccttttttaacctctagtggtgtaaataatggtgtgtcattccggttgactagtacattctaggtttaaacagctgagtttgggctacttgttgcttgacttactgaagcagcttgcttaaatattgccctgattgggcataggtgaacataggttattagtaggagcaggtttatgctgaaggaagtcagccacattatgcatgcataaaaattgccattattgatatagtaatcttgccaagaatatagaccagcctgatacaggatatgaaaataactgaatgatcttggaacttattttatccatgaactaatatgttaacacgtaaccctttgaatgtcaggttccaaataactaaggccatatcaaatgtgaaattaacacagcatgtggaagtaaacttaaaaactaagaagttctttacaaacataatcatttcttaacttttacagttaatgatgtagaacttctaaggtagtgtgaaattaaaactactcattaattttatagtattttagaattgaaaaggtgacagatctttaaaaaaaaaaaacctcgtcaaacgaaaactgttcattttggtcagtcatattcaaaaaacttagtctgggccaggcacggtggctcacgcctgtaatcccagcactttgggaggccaaggcgggtggatcacggggttaggagttcgagaccagcctgaccaacatggggaaaccccgactctactaaaaatacaaaaattagccgggtatggtggcgcgcgcctgtaattccaactactcgggaggctgaggcaggagaatatcttgaacccagcaggtggaggttgcagtgagcggagatcgcaccatcgcactgcagcgtggtgacagagcgagactccgtctcaaaaacaaacaaaaacaacaacaacaaaaaaacttatgtccgattccttttggtttacaggcagaaatttacaggtagacacatttctttcttgtactatcgatgcttattgatactgatgctggaattttattcttccattatagttttatatttgaataggtgctttttaacaattttgttttccttaaccggttaccttacttttttaagactggacccaattacttgttgagcactttatgaattaattttgttagttttaattatttcacttctgagacttcttagcatgtgatgtgtgttttccttttatcacctggaattttctgatactttattatcttggaactgataatacagtgaaaaaaacttaatttgtctaatgtcacgataaaaactttgtccaagcttctcaggttttcttagaactcgtaactttttggatttttaattctctatctaggcatgggcattaccaaactaaagaaaatcttacatcgcatattatttttgagtcatttcaggatttggctgcagaactagatgaatcctagcttattaagtggtacctggtttagaaacttccatgttatttgtctgtgcttctgtaattttttgttttgattttgaaaagattatcttacctgaaaaatcctttatagcagtagttaggcagtatttttggttttttgaccaggacacttgcactacatgcctaataaaatattcagtgggtcagtgtttgaacttttatctttggagccaaattaaaggacaagccaagggattactaaagcactggaaagatagaaactttttcgctaaatctatccttttaatatacatatatttctgaagcaagacaggagaatattgagttaagttgttgagttaaaaatcttagtgtattgaaactgggagaaatcttaggttattctgcccagctatttatttgacaaataaggaacctgaaatcatagagcaggtaaataacttgattaggtagatgaagaacaaaagctagttaggatctaataatttgggagatgacaaagcatttgtagtccagtagatggctaataagtcatttcaaatgaagcaatattgtgttggtgtggaagtggctgttggatttctggagaaacccggtccttatacccatggcaaatttcaggcttctgttttgggtgttgatttttatcacttcaaattgagatataaataggcttttgtggatgggtcaatatggtatacaaatcaagctattttctgtcatgctaatttttttagagtcatgctatgcattgctctttagtaaaacaagcatcaattcttttttttttttttttttttttttaaaaaaaaaaagagacggagtcttgctctatctccaggctagagtgcagtggcgcaatctgagctcactgcaacctccgcctcctgggttcaagcgattctcctgcctcagcctcccaagtagctgggagtacaggcgcaccccaccacacccagctaattacaagcatcaattcttagtaaataatgcctaggtaatattttgataccacaggaccttcagtaattaccgagatgtttaagatgcagatttctttaactggttttattagacaagtagtgcaccttaattttaatatttggttgtcttggtcagaaaatattactgttgggctctatctgcagagtttacattgcttttctagaaagggatctggtttttcaaaaaagatagcataatttcctttaagaaaacattgatggagccgggtgcggtggctcacgcctgtaatcccagcactttgggaggccgaggcgggtggatcacgcggtcaggagttcgagaacagcctggccaacatggcgaaaccccatctctactaaaaatacaaaaattagctgggcgtggtccgcacgcctgtaatcccagctactcgagaggctgaggcaggagaattgtttgaacccgggaggcagaggttgcagtgagtcgagatcgcaccactgcactccagcctgggtgacagggtgagactctgtctctaaaaaaaaaaaaaaaaaaagaaagaaagaaaaagaaaacattgatgcacagatttaagaatgatttattttaagcaccttcccaagttgcctctgaagagttcacatgatgcgttatatgttgatgagattgtttccacatctacctgaaaagagaggttaaatcatatttttgttgaagctccaatatacttaactgcttatttttctctgtcttttattaagactgtgtgtcatgagtacatgacattaatattttgtgaatagtatagcagtgttacagaaatgggatgtggttctgtgattaagaaaccatcatttatttctttgctatagttctttttttttttttttttttttttttgagacggagtctcgctctgtcgcccaggccggactgcggactgcagtggcgcaatctcggctcactgcaagctccacttcctgggttcacgccattctcctgcctcagcctcccgagtagctgggactacaggcgcccgccaccgtgcccggctaattttttgtatttttagtagagacggggtttcaccttgttagccaggatggtctgctatagttcttaaaatatctaattgaactgaatctctctatttgaatgttggtgattttttccctcttatcttttaaatttgtgccacattccttattttttaggatgagaatcagcgtaactttccgtctcagggaatagtttttggagtttgttcttaaatcctcaaagtcaccgattaggagtattggcaaatttttttctcttaccttttttctgacccgtagtaacacagtctgagaagtaatctaaaaacctggaaagaggttgtttttgtgtaaaacaaaccaggaatctattgttgctttgtgacaattcatttcttgacattcaaattctgatgcaagagcctagtcatttaaaatttatcttattccaccagcagcttatcaaagaatttcaaaaaataaaaaatatatgtatataaatataaataaaattcatcttagttcatccctatggaaacattcaactaaaactgggctctcattttcagaaatcatcctaaacctgttatttgggttttctggtagtttttacatttttttagataaagctgtaaaagcagcaagagtagctgtactcaattatcatttctgaaaatatttagcatactatgaaataattcataattaccgttagtacacctttgctataccagttctttaaattatattgataatttaaattatatatttagtaacttgcattttgtttgagttttttgtttttttgtttttgagacagagtctcactctgtcgcccaggctggagtacagtggcgcgatctcggctcactgcaacctccacctcccgggttccagcaatgctcctgcctcagccccctgagtagctgggattacaggcgagcgccaccacgcccggctaatttttgtatttttagtagagatggggtttcaccatgttggccaggctggtcttgaacacctgacctcgtgatctgcccgccttggcctcccaaagtcctgggattacaggcttgagccaccatgctcagccgttttgttttgttttaaaacctggtctgcaggaataggtgagacttagcatgacctcagtttatgtttgaagaggccatttttctgccttgtaacatagtagttaagaactagattgcctgggctcaaatcaaggctcagctacataattgtgtcaccttgagcaagttttgtgctacagtttcctgtctgtaaaatgggtgtaaaaaagagtacccattttatagagttgtgctgattaaatgaatgaacatatataaaacatgtaggatagggcctgccacataaatattaactgtgatgatgcagcatcttttttaggttgtccttttgagggaatctgtgaagattttgtttgtttatatttatgcttgaaaaatcatatagcaaaacttaactactgttcttggaggaggaggaaagcaggtattgatctttatgttactggtgcttttaaattccttagctctacctggcctttgcctaacattttaattttgtgacccatcacccaaatgccaatctttctgaactgcttattttcagaatctgctaagatccttgtctcatctttgcatgtatctagaaagcatattttcttttggtggatctcatatataattcttatagtatttatttatcatattgaaattgtttatatattttgtctaatccattagtctttggaaagttcactatggtgtaatagaatactatacaatgaaaaggagcaccaaggcagaacccttgagttctagattacccaattttctgagctttgagtaaggaacttaatctataatgctcatttattagcaatatgtcttactgatttaggattgttgaagatccactgaaatactatgtgaatgtactttgaaaaatgttaagtgttatataaaatataacagaatacttaaatattcatttagaaggctataaattgtcacctattacaaatggaatatattaaacttagttggattttaggagctttttgctttgtcaacttaatttctcaaatcttaacaggggagcttttcagtttgaagaaacattgtcagaagctcttaatattttatttggaagatgattatgcctttgacaggtagcaggcttaattttatatgtagttttttttttattgttgttgtttttgatggggtcttgctctgtcgcccaggctggagtgcagtggcgtgatcttgggatcttggctcactgaaacctccacctcctgtgttcaagcgattctcctgcctcagcctccagagtagctgggattacaggcacccacaaccacacccggctaattttttttttttttttgtatttttaatagagacagagtttcaccgtgttggacaggctggtctcaaactcctgacctcaggtgatccacctgccttggcctcttaaagtgctgggattacaggcatgagccgccgttcctggtctatatgtagtttttaaaagattggttatttgtgatttttacataagaggaaaagcatcagtaagctgtggttttgtggccaacttaattgatcatataatatctccaccttcacttacattaatttagatttttcaggtggggtttcataaataatttactttttagtgttgtgacttgaatcttggctttgccaaattaccatattaaatacattatgctaaatgaatatgttggaatgattttttagaagagtcctcagataagctgttagtcataacaagcaaataattttctcaggaatgtaagaattcttaagaattttaacagtttgaatttaagagtgtttggaaatttgcttgttgtaatcatcatactcaggttagttaagaaaaaccacagtcattcctgcagataccttttgtgcagctgaggttcagcttctcagagacaatattatttttgtcagtagatacgtggtagatggtctagttaaccaaacacacactaatgtataaaccaaacagtgagagatgaaattaattagtgaatcaaatgattaatgtgcacattctctgttactagatagagattaacagatttcttgggataagatcattttcatggctaagagttttgagctacataacctgatatatctatctttatgtggatcatctccttccatggactggtagattattgtggattaaggtaaatcgggaaatgcaacagatttatctctttaacatgctaaagagttactagatatcattgtcatattaaaatgttctttgaactctccatattgcccctctcacacacagtcatccgtcagtatacacaggagattggttccagacagcccccaccccagggtaccaaaattcacaaatgcacaagtctcttaaataaaatggtgtattttcatataacctacagtagtacatcctcctgtatagtttattttttaatttaatttttttttttttttgaggctgagtcttgctctgttgcccaggctggagtacagtggcacaatctcagctcactgctacctctgcctcctgggttcaagcgattgtcatgcctcagcctcccgagtagctgggattacaggcacatgctaccatgcccaactaatttttgtatttttagtagagatggggtttcatcacgttggccaggctggtctcgaactcctgacctcaagtgatccatctgcctctgcctcccaaaacgctgggattacaggtgtggctcctcacgtatagtttaagtcatcactaaattacttataatacctaatacaatgtaagtgctatgtaaatagtttttatactgtagtgttttaaaattcatgttgttttttattattgtgttttgttattgttttttcccccaatattttcatctgcagttagttgaatccatggatgcagaacatgtggatatggaacctgaggatgtggagggcggactgttcttatgtgtagaaagtagagagtaactgaagagttgagttttaaacagagaagttaattggttagatttgcatagcagtaattgcccaaaaatagattaaaggcatacagggggaagtgtagagattccagtagtccccactcttcttcttaggggataatggttatttttttctcctgcttttcattttttttttgagacagagtttcactcttgttgcccagctggagtgcaatggcgcgatctcggctcaccacaacatttgcctcctgagttcaagggattctcctgcctcagcctcccgagtagctgggattacaggaaggcgccaccatgcccagctaattttgtatttttagtagaggtggggtttctccatgttggtcaggctggtctccaactcccgacctcaggcgatccgccagcctcggcctcccaaagtgctggaattacaggtgtgagccaccactcctggtccgtatttttatcttttggttctgtttactttgaggtttgcaagacctcccgtggatacctgaagctacagacactactgaaccctatgcatactttgctttttccatcccataacccattagactaagtgactaaaggacgagatgggtgggtggcattaacagtgtgaatatgctgaacaaagggatgacatgtcccattcgagatttcatcacactagtcagaatggcacacaatttaaaagtcgtgaattgttggctaggcgtggtggctcacgcttgtaatcccaacactttgggaggccgaggttagtggataacctgaggtcagaagttggagaccagcctagtcaacatggtgaaaccctgtctctactaaaaatacaaaaaaaaaactagccgggtgtggtggtgcatgcctgtaatcccagctacttgggaggttgaggcaggagaatcacttgaacccgggaggtggaggttgcagtgagccaagattgcgccattgcactccagcctgggcgacaagagggaaactctgtctcaaaaaaaaaagaaaaagttatgaattgtttatttctggaattttccatttaatatttttggacagtgggaagtgaagcctcaagtaagggagggctactctagttaggatatgagtgtgagatttttaggacctaaactagggagataatagaaggaatagaacatttagatatttaggagataaaatatttagggtttagtggataatttagtgattaattggtgtttggaggaaaaatgaagcatggataagaggttaggggatgatagtgctgtcaactgagagagaaaaatcaaaggttttttttaagttttaaggttttttgttttttagatgggaggaggtatggagatgtattcaattggacatgttgagtttgagattcttatgtaatctccagtaagaagttcaataggcagttggatatattactaaaacttgaagactaggtctgagatgaagataaaagctgatgattcccaaaaatgtctatattagttgtagctgaaataatggaagtaaatgagatacgctagggagaggatatgaagagatagaaaaattagagagagggagagggaagagtaatggtcctcaggcaaaatagtaacaattaccaagggaataaaatttcaagaaaataatacatcagagaagttctattttcatagtagtaattgtggagaatgaatttaacaagtagtaaagaaatgtagtagttaggctgttgaaattgttgcacttggctattaacaaatcattaacacagcacggtggctcacgcctgtaatcccagcactttgggaggctgaagtgggcggatcacctgaggtcaggagttagagaccagcctgaccaacatggagaaaccccgtctctactaaaaatacaaaaattagctgggcctggtggcacatgcctatattcccaactactcggcaggctgaggcagaagaatcgcttgaaccggggaggtggaggttgtggtgagccgagatcacagcattgcactccagcctgggcaacgagcgaaactccgtctcaaaaaaaaaaaaaaaaaaaagaaagaaaaatcattaacattcccactgagaaacagccctgacaaaaagaaattaaaaaaaaagtcagtaacaattaaatttaaggttgcctcagtaagggggaggttgaataagagagaagcacataaatacatgtaagtcactggtaatgccctagatttctgcactgttcactatctaatacaatatccaccagcctcacgtggctatttcgctcttgccacccaggctggagtgcagtggcgtgatcttggctcactgtaacctctgcctgccaggttcaagcaattctgcctcagcctcctgagtagctgggattacaggcacgtgccaccacacccagctaattttgtatttttagtagagacagggttttgccatgttggccaggctggtctggaactcctcaggtgatccacccatctcagtcttccaaagtgctgggagtacaggtgtgagccactgcgtccagcctttatgtggctatttaaatttaaataaattaaaatgaaatttttagaacttcattgtcttgtactagccacatttcaagtgctcagtgacaacatgtggctacgatattggattgcacagataaagaacattttcaggctgggcatggtggcttatacctgtaatctcaatactttggaaggctgaggcaggaggattgcttgggcccaggagttcaagaccagcctgggcaacatagcaagaccctgtctacaaaaaattaaaaaattagctgggcctggtggtgtgcatctgtaaccccagctactttaagagactgaactgggtggattgcttgagctggggaggtcagggctgcagtgaggcttgatcatgccacttgcacttcagcctaggtgacagagctatgaccctgtctcaaaaacaatttttttttaatcattgcagaaaattcttttggaatgtgctatatccagatcttgggtcaagttgtgcttttaaaaaatataacgatatgaggactgtgcatggtggctcatacttctaatctcagcacttctgggaggccgaggtgagagcattgcttgaggccaggagtttaagactaggctgggcaatgtagcaagatctgggtctccaaaaaattttaaaaataaaaataataactttatccaaaaagttcaactttaaccataaagttcatccttttaaagtatatagagtgttgtttttagaactgaagttacacatttaaatatgtatactctattaataaagaaaaaatagttattttttgggaaactgtacaaaggatgttatcacatacatgcagaattaataaaggttaacaatatgtcatagttactcaaaatatttggtgaccttacagtttcagaagaagggaaaatttgcagtgggtttaatgagtggatgagaggaagtttagaaagtagagacaataagtgtaggctggggtgagggttgaaaaattacatattggatacaatgttcactatttgggtgataaggcgataaggttaggtaactagaaaccctaacctcaccattatgcagtatatccatgtaacaaacttgcacatgtacccctgaatccataataaaatatatgtatgtaaataaaaattaaaaaataaaaccatgaacaaaataagtgtaggctgtttattctggtaattttaaatgaataagttcagggaaggttgggtacaaggatgagatggatagatgagctggaaaaggtctttaaaagttgaaacattgaactgtcatgttttgtctgctttggtatctatcataagtctgttccaagccaattactgctttagctttgattattctttttttttttgagacagtctcgctctgtcacccaggctggagtgcagtggcatgatcttggctcactgcaacctccgcctcctgggttcaagtgattcttctgccttagcctcccgagtagctgggactacaggcgcgcaccaccatgcccagctaatttttgtttttttagtagagacgaggtttcaccatgttggttgggctggtattgaactcctgacctcatgatccgcctgccttggcctcccaaagtgctgggatgacaggtgtgagccaccacacccggcttattttattattatttttgagatggagtcttgctctgtcgcccaggctggagtgcagtggcatgatctcagttcactgcagcctccgcctcccaggttcaagtgattctcctgcctcagcctcccaagcagctgggattacaggtgtctgccaccccacctggctaatttttgtgtttttagtagagacagggtttcaacatgttggccaggctgatcttgaactcctgacctcaagcggtctgcccacctgggcctcccaaagtgttgggattacaggcgtgagccaccgtgcccggccctagatgttctttagattaaaatagttcattgtggtcaaacaggttcatgctctcttacaccaggggtaatccatacttggacacacaagagcttatgtcaaaatatggcagatttcttaaaatattcctgttgtggcagactttctgggttgataggtttttttttttttttttttttttttttttttttttggagacagagtcttgctctgtcgctcacgctggagcgcagtggtgcagtcttggctcactgcaacctacgcctcccggattcaagcaattctcctgcctcagcctgctgagtagctgggattacaggcgcgcgccaccatgcctggctaatttttgtatttttagtagagacggggtttcaccatattggtcgggctggtctcaaactcctgaccccgtgatccaccctccttggcctcccaaagtgctgggataacaggcatgacccaccacgcctggccgggttgataggggttttcagccttacctacacatgcaaatctcctttccctctgtaatccccaaatttagactttaattctcctgtctttcaaggggagttgccttactctgtgtgggttcagggtgagggaaacttttcagccagtttatgtcattgaagtacattgaagtttatcagggaatttctaataatagtaaacttaaaatggaaggccttggagttgtagttgtttaccagaagagtttttggctttttctgcatacttctacacacctcttacctcccttcctaattgatagagacagatttttatcaggtcacacatggaatctgctactccctttgaattcaggtctgtttgcttcaacgacgtaactgagaaggaccactctagatggctcctttctacctagacatgctcttttctacctagacaaaaaaagccaccagccattaataaatggtaaactatcaacttaaatatttgttctgcctacccaggcaccctactacatagaggggctagtttaggttttagtttggtgacaaattgtttgtgttgcattgtatcaggttttttttgttcgtttgtttttgaggcagagtctctctctgtccaggcccaggctgtagtgcagtagagagatatattggctcactgcaacctccatctcccgggttcaggcaattatcgttcctcaacctcccaagtagctggggttacaggcgcttgcaaccatgaccagctaatttttatatttttagtagagacgggatttcatcatgttggccaggctggcctagaactcctgacttcaagtgatctgcccgcctcggcctcccaaagtgctgggattacaggcgtgagctaccatgcccggcctgcttgtatcggtttctttatgtctccacagatttttttgttttcatggacataagtggggagcatagagatattttgctagtgatcatcctctggctaaagcatagtttgatttctgtgataagaatcttgaccatattctatccctcttagaagggcagaagtgaaactgccatattacccataaataccactattataggctttcacaaatctgtatttactgagtgtgtacttggtgtgaatacctcattaatgttttaaacatctgccattcttattctcttaatgagtaaagttaacttcttcaacaaccagtacttagctaaatattacacaatataatttttccctttcttcatgtaatggatgaagtttttttgttttttttttgagacggagtcttgctctgtcaccaaactggagtgcagtggtgcaatctcagctcactgcaacctccgcttcccaggttcaagcgattcttctgcctcagcctcccgagtagctgggattacaggcacgcaccaccacacccggctaattttttgtattttagtagagatggggtttcaccatgttgaccaggctggtctcaaactcctgacctcatgatccacccgcctcagcctcccaaactgctgggattgtaggcgtgagccactgtgcccagcctggatgtagtatttaaagaaaaaacaaaaaactctttactgtgaaatactttcaaacataacagttgtcccagatttggctagaagctaccttccgtttccttttttttttgacagattctcactctgttacccaggctggagtgcagtggcaccatctctgctcactgcaacctccgcctcctgggttcaagtgattctcatgcctcagcctcccaaattgctgggattacaggcgcatgccaccacgaccggctagtttttgtatttttagtagagacaggttttgccatgttggccaggctggtctcaaactcctgactgacctcaagtgatcttcccgtctcagcctcccaaagtgctgggattacaggtgtgggccacaatgcctagccccttctgcatccttgttattaacatgtccctatcatttttttatgacatccttactttctgtagaagatgttctcagttcattttattatttccccaccccagtcctgcagcagcaatttctcctggagccctggttctttttattgtagaaaggtattcagaaaaatctgggtgccaggtgtgctcggctactgggcctgttttcggtgaagaattagtgtcttagttcatttgcgctactataacataatatataaagaacagaagtttatttcctcgcagttctgtaggcctagaagtccaggcaagacagaggcatctgttgaggtctttcttgccacgtgctcacatggcagagggcttcagggcaagagagtgtgaacccactctcaaaagccttttttatagctgcattaattcattcatggaggcagagccccacttcccaaaacactgttacattgcataagtttcttttttttttttttgagacggagtttcactcttgttgcccaggctggagtgcaatggcgtgatctcagcccaccacaacctccgcctcccaggttcaagcgattctcctgcctcagcctccctgagtagctgggattacaggcatgcgccaccatgtctggctaattttttatttttagtagagacatggtttctctatgttggtcaggctggtctcaaactcctgacctcaggtgatccacctgcctcggcctcccaaagtgctgggattataggcgtgagccactgcgcccggccaggaattaagtttctgatacatgaatttggtggggaggaagcatttagaccatagcagttaggaaatatttataagtaagcatgtgtgttttggattttgaaaatttagtatgaaaaagaaaagcatttgttttcaaaaaattggattacatattgaaatgatgatgtttagatatatttgttaaatatattaatctgtttctttttacatttttaatgtgactactagaaaattaaatttcatttagctcacattatgtttctgttaaccatcgctaatttagactattctattaaaatgctgtgaaagttgatgctacagcaaatttactacttccttttaaaaaatatcttaataccttcctttttgtggtttcttgcattagcatcctctacaggccataattctttgctgttgctgaacacagaaatttggggttttaaactcttagtggtttgtgatgcttttcataccagattgttaagaaaattggaatcctcatcctttaaaatattatcttttgttatttgccagcatgtccggtaatcagaaatggcatttctttatggctttgttctttgagaactttaattgttgttaagagaatattagaagtgtttactataaatatcttgaaatatttgggaaatattttggtttatttcagataaactgctagtgtatgtttggaatacgttaaatgcataaacttactgctttatattttctttttttttggagacggagtcttcgctttgtctcgcccaggctggagtgcagtggtgtgatctcagctcactgcaacctctgcctcctgggttcaagcgactctcctgcctctgcctcctgattagctgggactacaggtgcatgccaccacgcccggctaattttttgtatttttagtagagatggggtttcaccgtgttagccaggatggtctccatctcctgacctcgtgatccgcccgcctctgcctcccaaagtgctgggatgacaggtgtgagctactatgcccggcgctttatattctttagtaatttctggccattgtggctccttaagcttgttaattaatttagtgtccatattcatatcttaatgatactgagaaattggttaaattggtttttggtgtctgtctcttgcttatgaaagataaactgtagttcagctatttattagcattgagtttttctagaatagttaaatttttttgtttgtttttgagacagggtcttattctgccccctgggttcaagcgattctcctgacccagcctcctgagtagctgggattacaggggtatgccaccacgtccagctaatttttgtatttttagtagagacacggtttcaccatattggcccggttgatctcgaactcctgacctcaggtgatctgcccgcctcggcctcccaaagtgttgggattacaggcatgagcctctgcacccagccttaactgctttattttaataaagttgtaatatatttgagatggcaagaccattctcttcagactgttaatggtaattttttaaaattattttttatttttagactgggttgcacactgtcacctaggctggtcttgaacttctagcttcaagcaatcctcctgtttcagcctcccaaagtattgggattacaggcttgagaaaccctcttaatttaaggactgcagaagcttactttttttttttgcataagggcctttgatagtcattgtttatggctacaaactaatttgattttgactaaattatctgagttataaacttcatttatttccaccttagttattgtaaccatccttaattcatacacaaaaaagatgctttaaaaaattagtaaaacactctcgttataaaaattaggaaattagaggaggaaaaaggaaataaaaaatcacctgcagtcagtatctttatccagagataagcattgttactgtgtatgacacactggtttctgtgtgtttgaactctgtttttatagttatcgttatattgtatggttgtacagtttgcctgttttaccacatagcaaaagcattttcccatttaagatcttgaggtttttagattaaaaagcagcaaaatatttgtacacagtaatcataattggggtgtgtgtgtgtgtgtgtgtatgtatgtgtgtgtgtgtatgtataggggtgtgtgtatgtgtatgtatgtatgtatgccaccatacagcagcgtaattatgtgtatacatacgtatgcacacacggttatgttgctgtatggtggcatcatttgcctgatttaccttatagaaaaaccatttcccacattaaaattttgaagttatatataaaaaacacttgaattcttgagtatatattatttttttaattctcagtaagagaaaattagaatgtttgtcccacagatgcaaacatttagttagaactaaatctagtaaattgatcattgatacatttgattgctctgaacagaagtttagaagtcatggttgatatattacaaagctaaattatttttttcacttccagtctttgttcagagatttgcaagaaagtccattcactgcttcgcatataatttggggtattatcagtagtttgtttttagaacagtggtactgtgtggttcagaaatttgtaaaagccaagtgttagggtgtttaataacagtacattgtaagttctttgaggagctgggcacggtggctcacacctgtaatccagcactttgggaggccaaggcgggcagatcacctgaggtcaggagttcgagaccagcctgaccaacatggagaaaccccatctctactaaaaatacaaaattagccgggtgtggtgacgcatgcctgttatcccagctacttgggaggctgaggcaggagaatcgcttgaacccgggaggcggaggttgcggtgagctgagattgcgccattgcattccagcctgggcaataagagcaaaactccatctcaaaaaaaaaaaagttctttaaagaagtttagtttcgtatattgactaagctatagggggaaaagccttactgtgccttttccacttcctacccactcaagataacctaagttggcttcctttatttaaagtgttaaatctactctagagcataccaaagatattttgaaaatataggaaattcttaatgcatttaaaaggaactacttcccaatcagtttttttcccatcatagaagtaatgtatactcagagatatcttaaaaaacaaggaaaaataaaaaccaaaataaccccactgaagtttcatcactaaaagacaatgtcgatatagcatttagaatgtttgcctgttcctccctctcatgatggattttaatatttattcaccaaatgtttattgtactcctatgtgcttgaggctgtctcaggtagcaaatagagaaaaaaattctgcccttgtgaaacttatgtttcagtgggatcataggtgtatgtttgcaattttatatcctgaaaattttataattcagtataacataagaattagtataaatatttttaatagctgcttgacagttccttatgtgcatatgccataatttccttcatttccccacagtgttaagtatgttatttttgctattgtaaatatagtgggcgagggtcttactccacaaggttgtaaccatgaaataatatttctgttttatgaaaaccaaatttaatctgtgttgtatccttacctaattgagatggccattatttccctgcacaaatccccctccctctaatccttggtgagcttcttacattccagaactttatcaggaaagggctttcctccagtctttcacctacaccgcttgtcattgacatgcccatttatgtaagtctggaaggtttctttaaggcctcgttacagagaatattgggtaataggatctttgcacaattttccgaaggaaagtttttaccattattgtctctcccttctccctgcagctcccaaggagggtgagtgtattgatcttttctggatgaatcctctaatcccttcctttcctccagcatctacctctcaaactccattctcatcccctccctcttgagtataatccaaccagactccttcctttgggcctggactttctcagacagaagccagctgaggagactgtcttctaattgctggttctaaaataacagtcttgaggctagaggcccacaagggcttggaataggagaagggaatttgcctacttagccttgtgaacaaaacactgatcagtacctcagatttcactgtttagaactattttcttaggattaaatttcagaaatggaattactggttctaagggcatgataagggcatgaacatttaaatactttctattcattgtaagattgttttccagaagagttatatagattttcagtgtcccaagtgagagttcttattttattaaccccatttatcaatactgttaaatatttcataaactatagtttatgtctgcagaacttcccccatatgctttgataataataactaattgtatttcctcttttgtcttttgttatatttttgccttcaggtgcttttctcccctaaccagttttcataagttccttatatcagaatgaatccttttatattttctgcaaatatttttcaatgccgagaatttaatgtcaatagtatatcactgtttataccatcaaattggttagtcatcttaattctgtttttctttttttcatttaagtatagtgaatctttgaacttgataggtgaatttctggttttttatcttcttgatattggtgtttaaaatggatttatcttcatggatatatttatgttatagtattaaaatctgaaattgaacttagtatacaaaaaatagatttttaaaatgtttatactagctccttatcaatgtttaaaattttgcttttgcagttacaataatggttattcccttatttctgtatttactagtagagagtaaattaagacattactgaatacaatgagataaatggcttatcaagtaatagtctttcttgtaacacaaatgagttcttagatcagttgtctttaaatttgtcttgttatggcaagttgtgttttcagtggcaactttttttagggcctaacgtaaagtttgatcagaagtttgacgtgtaatcccagcactttgggaggccaaagccagagaggatcacttaaggccaagaatttgagaccagcctgagcaacatagcaagacctcatctctgcaaaaaaaaattaacatattagctgagtgaggtggtacatgcctggagtcctagctatagttcaaggctgcagtgagctatggtcgtgccactctactctagcctgggcaatagagcaacaccttgtctcaaaaaaaagtttgagctatgtatgtttgaagggcttgtgttctcaaattggtgagaaaagggtggcgatttgatactatttatgaaccagacactgtgttttatatatattctcttttattcttgtgtcatatattcttatgtcacctgaatgaggtatcagtcccattttacagggtgaagagactgaaatgaagtaatttgccaagcttgtgttcaacaaacgtagaagtggcagtggagcctagatcattcttgtttgtttgtttttcatttttgttttaaaagctgagcatgcttctcttcaaactttatgattaccttgtagtgcacgttaaaactaatagctcaggttgtctgtgaccccaaagacaataaagacaggatctcattctgtggcccagactggagtgaagtggcaggatcatggcttactgcagctttgaactcctgggctcaagcagtccttcccctttagcctcccgagtagctgggactacaggcatgtaccaccatgcctggctaatttttaaaagtttttgtagagatggggtcaagctatgttgctcaggctggtctccaactcttggccacaagtgatcctttgcctcagcctcccaacgtgctgggattacaggtgtgagacactgtggcctttttcagttttcaagctgctgtttgttgttacattttaaaaatgtgaagttaaagtcagatctctgtgtgtgtttgtgtgtttgtgtgtgtgtgtgtgtgtgtgtgtgtgtgtgtttcttgagatggagtctcgctttatccccaggctgagtgcagtggcgcaatcttggctcactgcaacctccacctcccaggttcaagcgattcttctgcttcagcctcccgagtagctgggactacaggtgcgtgccaccgtgcctggctaattttttgtatttttaggagagacagggtttcaccatgttggccaggatggtcttgctctcttgacctcgtgatctgcccgccttggcctcccaaagcgctgggattacaggtgtgagctaccgcgcctggcccagatcttaatgtgttcttgctctgcgtggtgtttgtacctgggctggtgctttgggagagaagttgcattgtatggttgtccaaggacttccaagaagacagtaaaagaaaattaagatttattataaattagaatgtgaactatagagaattgacccatagtgctatgtttgagtcataataactgactagtgtttacaaagacttattcacacagagtagctattcattcagaagtgttgaagataaaaagactgtactaaatgacctcttggtccctttattgttactattctgtgatttattgagaattatgtgtatatttaaactcattccatgatgtgcagtgttaactttttagttacttttcttattggataaaattagtcagcatctgtgctttttttcatttggagggattttttttgtttttttttttgtttttttttttgagatggagtctcgctctgtcaccaggctggagtgcagtggtgcgatcttggcccactgcagcctccgcctcctgggttcaaggaattctgcctcagcctcctcagtagctgggactacaggtgcacgccaccacgcccagctaatttttgtattcttagtagagacagggtttcaccatgttggccaggatggtctcattctcctgaggtagtgatgtgcctgcctcggcctcccaaagtgctgggattacaggtgtgagccaccgcgcccagcctggaatttttaagtagctaaagaattagatttgtttttatgtgaaagatatgattttgtcatagagttaggcacttgtgttactttggaccaaacgtagtctgctagaattttgagatagagctagatatgatctaccatggaacataattcagctatgtaatttcttaagtactagtatattatgaactgggaagcatttgaagagaaacagtgaaagcaaagctcctggtatttttcatgaaatgacaagtggtaaatagtatctattaaaattcactgtagttgctcagtgaaacacatcaatagctacatggtagctatttaagaaaaataacttaccacagactcaggaaactttacagtgtttgacttccaacagtttacagtatttatcatctgtgtttgtttgctgttcagatatggtagattcgtcatattaaacacaagcttcatgcggtaaatgtgactctaaaacataatccaaaactttggcagtggatgccttgttactttagaaagactttaaacctcactttgtatttagtgctctagctatcaaatctataagtagtagctgagtcctggttacttaaatgatttaaatgatgatattctcacctaaaagggctcatttaccaacctaagcaatttcacctttttgcttataattagggttaaattgtgcttaaactgtttacttgacctgtgggaaaccagaagaaggctactcccttatactactgaatgtttagaattttaatacctgtgattgtggtttgatgttttagttttaaaaggcattgaaaatcttgaaatttatgtaaaattctctttttaaattttttattattaatttttttttcgtcttttcctttttctttctttttttctgagacggagtctcaccctgtcacccaggctagagtgcagtggcgccatcttggctcactgcaacctccacctcccgggttcaagcagttctcctgcctcagccttccgagtagctgggattacaggcatgccatcacgcctggctaatttttatattttcagtagagacaggctttcaccatgttggccaggctggcctcaaactcctgacctcaactgatccacctgcctcagcctgccaaagtgctgggattacaggtgtgagccaccgtgcccggccaatgatcttttttttttttttttttaaagtcattcgtagaaattggaaggaaatatctatcgtgctaacattcattagagtttaagattatgaatgacttattaaaatataaaatgataaggacagtacatgtaaactctagaacgaattttaaattcttagtaatactggtaatagttattaatacaggtatgacttctctctcgtgctgtttctggtgaacaccaccacagggtcacagtaaggttctaaaaatatgagcaaaagctggtactaccaggaaattcaaattccatacctgggaatctcagaactcagggaggaataaacattacagggggagcaaacaataatggggagtattgtttgagaaataagaaattaagaattttactgctctaaaatgtaaaagtaaaacaggtgaagtctggattttcttttgtttttatgaagttcagtgggagagcattctcttctgttaaaattgccactaattatgtgttttttctaaatcatattgtctgcttttctccaaaacagttgaataatgtactcattttcataaaattttagaaaaattagtgagtaaatttttggcagttattttatttgacatgtgagtggtatttgccttcagatttcgaattccctgttgggaaagtaatatggttatgttgctgtgactataatattaaaatgcacagacacactataaattccctttcccttaattttctttgcctttcttttctttcttttcttttctgttttttttttttcttttttttttttgagacatagtttcactttgtagcccgggctggagtgcagtggcacgatctgggctcactgcaacctctgcctcctgagttcaagtgattctcctgtctcagcctcctgagtagctggaattacaggtgcgcgccgcacctggctaatctttgtatttttagtagagacagggtttcgccatgttggccaggctggtcttgaattcttgacctcaagtgatccacctgcctcaccctcccaaagtgctgggattacaggcgtgagccaccgcgcctggctcctttcccttaattttctgaaagaaaaattcacatacagccgtgtgaattgactggactgtgaaattaaaataatggatttttttggtctttatactgcaagtttgagaaataaagaacaaagcattttctctgtggatgcgaagaactctgtacttgactcagcttcctttttctcttgcctgcattttttgtttacttcactggcttgattagtcataataaggctcagtacctctgccattcccaatgttaagcaattttttaaaatttggaattttgtggataatcattaacagagttgcttaatgggtaatgttgttttctttatggaaataatttgaggcaccttttctggggttcttggcaagaaatatgagtttattatggatatttaggaaagaggatgtagaaataaacctttgtttgtagtatgaagctgtgataatctgccccatctttgtctaattccgttttaacttctgtccttaacatgtttctcttcttaatcagttgtcagtgaagatttatttatcaggagatgggaatggagtattttggatatacttcaagttttgaatgataaccgttaaaatacatacaatgttttaatagtgagatacactgatcacaaaaatatggtctgatttaactttattttgtggtacttttcttctaagtttagacagatgatagaaattcacaaaaatttcagtcatagttatggccacagttaggcattcccaaaggaagtgtgttgcattcctaagtgtagtgtgttgcatgcactactgagcataatgggaaaagaaaagtgctataaaaacctaagtaccaagtaactagctagaaaaagcttttaatgggagagctggcatggtcattaatctggtagaatagtatttgaggaaacagttgcatgtgttaagctgcagtttcttttggttattgaaaaccaaataggaaattctgaattaatacttacatgctgaagtatctttgtggagcttattttgagcgttagagtgggagacttagttctaatgcaaactatagaagaatgaccttgggtaagtttgttgtctaattagtaaactgagtggtagagttggataatcctgtcagctttaggcccatgccttaaatatgcttcttatcctctcacagtcaaaaaggatttttaccttggtacagtctgattcctgcaacacctctctagttattgaatgtatagtagtttgctatagacagactactttgcagtggctatcaaacctttctgagactcattctaagaaatacatttacattgtgacttagtatatgcacacataaaaagaagaaagtttcacaaaatagtttccttactagcaatgagctgttttttgttttatttcgttaacaacaacaacaacaacaacaaaaactgctaaccatctttttcttggggttgcactactgtccaatgagcacatagtgagggcagtactgctaacgcctacataacatgcctgcatcatctagagctttgctttaccttggtacaatttttggaagaatgaaaaactgcttttccacagggggaaaatactgtttactgcccatctttgaaaaacattttacttagagcataaacttgaagctagatccttttaaccacttaattaaatcatacagtaagttgttgatagctatttgccacaaaatgaaaatatagtggctatatgaattttagctgctgtcactgttcattaatcataacataagctctgaacacagtgtttcttcttagaaaggtacaaatgattatgattttgtataacaactgaagttaggtgtgtgtgaagttttataattgctggtcttcattagataaattaaattataattaaatgatctgttttatttttgctttttatttggtctcttattaataggcacaatactggcattagctataacacaaaccaatggcactaaaaatcttcagaacctttttggatttgagtttttgaaagatattttgtggagactacagatttaattttaaagtataaatatgctcttattttaaataaatggggtttatactttgtgttctaatgattgagataacttttttttttgagaacttaaattaaaattcccagtcttctctagttctgtcagatttctttgttccccctcccagtggttgagttcttatgggatttgtggcttatttttaaaatccaatgattaaaatgaagttttctggcaatattaatatttgtgtgaatctggatatcctcctcacttaacttctaaggctttttcttcatctgaaaatgacaattttgtatacttggctggattattttaagtaacaagtaacaaacactgtggtagactaacatttgagtttgaagtttcatataattttaaatcattgtcatcgactgactttggaaagtaacttctgagatttttggtctgaagtgaccctgaaagtttatgacctaattatcattttattaggtctgaatgtgaatgttgcactttgagaggaaatagtatagaagtagttacattgctgggtgactgatctagcaagtccctaacagtgccattaagctgtcctgtagtacatcttatttagttctctcaataactacatagtatgttgtcagtcctattttatagatgagaaaaccaagggaacaatttgatagaataatgtttccaaaatcagagatctaatcttagaaggcttagttgaataacattggatatattactctgcggttcctaagtctatgaattaatgggaattttgaaatctaattgaaatccaaggagaaagtgatagaaataaaattgtagtgagcgatgtcggctcactgcaacctccacctcccaggtttaagcgattctcctgccttggccttccgagcagctaggattacaggcatgcaccaccacgcccagctaatttttatatttttatagagacggggttttaccatgttggccaggctgatctcgaactcctgacctgaagtgatccacctgcctcagcctcccaaagtgctgggattacagacatgagccactgcgcccaacctagtttaaattttctagtagccacatttaaaaaaaaacaggtggaattaatttcatgaatatgtttcatataacccaatatatatccaaacatagtttctttttttttttctgagacagggtcttgccctgtcacccaggctggagtgcagtgagtggtgcacgattatggctcactgcagcttcgaactcctgggcttaagcgatcctccagccttagctttccaagtagctgggactacaagcacgtgccaccacaccctgctaatgtttaaatttttttgtagagacgggggtagggtgggtctcactatgttacccacactggtctcgaactcctggcctcaagtgaacctcctgcctcagcctcccaaagtgctgagattataagtgtgagccaccatcctggcctaaatatctttcagcatataatcagtataaaaattataaagatagtatatattcttttctattacatcttcaaaatctgctgtgtgttttacacttaacatatctcggttcacaccagcaacatttcagtgaagtactcaataaccatacttggggctgggcgtggtgacacatacatgcctgaatcccagcactttgggaggctgaggtgggaggattgcttgagcccaggagtttgagaccaggctaggcaacaaaccaagatgctgtctccaccaaaaaaaaaacaaaacaaaaattatccaggcacagtggcatgtgcctgtagtcccagctacctcggaggctgaggtgggaggattgcttgagcccaggagtttgagaccaggctaggcaacaaaccaagatgctgtctccaccaaaaaaaaaaaaaaattatccaggcacagcggcatgtgcctgtagtcccagctacctgggaggctgaggtgggaggattgcttgagcccaggagtttgagaccaggctaggcaacaaaccaagatgctgtctccaccaaaaaaaaaaaaaaaattatccaggcacagcggcatgtgcctgtagtcccagctacctgggaggctgaggtgggaggattgcttgagcccaggagtttgagaccaggctaggcaacaaaccaagatgctgtctccaccaaaaaaaaaaaaaaaaaaaaaaaaaaattatccaggcacagcggcatgtgcctgtagtcccagctactggggaggctgaggtgggaggattgcttgagcccaggagtttgagaccaggctaggcaacaaaccaagatgctgtctccaccaaaaaaaaaaaaaagtatccaggcacagtggcatgtgcctgtagtcccagctacctgggaggctgaggtgggaggattgcttgagcccaggagttttgagaccacagtgagccatgattgtgcccctgtgctccaacctgggtatcagagcaagactcccatctctaaagaaattgtattttatttattttatttttacaacccagatgtgtgaatcttgaaggaatttttttttaattggctaatggctactattactggacagctcaatttctgaatgccaagtacctcttgttaaactgttcaacagcctttccctaccatctcaagaagttggtgataaaaattatcaataatgaattacagttttttaatttttgcctttgatgtgattgtcttattttataatatgttagcatttaatatgaatatttttgttgacatttattttttatttttaaaaatagcattattgaagtatagttgacataataaaatgtacatatttaaaaggtacaaatttaataagttgtccacatccatgaaaccatcaccacagtcaagatatttattactattttcctgaagtcttccctcctagctgtgcaaatctcctgtcactacattaaaacttttagatattcttcttttttggagataacctctcttaaacttctaaacttcaccatttgtactggttgcattctaggttgatgcttaggttggggatcttcattcattctcattttggagattcttcttatatctagctggtttttgatcctgcttccagaatcccatttctttctctttcttggtctcctcatttgtgaaagaataacttcataactctttgagaaaggtcatttgggagataaatgtatttttgagaacttacatgtctgaaaatattttccttcatcttcctttccctttcctctttaataggtagttcggataacaaattctagattggaaataatttatttcagaattttaaagacatttattctattttcttctagcttccagtattgctgttaaagtctgaggctagtaggattctctgttccctgtaacctattgtttttttcctctggaagttttcaggttttttgtcttgtcctcagcgttttgaaatttcagcaatgtgccttggtatgggtctcttttttccattgtggctttttgtctggaaactcactggccatcaattctgaaaatttaccttctactcatttcatttcttgccctctgttttttatgttgccccttccagaactcctgttacatatatgttggttctcctagaccaatggtctaacgtccatatcattttctcccccccccccaccccctcgaagtggagtcttgctctgtcacccagagctggagtgcaatggtgtgatcttggctcactgcagcctccacctcccaggttcaagcagttctgcctcagcctcccgagtagctgggattacaggcacccgccaccacgcccagctaattttttgtatttttagtagagacggggtttcaccgtgttcgccagggtgatctggatctcctgacctcgtgatccacccgcctcagcctcccaaagtgctgggattacaagcgtgagccaccacatgaccctgccttttccaggttcctttttttggttgttgttatttgttactgattttagttgctctttaattttatttatttatttttttgcttcccatgtagattggatgctctttaaagacttttttcaagtaatcccatgagccttggttgtcgcatttgagttgggcactgaaaactgataaataaatgcggtttgctgattgtgggccccagtataatctgactgtactgttctggcatcttatgaaatgcagatgttgggatctttagagctgttcatttatgctactcagatccctagttttatatgccaaagtataacttatgctttatgtgatttccactttagagattttattaaaactttttatttatagtctaatgtatgctgttgtaaaaattgaagttctatgtttatttgaaaatagtatttattaagggaaaaaatctgtatttgttaattgtattgcttaaattccatgtatttttgttgccttagactacttgattagctgatatttgataaacgtgtcagccctacaaaataattgtggatttgtcaatttccgtttgtatttctaacagtttttatgttatatattcatagctttatatttaggctgggttaagcatgaatgttatatacgtaaataattgtactttttatcaatataaaatatgcagcattttctcaaataattctctttgcttaacacattccctttttatattgtcattcttttttcacatttgttttatttgttcctctatcttccctttttttttttttttgagacagaatttcactcttgttgcccaggctggagtgcagtggcacaatcttggctcactgcaacttctgcctcatgggtttaagtgattctcctgcctcagtttcctgagtaactgagattataggctcctgccaccaggcctggctaatttttgcattttagtagcgacagggtttcatcatgttggtcaggctggtgtcgaactccttacctcaggtgatccacccaccttggcctcccaaagtgctgggattaccagtgtgagccactgtgcctggccctttatcttcttttttatgtcattttaattttgatgtgtttcttataaataaacagtgtttagacttttttttaaagcctgttccacaggttttttgtaatagagaactttaacgtacatttatagtaataattggtatgtttggagttggtcttcttcctgccttctatgtgttttaattggtatgtttggagttggtcttcttcctgccttctatgtgttttatttctgccttgcctttcttagatagatttattttctttgcattttacacctagtagtctatcttttatgtaattttcattatttaagtgacttaaatgaaattatgtatttttcattgttaatttttaaaacacctacatattagactataaatctactttataaaaataaaattatttctctacttttataggtggtattgtggaatggcaaagcacagactctagaacaaggcagcttctgtttacaccttggcttggctttgccacttttttattgtaatcctcttgtgcatccatttcttttttggttaaagtagagatggggtctcactgttgctgatctgaaactctgggctcaagtgatcctcctgcctcagcctcccaaagtgctaggatttcaggcgtgagccaccaagcccacgtaggtacctacttcacagaggtgttgttgagtttaaatatgttaatatatgtaaagcaccagaacagggtctggaagtcaataaatgttagctattattaggtgtcagttattaacaaaagcttgaaactacattattagcgtagttcttgtgggttcctgtgtttaatgcttgcctggttcttaacctatattagctttctgtgtgtttaaaaaaaatctttatcttttgtgtaagtcggttttccttattcttacacactttaatgtatgtaggctgctctgttgtaaagaccatctgtcttctgctgggctgaggacctctgtgcatttccactctttgaccatctcaggacaggcacaacaaaaaaatgttaaaaacttagatgttgtcatggatatgtggatgctttacattgtgtgtgtgtgcgtgtgtgtgtaattttagtgtgaaaaatggtatcaggtttctccaaggcaacaaaaccattaggagattttgtatataacagatagatattatatgtaatttcaaggaattagtttacttggttgttggggctggcaagtctgaaatctgtcttctggttgagctggccattgggttgggaactctagcacaggagctgatgctgcacctttagccaggatttctcaggaaatcccagtttactgccttgtaagtgattagatgagacccaaccacataattgagggtagtctcctttacataaagtcagctgattgtaggtttaaccatatctacaaaaatacctttatagcaacacctagttagtatttgatagaataattgaatactgtggcaaaattgtaacataaaactaaccatcacagatgagtatattatttcacaatagattgtccttcatatcagcttcttgaaattaaaaaaaaagctactgtgtgtaatactatatggaaattaaacattgtccatatttttagtaaaataataattcatagttatactctgctaacatgagatcaacttatgcactaatggaccatatttctaaaagtttgtgagttgtttgttgacttaagtgagaaaggcctgtaatgccagtaccggaaatgattgttcccagaataaccagcaaaagctgatacccagacagtatatctgaaatatgttacatatgaaaaatatatttaaaaatgaaagtgagaggaccgggtgaggtggctcacgcctgtaatcctagcactttgggaggccgaggcaagtggatcacaaagtcaggtgtttgagacaagcctggccaaaatggtgaaaccccgtctctactaagaatataaaaattagccgggcgtggtggcagttgcctgtaatcccagctacccaggaggctgagggaggagaattgcttgaacccaggaggcggaggttgcagtgagccgagatcgtgccactacactccagtctgggtgacagagcaagactctgtctcgggggggaaaaagaaaggtaagtgagcaaacatctgtttggtgccagtaatattaatagtttagactttaacctttgcttataacagtttttgtgggaaggtttattagttggttctcaaatgtgaaggccacatgcttccttcaattaaggcataataatgaaaggacatactgaggctacattacatctttgttggtgaaatcaggagtagaggaaagggtagaaactagaacagatacagattgggaagtggagaggtaagattcttagcccataattttcagagaaagtagttgtttgttgatggcaccaaacagggctcctgatttatgataaagaatcatacatttggtaaaagttacagtctgaagtacaaaaccccaatgattttccattctagtgcttcagtgagaagcttaacagtgtactatgtataggtagataagaataaagtaaaagacagaattctttgctgttaaaatgaaagaataacttttacttagcatagtatggtagtatactaataaatggtacacactgctagtcataaaatttagattttgtccccagttctacctgtatacctgtattattagtcctttgttctctgttcagtgtcctagtagaaactgtgtggttatactccttttttttttttttttttttgagacagagtctcgctctgtcactcagactggaatgcagtgattcaatactcactgcagcctcaaactcctgggctcaagcagtcctcccactgagtagctgagactacaggtgtatgccaccaaacgccaggctaagttttttaaagaacttctgaaagcatagagttttcaggatgtttttataatatttcatagatggtaaggcagtgtcagattgattcagttatgtcatcaaatgtctctctgccattctcagcatgtatttcaggctaatgccccttatggccctattttcagccatcacatgcatcctggatagcattcagcagcagaagcagcaatttctttaacaatgcttcatatcttactggtcagagttgtgggtcacatggctttgtctagatcaaatactgaaaatggaacttccatgattgggttaggccagttatgactgtcttgacaggagatggggcttgcttttcctctagtacaagatagatacttaaaccaaataaaggattatggttagcaaggaggagggggtttgggaatgacccagtagtagactgccaacagtgcctgctacttaactcactcttgcgagatggggaagtaagatagtcttgagggttggggctatagtagaatagaaggaaatgactttttggagaaagtgatttctttttatcttttcatgtttttattttttattacattttgttttttacttagggatggggtcttgctatgttgaccaagctgatctcaaactcctggcctcaagccatcctgtcatctcggcctcccaaaatggtgggattacaggcatgagtcaccgtgccacatctggagaaagtggtctgtaaactaagttttgtggacaaatggagattattagggagaaagacttttccttatccttctgagcccttggttgtctatgggtactgttgcttgttttcatttttaaggatagtaaacatacttaacatttcccaaggaatctgtcttgacctgtgtatgtgtgtgtaaaagctgcattgtggactttttgaaaaagaacatataataaccagttcagttgaatgcaacgtgctctgtgagattaagggctcacaagaaactgctaatcacagttttaaaaagacaatcttttgatgtctcatatcttagtgttactatgagtttatagcctgttattttgtttagtgtttactctgtcttgcctttcttttttccttccttcctttccttttctttcttttcttttggaagggaacttaagtacatcttctggttctttctgcctgatctcttcctcttaattttagaaatgaagatgtagaagtccaaagaggatttacttgatgatttgactagaaaagctaggtttaaccaggtcttctatggaaatgaattatagctgtagtgaaaaaataagggaaatgtgctatgtttggattctagagacagttctctagaatagaaaatcttctaaacccaagacagcttgatatttgaaaaagggggtataaaacctttttttaaggattggcagatcgtagtaaatattgtggatgtcatagtaccacaatatataataattaagtaacatacttagaatagaaatctagaaatgtcagtaacagaattttactatttctctcaccacacacacacacacacacacacacacacacatacacaaaattatgaacacataataaaggacttccttataactaagaaaaagataatacatgaatagagaggcctatctggaaattttcatgtatatgcacaacatttcagtgataacagagtggctgttataaataatgatcgtaaagtgcggttataaattatatcatgtatgtgaaaattattttttgtacagtatggttctttatctaaaacgtagatctttgcttttctataataacattctcttctaggtttcagcttatacttgacgcaagaggttctttgagagagcttcttttttaaaaaaaaaaaaactacatttcctattacattttatatctagcctgccaccctaagatggaaatccattttagttcatcaggtatttattaatggtttcactttgtgaaagatattgaagagggcagataaaattgtcatttacagcttacttagcatagtacattgtgcttaaaatatatgacattaatataaatgatgccctttcttgataattttttttatctctaatcttaaattgggggatgatgtttctttttagcctttttatttttatacatatggttgtccaagagtcatgtattaacccaggtttagaacacatcataatgtcactgcctccacttcccagactccaatagggaatagcagctttattctacccaggtcctatcagagggtgcacaacagatgaggggaattgcaggatttcccagtacaccaaactgttggtcagccttcctgcctttattccccatgtagacctaaatacagaaactttttaattatcttggttatacctaaacattgctactcccctacgctagccccgcaaaagtgagagagcttgtcaaggcaaagttttttgaaggaagaagccacatgaaatgagagagggaaataatgtatactgtgagcttaggaagagcaaaggtataaaggtgatagagagattggcacagaactacagtagtatatgtattagttctgattaataaatgtttcaatttttatgatactgttattcttttttttttttttttttttttgaggcggagtctcactgtgtcacccaggctggagcgcagtggtgcaatctcggctcactgcagcctccgcttcccagcctcaagtgattctccctgcctcagcctcctgagtagctgggactacaggcacccgccaccacgcccagctaatttttttgtacttttagtagatgtggggtttcaccatgttggccagcctggtctagaactcctgacctcgtgatccgcccacctcagcctcccaaagtgctgggattacaggtatgagtcaccacgcccggctgatactgttattcttgtaacaaaaaagcttacaatgaggaatacatttatattgttttgcttaagattaaagccatataaaaaatttacagcagaacctggaagttctttcttgaccctaacctcctttactcctttgcccagaggcaaccatatatttgtatgtatttccaattcttcatgcttttacacaaatatgtactcacattaaaaaaaatatatataaacatattattctatgactttttttttctttaattcatagagttcttaatcaggtctagtgaactcaggacaagagacacaacttggatataaatacctttaagcctctgttttcttcatgtgtaaaatgagggtaatgttttagtgttattacaaggtttaaatgagactacatgtggacaccttagcctggtaactaagtcacggtagctgctattattaataaacaaggctaacatgcttctatatgatcctcctgtacctaagaaataaacttatagcaatagagcacaatcagccagccatttaattttagagaataacatcttcatgtggcctagtaaaaatgactgttaccaaataataggctttttatgatgaatgaatgagtcagatgttttctctgtagtttttagaatcattgagataccaaattcttagctgttttatggaagaactttataaagtagagtttactgaagttgggtgactagaaaagcctataaagttaaaaaggagaaaacgtgttggttctcctaattaatgtaaattaaaacaaggagactgcccacaagagctaaatagtaaatttcggtcaaaaataatgatagtatttcttttttcaattggtagtaaaacattggaaataattattccaaatgaaaagacaggttgataacagttttcaaaaggatcaggataatagagattcatattgggtgacggtatggttttagaactgtcttccctattcttcctaaatgaagtgggccatttcttctcactatatgtatattcttgtctggccctgagacagaacactggattagaagcactataggttgactaaatatggcagttcttaaatctatatgatgatagtttgcattattttattgttaacttaccatttgcatttttataaacagctttattgagataattcacatactatacaattcacttggttaaaatatacaattcagtggtttttaaagtatattcagaattgtgcaaccatcacagtactaagttttagaacattttaatcacttcctccaaaaaaaaagaaaactccatttcccctcaactcttccagttgtgtggataaccactaacctactatgtctctagatttgcctattctggacattttatataagtggaaccatataatatgtgatctcttgtgactggcttttttcactcagtgtaatgtttttaatgttcatccatgttatagcatggatcagcacttcatttttatggttgagtaattaatatttgattgtatggagataccattgtgtttattcatcagttgattgacatttgtgttgtttcccgttttgggttattatgaataatgctgctataaacgttcatttataaggttttatattaacatatacttgaatttctcttgagcagatagtaaagagtgaaattgctgggttatatggtaattctgttgaaccttttaaggaactgcaaacctgtttttcaaggtgactaccattttacattctctacagcagcgaatgagggttccaatttctttacatcttcatctgcgctaataaggttaagcataatgttagctgtggggttttcctagatgccctttatccaactgaagatgttcctttttcctagttggttgaatttttttttttttttaaatgaaagggtgttggacttcggtgctttttctgtgtctatggagataatcgtatgggctttgtactgtatggggtgtactacactaatttttggatgctaaaccttggattcctgggataaatcccatgtggccatgggaaataatcctttttagttgctggatttggtttgtttgtattttggtgaggatttttgtgtttgtattaataaggaatattcttcttttaaaatatttatgtattcatttattagagacagtcttgctctgtcatcttggctggagtgcagaggcacaatcatggctcactgtaacctcaaactcctgagctcaagcagttctcccacctctgtctcccaagtagctaagactatgggtgcgtatcatcgtgcctggctaatttttttaaaaaattgtgtagagatgtggtcttgctgtgttgcccaagctggtcttgttctaacctcaagtgatcctcctgccttggcctcctgaagagctaggattacagtcatgagctaccatgcctggccaagatactgtcctttagtttccttgtgatgtttctatctggcattggtgttaggttaatactggcctcatagaattcctcttatattttttggaagaatttgtgaataattgatgtcaattatttaagtgttttatagaactcatcagtgaagtgatctgggcctgggcttttcattgtggaaagtttgttaaattactaattcagtctcctttcttgttataggtctattcagattttccgttgttttttttttttttttcttgagtcagtttctgatatggtttggctctgtatccccccacccaagtctcactttgaaatgtaataatcttcatgtgtcagtggcggggccagctggaggtaattgaatcatgggggccgtttcctccatactgttctcatgatagtgaataagtctcagagatctgatggtttgataaggggaaactgttttgcttggttggttctcattctctgtctgccaccattgatgtaagacatgacttgctcctccttgccttctgccacgattctgaggcctccccagccacatagaactgtgagtacagttaaacccagtcttggatatgtctttatcagcagcatgaaaactgactaatacagtttctatagttcgtgtctttctaggaatttctttccattttatctagatcatctactctcttgctatacagtttcttgaagtttgcccattataatattgatactgttgcttactgttttctctttgttcctttaaagaaaaaaatttttatgctttgggggtcatttaacatttctctttttatccattggcttaacaagtatcttcttttctccttcttctttttgagacagagtcacactctgtcacccaggccagagtgcactggtgcaaatctcagctgactgcaacctctgcctcccgggttcaagtgaccttcccaccgcagcctcttgagtagccctccaccatgcccagctaatttttgtatgcgtttgtagagacagggtttcaccatgttgtccaggctggtcttgaattcctgagctcaggtgatctgcccttcctggcctcccaaagtgttgggattacagacgtgagccaccactcctgaccatgtatcttatttttaattttttttagtggttgctcttgtgcttataatatacattttaaattaatctgccttcaaataatattctacccttcaagattagtataaggaccttgtaacagtatattcttaattcctttattccatctgttgtgctacttgtcatgtatttttctgaagtataggaaccagagaaattataaggcagaggagtaggaaacacatactttcctgtattacgcaataaggagcttgataattggaaagggaaagggaaatgaatatatgagaaattcagaaagaatataatcagaattcttaatgaaatttgaaacctcaggtgatccacccaccttggcctcccaaagtgctgggattacaggcatgagccactgcgcccagctgaaatctcaaattgaagttgaatgatcaatttgggataacttaaatttctttgtggctatagacagatctatttcaagaagtctccctacctaaccatttttcctgcccctaaaaaacaaaaccagaaagttctgagaatcatcctagacttctcttcctcctttatatcttcattttccatttctaatcagccaccttgtcatcttgattctccctcatctgtaccaatatatcaaccaaaaatgatcttcctaagtctaattacacttctctctgttccacaccaatgcaagcatgatcaatcttatgaagatgcaaatctgatcacatcttttaaaattttcggtggtgccctattctccacagtataaattttaatctccttattgttatgtgaagttctcaagattttagtgtttatccaatcttctctcctaccatctcttctaaaattatataaacaattcccagactttattttaagttactatacatatgctgattttcatttccacacccacgttcttctttttgcattcctattaaattcatattcatgaaaataaataaatgtttctttaaagaatcctctcagaaattaatctcttttttgtctccttgttgtacttatacgctcttctcataatgattgtgtcattcttactgtgattactgtgttctttaaggctgtagctataattgttggatggatattgtgttcaataaagattggcagaatttagctagagtttagtaacatttttatgattaccttctatataagagaaacatcagattagtggttttgaatcagtattgtaatgtaaaatttctttataccaataaatttaagttttataaaaaggtagattttgggggaatgttagattttcaaatgatcgtaataatacagcagcaatcctaatgatagtatgcaaattatcggcgttcagttggtgtcaatttcaactttaggtattctacctatgccatacttttatttattattgcatcaaatgcagacaggttctactctctactttgtaagatgaccataatactctcactctcttaaaatcactatctggccaggcggctgtggctcacacctgtaatcccagcactttcggaggccgaggcaggtggatcactggaggtcaagagttcgagacgagcctggccaacaccgtgaaacccccatctttactgaaaatacaaaaaaattagccgggcatggtggcgggcgcctgtaatctcagctactcaggaggctgagacaggataatcgcttgaacccgggaagtggaggttgcagtgagccgagatcgcaccactgcactccagcctgggtgacagagtgagactctgtctcaaaaaaaaaaaaaaaaaatcactgtctaacctctattctatgtattttacattgtgaagatgagtaatattaatatctgccttctgtcttttaaaaatgtctaaaagtgaaaatcaattgtgtctggctgacatttctctaaggtaactagttatggatagagctcctttttatacttccttgttctgcttcctggttttcctgtcatttcaaattgccttggtttttttcttattgcattttctttttttttttgtttttgagacggagtctggctctgtcgcccaggctggagtgcagtggcccgatctcggctcactgcaacctccgcctcccgggttcacgccattctcccacctcagcctcctgaatagctgggactacaggcaccctccaccacgcccggctaattttttatattttttagtagagacggagtttcactgtgttagccaggatggtctcgatctcctgacctcgtgatctgcccgcctcggcctcccaaagtgctgggatgacaggcgtgagccaccaagcccagccttactattgcattttcaaagttttcattttcccatccagtatatcgagtcttctgccttcctagggaattcttcagacttttctatcctgctgatctgaacttactgctttctgagtatgctgcacaactgtcttttttttcctttaattgtgttcctctttttaataaattatttaaaaatctatgaatacatatttaagtgtcttgctagtaagaaaatatgcatgtataataaactttgcctccacatatgaacatacttttcctttttaaaaaaatctggttttgtttaggattctgtttatttcattttcctccttgacactcgtggtatttctccccatctcctagatatttttttggttttggaaacttctcttaatttttactttttctctaccatctattgtacggggatgttaaatagacccttgtaaatatgtttttctgttttgggaagtgttctaattcttggataattttcactccttcatttttccctattctcttttttgggggggcatatatttatatgttggaattcttgtaacaaccttccccccgtccccaactacttgcctgatattttaggttgacattattttgcaagctttcattgaatttctgttttggtgagcatgtcttttttgagacagagtcttgctctgttgcccaggctggagtgcagtggcgcaatttcagcttacagcagcctcaacctcctgggctcaagcaatcctcccacctcacctcctgagtagctgagacctcaggcgtgcaccaccatgtctgtctaatttttgtattttttttttttttgtagagatggggttttaccctgtttcccaggctgcccatgaactcctgagctcaagcaatctggctgccttggcctcccaaagtgctgggattacaggcatgagccaccgcacccggcctgcatgtctgtcattttaagagtttcttctgattttctcacccctaatcattttctcttcttgctttatattacagtatttttatgccttctctaaagtaaaagatttcttttaaaattataaaagtagattgggcagggtggcttacaccttgtaatcgcagcattttaggaggctgaaacaggaggatagcttgagaccaagaattcagggccaacctgggcaacatagtgagaccctgacattacaaaaagtttttatttatttattttttgagacggaatcttgctgttgcccaggctggagtgcagtggcacaatctcggcttgttgcaacctctgcctcccgggttcaaatgattctcctgctttagcctcccaagtagctgggattacaggtgcatgccaccacacgtgcctactttttgtatttttagtagagacggggtttcaccatgttggccaggctgttctcaagctcctgacctcaagtgatccacctgcctcggcctcccaaagtgctgggattacaccgcgcttgtcctacaaaaatttttaaagaaagttaattaggcacagtggtgcgcacccatagtcccagctacttgggaggctgagacggtaggattgcttgagcctgggaggttaaggctgcaatggtctaggactggactactgcactccagtctgggcaacagagtaagaccctctgtcaaaaaaaaattttttttaaactgaatatttatttggactgaaagaagaaatgacaacaaattataaagttaaaagaagtcatatcaaaaaatcacaaaatccagaaaaaaacatttattaagtaccagacacatcctacttttgcttttccttcattttttggcttcatcttctttgatcacctttttatttggcagtgagtttataatactttatatatagaaaataaaaagatcatatagctttcctctagcattcaggtttttttgctatatgggtgttaataatttttattttaattgcctgctataattattttttattttggtaaaatatataacttaaaatttaccattttaaaaagtatattctatttcctgaattttttgtttctctgaggcaatttcccctttttgatgggaagagtgttttatctttgtgagttctcaagtgtgatgatctgtgggcctgctgatatttaagaatgaggcttaccattaggcaaactctgtatttagagtttgtctgtatttagagctcatagtaagcctcattacttgttaatggtcagacttcattctcaagtgaatggtcagggaacccccaaaataacagatggtaactggttttgttctgggatgttaatttgcactctaatggccctactagttgttttgatatctttagagtagaaccttaatttcctgcctacccaagggtaagcattgggtgatcattttgctgtgcgcacagaaggtgagaggcattgatttgtctgtcctacagattcttcgtttttaaaaatctcatgtctcatttctgctttactggatctcattggtttttggaggaaaggtattggttcctttctcaggtaccctccaactatattttaggctgttacttcttgggccagaatttcgccatttgtatctgctgatggctcctctctcatcctctttattgtttgcatttaatattttatttctgtaactttcttgagttatgttaatggaatctggagggaaagtgggtaacagtaaagtaagctgtttatactgtcattctgaattgtaagcccctgcagacttcttgaatgatattaatgaatgttgagtcacctttcaatatggagggacaagcctgttctttggtgtcacgtgtatcgctctttggttgtttgcttagcagcgttgaaaattgaggaggcagaggtgtatgtatgtatttggttcaggatagtatctcactagcaactcccaatataacctttttttctttgtgtgtgtgtgtgtgtgtgtgtgtgtgtgtgtgtgtgtgtagtggcacgatcacactcattgcagcctcaacctcctgggcttaagggatcctcccacctcagcctacccagtagctgggactacagccatgtgccaccatgcctgaccatttttttttttttttaagagacaaggtcttgctctgttgcccaggctggtcttgatctcctggcctcaagtggtcctcctgcctcggcctcccaaagtgctgggattataggtgtcaaccattgtgcccagcaaaccattcctattttcccactaaaattatcataaaatcaggaatgaatgaaagctccaatcattactacaaatgaaaattgacagatataaagacagaactctgggagtaagtggtactaatgatgaggcagattgaatcagagaaatacttatacatttcaatttgtacaatgtgtatttactttgttttttgagtgatgaccaccaggaggaaaaatccttgtctgtccccattgtttgttcaaaagtcagacctggagcccctgctaaccagaaaattgagcagtcatcaacttcccctcacagtttttctgcatgtaagaatattagtaaaattagggtgatggggaagagggctgtggaaatgggaaactgataatgtacatgtagtataattgggcattattatccaaaatatggtacatatacttctagaaatagtagatattttaggttgtacgtgaatgaacgttttaaagccccaaaatttcttttaataactaacagcaatactaattagttacgaggatgctaaaataggtagtaagtacctgttttatgatgttaaaaatatcaagtaaatattatagctggttattagttttggcataacattaatgacagaaacttgagaaacatttcctctagataaaaaagcttgctagaaactggcaacagtactgctttttacacgtatcacagttgtaaatatgagaagggagtttgacttccacttgtgtgtcagacagcggggtcataaacagtaggtttggaggatctatccttgttcagtatagaagttctattatgattgatatggaaatgactttgacttattgttgaagccctgatactaaacaaatctgatttcgtttgaatctttttttccctctagaagtaaaaaaggacaattaaaaaaaaaatcctttacttaattttcagtttcttctttgaataacaaagtttggaagtatagggggttggaactgatctcttgtcacagagtttaaaggttaagactggggaattttatttgtttctaaatgaaaatgttatgatttacataaatgaaactacagtgtgaagatggacagtaaatgagatagatatttttgaagcagcaactgattttctttttgtcagactctgcagccagcctgaggccacaaataaatgtagtcagaactagtttcataaagttagatggatatgttcaataaataagagacattttccatagtattcatattttgaacatgatgaacaagatttagccaaaaaatatgtgcatattcttatgactcagggacatcacacaaaaaagaaaaaagaataaaattgaagaaattaatgtgtgtattcttttttccctggattgataagcagcttctaaaagtatgctaattcaaaggttagttttatgtattgtaaactgtagttagataaataatggttactttgaaaatccacagtaaatgctgctgatttgacaaggaaatgtgtttagttgtactctaaggatggccttctttgttggggtacaaaattagttcatttttaaagatcataaacaaaatagcagaattgagcaatgtaagtacagaaataacatttatataaaaatcaaagtgcaaaacagtatagtatatcattcatgaataagtaatatgttgtaaaactataaaaatatacaatagcgtgataaataccatattccagatagtggctctggggatgtggagagaagaatagtggtattatttcatagaaaataatctaaaagaaatatggcggctgggcacagtggctcacgcctgtaatcccagcactttgggaggctgaggcgggtggatcacctgaggtcaggagttcgagactagcctggccaacatagtgaaaccctgtctactcccagctactcaggagactgaggcaggagaatcgcttgaacccaggaagcagatgttgcagtgagccgagattgtgccactgcactccagcctgtgtgacagagtgagactccatctcaaaaaataaaaataataaaaaaagaaatatggcaaaacattaagaagtgacaaatatcagagggacatatatatattccacatttctgtatgcttgaaaacatttatgtaaatttttctaatgtgtacagtgactttttaaaagtaatatgctaaaaccaatccattgagtgaaatgacaattggattaaattataacaacaatattaatgcagacaactctattttctagttacacttatcaagagattagtattgaattatttacttgctttgcaaataagaaaatgtaaaattttaaacttttctcttatttaaagacctaagatgaccaatagacactttttctcatgtacctcaagtccttaccaagtataagaagcagaacagtatctgtatcttcgaagctctcagtgtacttctccctagtaacatctccctgcctcccctgtcctgaattttacatttcattttattgtcttaagtgccaagggcaaggtttgtcaaaatcaagtaatgttcagcctttttggtagtgaaatatacataacataaatttaccattgtaaccatttacaagtaacttagaagtatacagttttgtggcattaagcacatttacaatgttgtgcaattactatcatccatatctagaactttttcagcatcccaaactgaaagttttttttttttttggcgcgatctcagctcactgcaacctatgcgtcccaggttcaagcgattctcctgcctcaccctcccgagtagctgagattacaggctcccgctgccacgcccagctaatttttgtatttttagtagaggtggggtttcaccatgttgaccatgctggtctcaaactccttacctcaggtgatccacctgccttggcctcccaaagtgttgggattacaggcgtgagccaccgtgcctggccccaaaccgaaactcttagctcttaaaaactgagtccccattgtcccctttccctggtccctggcaaccttttttctactttctgtctctgtgaatttgcatatgctagatgtacctcatgtaagtagactcagacattatttatccttttgtgtctggcttattttacctagcttaatgttctcaaggttcatttgagttgtaccatgtgtcaaaatttggtacatatttttatattttatatatataattaatattttataaatattatatatatataatataaaatataattaatattttaatattaaataatattcctttatatttatatattttgttttctgttcatttgttgatggacacttgggtcattgtaccctttgactattgtaaaaaatgctgctgttaacattggtgttcatgtatctgttggagtgcctgctttcagtttcttggggcatatacttagaagtgaagttgctgaattgtatggtaattctgtgttcaactttttgaggaactatcgtgctcttttccacattgtctataccattttacaatcacagcagtgcacgaggatttcactttgtccacatccttgccaacacttttttgcttccctactggccctttttttggggaggggcgggtaatagccatcctgattggtgtgaagtggtatcttactgctagacatgttttaaaggaaaaaaggacagttctttaatgtgacttaaattgttaaaacattgtatgtgtaaatggaaaaaatacatatacactccttgtgacttaatgatcttacacagctataacagcaaaaccaatttttagtgtaagtgctaattaaaacctactaaaattaatgtttttgacagtgcaaaccaaattgtggctgtcttcctttataaataacttagtcttatgtgagagtatctatttcagttacaaattataactgcagaaactttaactggtaaaagaattcagagtatatagttaggaaagtttgctgacattaggacgtgccaaactacctatagtcaaaattaattaacaaaattaatgattaatgtgtcaaacttataaattgtcatttaggttatcatttggttggtaatatgattcaaaaaacaaactgcctaatgaaatcttgtggtcacctacatgagccacaatatacatatatttatttttaattaattgtctaagttagaacccaaaattcttttttctgaaatttaaagaagaaaaaaaaattcttttcgccacctctgataatatcgatagtccaaaattaagaaaatgctaacttctcctgatgacttcttcaacagcctatttcagcctgtgaaacatattcaggaatacatatgggagaataaatcaatgtgaatggggtagctgccataaaaataatgttcttaatttgtgtaattattttcagttttcaaagcacacttacaatatgtcgagccctcagaataattcttagctattcaggaaagatggtgttttcattttacaggcaaggaaactaaaactcatggcagttactttagaaataggagtgcaaaagaagaaataagcatggcatgtgagaataacaagagtccttatctgtagtgggttgtttttggaaagtattgagaaataagctggatccaagggactttggaatttggatttgatgtaatggagcattttccaaacttgctggtcataagaaatcccttccttggagactggggccagggtcctagaatcctttcgtaacaagtgcccctgaagattcttgtacttcagcaaagttggttaattatgcatttactatttttgagcaaggagcttggtgtcataaaaatagtgtctgggggaatatctttatctaaagggtaggttgaagggtaaagagagtcatcaggcaatgtttattttgatatgacgtagttgtggcttttattagtttgtgaccatggaaatgagatatggggaatcatggaattatagagattgcctgggaagacaaagggaaatagggaatgagtgatttgtggagagactttataggcttggacatatattgagtctttgctcataaaatgtcgtagatatttggaaatctaatttgaattccagaattagtaaaacattacacttaagtcagaccttgccaggcataaagatattgtatatttttatgtacatgctcaatatcgtatattctcaatataaaactcagttgcaggttgcatttgttgtagaaattctgctttcaggttttgtttttcctgactcttcaaatcttctcgctgggcttctgggctagatctccctataaatttgaaatagttattccttattccccaagtaagtatggaaaagagggaaagagggatagaaaggttaagattgagctgataagaagacccttgtggcggggtggggggttggtgtggggagtgggtgggaaggtagtacacagtatttaaagttaacaagagctgggtgtggtggttaatgcctgtaatcccagcactttgggaggccaaggcagagaatcacttgaggccaggaattctagaccagcctgggcaacagagtgagaccctgtctctgttttttttttttttttttccggagattaatgagtcctccctcttttgcttttatttctttaagtgaaagccacatcaggcacactgaaaacctaactctttgtttttatgtactgggcttattttttttcttgatttctttcctgaacaaaatgaaacaattctttgagatgcttgtctttgtgatgtgcacaaccacttttgctttcctgtggtggcagattcttacaggatgacccactaagtttcagtgctaataactccatttgagcttttcagttctgttttgttggtttcccctttggcaaaccctcattaccctattcaaaaaactttgggaactgtttcttccccatttgctgcagagtaacatttgtctctgaagtgtaagatttccttccagtagggagcaataattcttttttttttttttttttttttttttgagacggaatctggctctgtggcccaggctggagtgcagtggcgcaatctcggctcactgcaagctccgcctcccgggttcacgccattctccggcctcagcctcccgagtagctgggactacaggcgcgcgccactacgcctggctaattttttgtatttttagtagagacggggtttcaccgtgttagccaggatggtctcgatctcctgacctcgtgatccgcccgcctcggcctcccaaagtgctgggattccaggcgtgagccaccgcgcccggccgggagcaataattcttctattattattctcattcacatttatctttcctttttctccccttctcagccttcttgctttcttcaggaagacctcctgcaagacctcacctatagtagtttgagtttaaccctgttagctgctttcacattcaaatcaatttaatctactttaataaaaaactttaaaaatttatgtgaatgactaggtatggttctaagttttgctatgcaatagatactgtaagtcacttagtgaaagtagtttgcctttttttttcttttttcttttggagacggggttttgctatgttgtaggctggtctcaagctcctggcctcaagcagttcttctgccctagcctcccaaagtgtgagccgccatgcccagccctagtttgccattttctgttttatttattaatgtatttttatttgttgcctttgtccacatgttctaagccattttctaatagaactaaatgtgttttttttttctttttgtggttcagctattatatgtatctgctacttttagcattaacctaaagcttcctgtatatgccaagtcccaggtattttggaatcccatgtggcttttgtgccctccaaagagaggtggagagaacctcttagactccaacttttacatactcttggcccagatttggggattaagtgaagggtgcctaatgaatagaacctatgcattcgtatacatctggcttgagaaaactgtatctctctctttttttttttttttttttgagaaggagttccactcttgttgcctaggctggaatgcaatggcgagatctcgactcactgcaatctccgcttcccaggttcaagcgattctctggcctcagcctcccaagtacctcggattacaggcgcctgccaccacgcccggctaatttttgtatttttagtagaaatggggtttcaccatcttggccagtctggtcttgaactcctgacctcaggtgatctgcccaccttggcctcccaaagtgctgggattacaggcgtgagccaccgcacctggcctcctatctctcttataagtagacttttcttcttgcttctttgaaacagaaactttttgtaaataaataaagtgtataaaggtgagccatattgggaagaaggggctgatagaggagttagaacaaccaggtaaccagatttttttttcctattcttttgaggaaaaaaaaaaaaaaaaaattttttttttttttggtctttctgaaactggtgctatttcagaatgataggtaaaagtctccatggagaagcaggggatgtgatgccatgtttacctgcccctcccccccataattatgatatcttttcacccattgaggaaagttgggctcacatagactctcttctttatgcgatagaccccaaatttcatctcgtaagagtaccagactggaaggtcataaagaaatctgcagtaggaatttaatctgtagatttggccacataaaatgcaggtgtaatttttatattatacttcaaaacaccttgaaagccatgttagtctttttgctatctttaacagttaagaatttttgcatgagaattattattttgtttctagttgtagtttttccaacctttcccaggccttcaatctctaattctgaagtttttaagaagagttagttacctacagttaatacttctgtcatctttgaattgctgttataccatataggcctatgagagagttgccagacttaaataattatttatatgcttaatttcttttaacacatagaataattctttaaaaaattgttttctctgtaaactgtaactgaaacccatgctgccctggaaagcaatgttacaaactgctgtaccctctgcctgaagacaagtttttatttctttatcctaatacccaacaacaattagtatcactttaaaagataaaatagaggccgggcacggtggctcacgtctgtaatcccagcactttgggtggctgagatgggcagatcacaaggtcaggagtcccagaccagcctgaccaacatggcgaaaccctgtctctactaaaaatacaaaaattagccaggtgtggtggcacacgcctgtaatcccagctattcaggaggctgaggcagaattgcctgaacccgggaggtggaggttgcagtgagcagagattgtgtcactgcactccagcctgtgcgacagagcaagactccgtctcaaaaaaaaaaaaggtgaaatagatgcccatgtcttgctaagtcagtgtggtgcagaaaatgataaggagggagtattccaatattgacctaaaatattttaatcaagaattccagacacttttctccacccatattttgatatgtagagttatcatgtgtggtcttaatttagcagtaaaattttgaatattgcacatatataatactagagaaatttaaatgttaataagacttgaggaccagataattttggggatacagttgttagctgtaaagtaaaaatttcaagtttaatgaatgaaaactagtctcactgctccattagcacaattggtttggaaggtttgcttctgggcgaataaagtgaacaatagcaaaggatgggattgctactttaaaaatactaaaatatgagggtaaagagagatgtctgtcagaggatgtttaaaatgaaacagcttcttaaaagcaagggacggaagatgtgcaaatggttatgaggtcattgtactaaacattagcattgtgcttctcactccagaagaaattacatcagtggataatctactgagcactgtaatttgggtagtactgagatgagcaattgttttagttgttgcctgacccccaccccacccccagcagcctggaactgtgcatgttatgaagaggtcatgtgacacggatccttggttttgctcatttatcctgtcaaaacaacttaatgtagatggaaagaaatgaacgaaatgaatagaatgggttagctgtatcagctttagtttatattgaaggtaatgaatgctgcaattgggatagtatagtatattaaggccccaggaatatccagctccataatggtgaagagaaggttctaaaaagcaacagtggctaatccattctaagtctcacttgatgttttaatgctactttttgatacggtcttttaaaattttatcattgtattcatgataatttgattgacagttggtaatatttaaacaatatatggttcctcttattttaccttcagctgtaatttagtataaagttcctatttcttttcaataattattatataataacaaacgtggatcttctgagaagaaaattattttagaagttttgcaaaatatttagggtttgtttgttgtcattgaaacatgagctttgaaccaaatcttcatttgtctcttagttctgtttttcatgtgaatttgagggagataataaaattttgtgagtcagttcgtctcacaacatttttctgaggattaaatgaagtgaagcagccaactagtaaatggcaaatacttggcaaaaattatttttaaaaccccaggtgttccttctgatctgtgtcttatgttagttttgatctactttattattgtcttaaagtcttttgggtgctaaaattatgtacttctctaagatattttatgaaatgttcctagattaaaaaaaaaacaatattcagttatagatggaacaagtagacaaactattgaaagaagccccaaattatttgtttaggtttcccccatttcctgctttgttgatgataatctgttgtcatgcatctgtatttctaacttcaaacattaagcaggggttctcagatcccttaaaataaataatacttttcagaaaggataaaaacacttagctatataaagtagcctgtatttatagtatagatgtcttctgggcaaattagagataaaatattctaaatatttctatggaatttttagattgtcattcagtgtattctcaaggaaaattaaatacggatttttgatggcaaagaagtcccccgtttttttccctctatgctttgctataaataagtagttggcagcttttttacaataagcttttacaaaccatttttaaaaatcaaaagctgggacctttgcaagttgatcattctgtatgggttgtgttggacttaactgagactcagaggcccaatttcaattctcatttttcttttaagtcacaggaattttttatccttggggaaatgctaactgcttattaaggacacacacacacacttttaaaggggtattgaggggaaaagacatttatggaattcattcaacaaatggctgttgaacaagtcactatgctaggttgtcaggtgctaaagatagaacacaaaaaggtatcttgtcactgccttttcatgacaaaaagcctctgagggcttattctatgggggataagagtcaatataatgttgcctgtgattaagtgttatgtaagaggcatgtacatagtatccattggttttaatgctattgggcagagtagaaacaggagtagtaacttggtttccttttattacattccttattgggtacttttggcgacagagtgagaaccttaaagttcaattaataattgatgtaataactgaagagaaaaattaatgaacaggaaggtagatcagaaaacattgcccagaaagtagcatacagaaggaaatggaaaatgagagagaaattaaaggatattaaggataaactaaagttatacacatactcacacacatttaaaaattgtttaaaaagaaaagaagagttggaaggggaaaaaaagagaatgagaggagacagtgtttagagagatactgagaattttcctgacttgaagacaaatacttgagtatttaagttattgcttaaaagaaaaaaaaaattaggcttcatgcagtggctcacacctgtaatcccaggctttgggatgccaaagtaggaggatcaccagaagttcaagaccagccagtgcatcatagcaagacctcatctctacaaaaaattaaaaaattagccgggcaaggtggcacatgcctgtagtcctagctactctggaggctgaggtgggaggatcccttgagcccaggatttgaggctgcagtgagctatgatagcaccgctgcattccagccttggtcacagagtgacttcctgtcttttaaacaaacaaacaaaaataaaaacaatgttttggttaaagatagattgattttaatcaaggcaaagatagaactggaatttatatttaggtctttgcctccaaagcctatgttcatttcctgacattaaattgcatgtctagcaattgatgacttatgttggatatggaaagttaactgcaccttacaaaaatgagactatatctgagttacacattaacagtaaagatactaaaatgatctcaagcatgaatgtatataatccaaatctatcatttataacttcagcatttgcattttttaaacaccatcgatcatgatttagtaatgtttaagtgtctaagattaactgtctgatttggtgttttatcattttaaaccacattctgttttggtttttgattttaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtaagttcatcagtattacaaaagctgaccaagaagtatgagagaatttgattttttaaatttcaggtctaccagtttcactttggttgttcagcctaagaagggaacagtccttccaactgttactgtattagcatatttccttgcccacaaagtcctctagtatataaagtgatttgataattatttcttggtaagtattgaaatgagaagttatggccgagtgtggtggctcatgcctgtaatcccagcactttgggaggccggggcaggcggatcacctgaggttggatcacctgaggtcaggagttcgagaccagcctggccaacgtggtgaaaccccgtctctactaaaagtacaaaaattagccgggcatggtggcgtgcacctgtaaccccagctacttgggaggctgaggcaggagaatcgcttgaacctaggaggcggaggttgcagtgagctgagatcacctcacttcattccagcctaggtgagactctgtctccaaaaaaaaaaaaaaagagtggctaaggaatcagaaatcaaatgtcaaggtagccctctagtggttaaaatgagattaaggtttattgagaaactacctatttttttcatttgtattgtgctttgctatatccctgcaacttttatatcagatgcagattatattgtgacagttatcacttaaaaaatacttttagttccatttcccataacatcagaaattaatccccaaatagctagatctatcattcctttcacagaaataggtttaatgcagaaatttcccgttacttattgtaaagagcttttggtaagtgttggagtatgcctttgtaatcccaggtttcttagagcagcagtccccaacctttttggcatcagggattggtttcatggaagacagtttttccatgaactggtgcgggggtggggctggggaagtttggaatgattcaagcacattacatttattgtgcactctatttctattattattacattaaaatatataatgaaatagttatacaactcaccataatgtagaatcagtgggagccctgagcttgttttcctgcaactcaactgtcccatctgggggtgatgggagacagggcagatcatcaggcattagattctcataacgaacgctcaacctagatcccttgcatgcacagttcacagtagggttcatggccctgtgagaaatctaatgctgctgacaggagccagagctcaggtggtaatgcgagcagtgagggagcggctgtaaatacagatgaagctttgcttgctcgcctgccactcacctcctgctgtgtggccaggttcctaaaaggccatggactgatattgatctgtggctcagtggttggggacccctggtatcttagaggatctgtttttactcagagaagaacctgtagtaagttaccttgtataaattttttatttggtgaaattggatatttttaaattatcactgtggcatatattctttattaattgttaaagttaatactgctgagctgattaattccagatcattggaatacagtgttacagcacctggatatagtcacttgcatgttttctgaaatgcttacggttagcatgttgaaacatgaacagatcatttctgtcctgcaaattctaatttctttatccaacttccactcttgtttatggcaatacctttatcctagttagtcaggcttcttgatactctcttttcttccattagaatgtgctaactagcactatatacctagtactatgaacaagtgctagatatcacattctactggaagtgtctaatactgaataataagtgtttgaatgaattaaggagaattatgtggtaataattatgtgtacatcttgagattctttccactggtttggatacttacttggttgtcaacagtttgtctggcatgcctaagattactctaaaatacaatggtttacttgttttaaaaactatattgaggagctttgggtaacatagtggggtaataagcccctgtggaatggctgtcccacaccaacaaactgaaatgtggaatataataaaagttttttccaatacgtgtctaagctttaaggaaagaaaggttaacctccagataataagcagagataactcaaagccaaaacaggaacttatactctgggattttagaccacatattggttgaggagttgatgctagttttaatgtccatgcaaggacagaaagccttagaactaggtagagaggggagctagaacttagcctgtgtcaaaaaactgaactatccgtgaaaagagagacctcagtgctctagccagtgaaagctgcaaggaattttacctgtgtgcagaagactgtggataagaggggagacctatgaaaaatagaaattcacatcaaatgctaccagtgttcttaattattctgtaaactaatcttttctttttctttttttggagacagggtctcactcggttgcccaggacagagtgcagcagcacaatcatagctcactgcagcctcaaactcctgggctcagggaatccttccacctcagcctccccactacctgggactatagttgctcaccaccatacctgtctaataaaaaaacaatttttttttttttagtagagacagtgtctattttgttgcccaggctgctctcaaactcctgagctcatcctgatttggcctcatcccgatttgacctcccaaactgctgggattacaagcatgagccacggtgcccagcctgtttggtattcttccatctcatatgtagatggcgctataacataaatttgtaccatctacttggtacaggaatcccaaaccgaagaacatacatgataattgatcaggaacggaaagaaaactcccggggacattttcacagttccttggtcagtgtccagaggcaaaactgtttccaaagaagatgacctcacaattaaattacaaatcacaccaatgaaggtgaatagacacaaccagaaaatagcactgcaacaattaaggatatcatggacaagtctgaaagtgattacaaacaattatttacataatgatgtcagtaaagatatttgtaagtgtatatgaagtgtataaagagaaaagaaggaattgaaggaaaaagacaccaaagaaaaaaaagacaggcataatttaaaagcttctgaagaacttctagaaataagaacattaaaattcaaacataaatggtctaacggttaaacagcagactgaattgaattgacaggaatattaactacgaagaaatgagcaacagaacacacaaaaaagacagaaaatatttaaagaggatgacatagtagtgagaagacccagatagatttaattatctaaaaggggtttccctgtagtcctagctactctggaggctgaggcagagaatcacttgagcccaggaggtggaggttgcaatgagccgagatcgtgcctctgcactccagcctgggtgacagagcgagactccatctcaaaaataaaaatgaaaaagtagagagaatgagaaaaagaaaaatttcagaatttaagaattctgattgagaatgtatacagattcctaagcaagtagattgaaaacattcatattcatttctggaagaatggataactaggaccattggcagcatttggagaggcagattgggaaggaatgggaattaattccaaaatgcgtgctttttggacctttcgagtttctacctttgttctctatgtatatttacattgaaacagataaaacacccatagctgaaaaataagatgggaatgtatgagtcagaaaatttggattaaggccaggcgtggtagttcacacctgtaatcccagcactttgagaggctgaggcggatggatcacctgaggtcaggatcacctgaggtcagttcgaaaccagcctgtccaacatggtgaaaccccatctctactaaaaatacgaaaaattagctgggcatgatggcgggcgcctgtaatcccagctacccgggaggctgaggcaagagaatcgcttgaccccggaagtggaggttgcagtgagccgagattgtgccactgcactctagcctgggtgacagagtgagactccatctcaaaaaaagaaaaagaaaaaaaatttggattaaaagttgagataaatttagatgtatttttttaaatagacatgaaattcaaatatcatacaattaacattttagaaagtacaattcagtggcacttagtacattcacaatgttttgtaagtaccacatctatcaagttactcaacattttaatcacctcagaacactctgtgcccattaagcagttactctgcatttcccttcctccagccaggcagcgtattttttctttaattgcacattatctaagttctttttctttttacaattaaaaagaaattttcagtttctgagcttcagaggcttatgccaacaggagggtttattaagtagaaagagcattagacttgcagtagaagttgtgactgctcccaccgctgcctctgaccaactgtgattttgggcaaatagctaaccttatttgggcttcagttccccatgtgtatgtaaaacaagtggttggactgcctgatctctgggaccagccattcgtggatgggatttttttattgtaaaaaacataacaaaatttaccatcttaaccatttttaagtgtatagttcagtagtgttaatacaaacacatttctgtgcaatttctagaatgcttttcatgtcacaaactctatgcccgtggaacaatttcccatttctcccaaccctcagctcctgacaactaccaactttttaccatctctatggatttatctaatcaggatatgtcctataaatagactcaaagtatgttatggatccttgtgtttggcgtctttcacttagcatggtgttttcgaggatcatcgtgattgcacgcatcagtacttcatccccttttatgactgaataacattccattgcatggaaatatcacagtttgtttatttatccattgatgaacatttgggctgtatccaccttttggctattatgagtactgctgctatgaatatttgtgcagaagtatttttttgagtacctgttttcatttcttttggctgtatactaggaatggaattgctgagtcatgtggaaatctttgtttaactttttgaggaggcatcctaccgggagtgacatgatacctcattatggattacatttgcatttccctaatgattaataatgtggaacatcttttcatatgcttattggctatttgtgtatctttggagaaatgtttattcaagttctttgctcattttttattggattgcttgtttttttgttgatttattagagttctttatatattttagaaattagacccttgtccagatccatgatatgcagatattttctcctataggttgccttttttgctccttgataatgttctatgatgtacagattgagtatagtatctcttatccgaaatgcttgggaccagaagggctttgaattttttcagatattggaactttgaattatacttaccagttaagcctcccaaatctgaactccaaaatgttcaaatgagcatttttgttgtgtgtcatgttggtgctcaagttcagattttctattggagcattttggatcttggattttctgatttggatgctcaagcctgtgccaagttttaaattttgataaaatccaatgtatctgctttgtcttttgatggttgggcttttggtgtcatgtaagagtccattgtcataaataaccaagggcatacagatgtatccctaagttttcttctaagagttctatcaatttaacttttctatttaggttattgttccatttttaagttaacttttgtgtatgccgtgaggtagggtctgatttcattcttttacatgttgatgtccagttatcccagcatcatttgttgaagagacttttacctattgaatggtcttggtactcttctcaaaaattatttaatcatatgtataggtttatttctggactctcaattctatttcattggcctacatgtctgttcttatgccagtaccgcattgctctgattactatagtaatttttgtaaattttgaaaattagaagtgacttctccaattttgttcttctttttcactattgtttttgacagttggggtcttcttgaaattccatgtgaatttgaggattagatttccatttctacaagaaaaggctgttggaattttgacagaaattgtgttgaatctgtagatcattttgtatagtatcaccatctttaactatattgtcttctaatccgtgaacacagggtgtctgtccatttatttatgtcttttttaatttctttcagcaatgttttgtagtttcattatacaagtctttcacatccttggttaaatttattcctagatcctttatatgctattgcaaatgaaattgttttcttaatttccttttcagattgttaattgctggtatatataaatacaactgatttttgtgtgtcagtcttgtacttttgtaactttactgaattcttgtattagctcatctgtgtgtgtgttcattctttggggttttttttttttttttttttttttaaacagatggggtttcactctgtcaccgaggctggagtgcagtggtgcagtcatagctcactacagacttgaactctaggcttaaaggatcctcccacctcagcctcctgagtagctgggactccaggtgtgtaccaccatgcctggctaatttttaaatttttcataaagatagggtctcaatatattgcttatggtagtcacaaattcctggcctcaagtgatctcccttgcctctggctcccaaagtgctgagattacaggtgtgtgccaccacacctagccattctttgggatttttatatattggatcaagtcatatgtgaatagatagttctttcagatttgaatgcctttatttctttttcttgtctaactgttttggctagagcttgaattatgattagcattgattatccttgtcatattactgattttaaggagaaagcttttggtctttcaccattgagtatatgttagctgtgagtttttcataaatgttctttatcatgttgaggaagttctctgctattcctatcctagtttcttgagtttttttttttttttttttttttttggaaaggtgttagattttgtcaaatgctcttctgcatcaagttagataatcatgaaaccacttcgttctattagtgtgatatattatactgattaattttcttatgttgaatcacccttgcatttcatagataaatagtgtataatccttttactatgcagttgggtttggcttgccaatattttgttgagagtttttacatctacattaataacggtgttagtctatagttttcttttggtatcttcagtatcagggcaatactggcctcacagaatgatttagaaagtgtttcctccacttttgctttttggaagagtaggatttgtgttaattctcctgtaaatgtttggtagaactcatcaatgaagccatccagtcctagacttttctttggagatttcttgaaggaatgttccatgtacagttgagaatatatattcacttgttgttgggcagtgtgttctaaatatgtctgttaccttttggtggtttataatattgttcaagtcttctgttttcttactcatcttttgtctagatgttttatccgttattgaaagtggaatactgaagtctccaactattactgtagtgtctactaatttcctccctttaattctgtgaatgtttgcttcattatttggtggctttattgtttgatgtatataattgttattttttatggattggcccttttatcaatacatcatgctcttctttatctcttgcatcagtatttttacttattttgcctgatattagttttgctacctcaccctcttttatttactattagcatagaatatcatttttctttcatcctttgaatttcaacctatttctgtccttggatctataatgagtctcttgtagacagtatatagttggctttttttctttctttttaaaaaatccattctgcccatctctgtttttggtaggagagtttatttacatttaattagtcaaaatgaatgatttgctattttgctgtttgttttctgtatgtcttataccttttttttttttttttttttttttgagacggagcctcgctctgttgcccagactggagtgcagtggcacagtctcagctcactgcaacccccgcctcccgggttcaagcgattctcctgcctcagcctcctgagtagctgggattataggtactcaccaccacgcccagctaatttttgtatttttagtagagacagggtttcaccacgttggtcaggctggtctcaaactcctgaccttgtggtcctgcccacctcagcctcccaaagtgctgggattacaggcgtaagccaccgcccgcagccgtaatatatcacattcctagagacagtcttgtactgttttttgctccttatctccttcattactacctttttaaatgtatttatttttcttttgtagtataccattttcattcctttctcatttccttttgtgtatatatttagatattttttcagtggttaccttgaggatcacaattaacatcataaacctccaacagtctaccctgaattgataccaacttagctttaatacagcatacaaatctctgatcctatacagcctcactcctccttcccattttatgttttcattgtctcaaattttatgtttatacattgtgtacccattagcatagttttataataattattttacatgcatttgtcttttaaatcatgtaggaaataaaaggaattataaaccaaaaatacattaatactggttttaatatttagatgtgtgatggactttaccagagatttgatttggttttatggcttcaagttattgtctagtgttcttttatttcctctaaggattctctttagcatttcttttagggaaagtgtactactgtcaaactcttccagcttttatttacctgggaatatcttaatttctctttcatttctgcagtataattttgctgatatataattcgtggttggcagtcttcaggttttttttggggttttgcttttgtttcttttagcactttaaatatgtcatcccactgctttctgccctctatggtttttgctgaaaaatcagctcataatcttattgaggatcccatggtcataagtcacttctcccttgctactttcaagattctctctttgtctttgccttttaacagtttgaatatagtgtttctcattgtggatctatttgcatttatccttagagtttgttgaactttttggatgtgtagattcatgtcttttactaagtttgggaaatttgtggccattattttcttaaatattctttctgctcttttctgtcttctttatctaggactcccattgtgtatattttgctcaacttgatggtgtcccacagatctcttagactctgctcatttctgctcctcagactgtacagtttcacttcctattttcaagtttattgcctttttcttctgtgtgttcgcatatgctgttgaaatctgttagtgaatcttcacagtatttttcagcacctcaatttctacttggttcctttttaaagtttctgtctctgttgatattctctacttcaatagaatattctttgtactcttaatatttagcagccattgttctcagcatttagtctgcaaagttttggcataggtactataattatccctatttaaccatgagttgattgtttttagtaaatatcttagtactgaagaactgattaagagctctgcttatgagagtggagcttttcagcaactgggctttgtcttcaatgtggttgggcaaaaatcagtcacaatggaagaacctgaagtgcttgatatatcagagacatctttttttttttttttttttttggagatggagtctcgctctgtgttgcccagggcggagtgcagtggcgtgatctcggctaactgcaacctctgcctcccgggttcaagcgattctccaacctcagcctcccgagtagctggggctataggcacatgccaccatgcccagctagtttttatgtttttagtagacaccatgtttcgccatattggtcaggctggtcttgaactcctgacctcaggtgatccatccacctcagcctcccaaagtgctgggagtgagccagcgtcagccactgcacctggcagagacatcttttttttttttttttttgtcctatctgcactgatggtgcctaattgtcacttttctttctcaagatgtggttggttatggtgattttaattaatattcgtatttttataaccacttttcattctcaccaaacttagcttctctgagtttagaaatgttccatttgtaatatggagcagattggattccttcttgtccttatactttccttataaacattgctataataatcatgtttgtacacaattcccaaagaataggttcttaaaatgaaatgtgaatcataatatatgtgtaattttcacttgaatagcaatttagacaaagatatgattccctcctgctagctgggataatcttgaaggtctttactaaaatgatagatataatttaagtagatcttaaaggataaacaggttttctgtaattagggaggtgctatgggaatagttaaaaaaaagagagaagtaatataaagttcatagtaggataagatacccttttgtttaaaaataggatgtttataaggaggactaacgacaaataaaatttccaatattttattataaaattctaaaaattatatagaaaaggcaaaagaaacatacagtgagcacacactcagcaccaagattctgttgttactaactttttgcatcacttgccttaccatattattaatatgtccatttattcatcctccatccatcttattcattccataataaaataaattgtaaaataaaataattcaatatgcttcacccgtaaacccttcagtatgcatttcgttagagttccagtatttgtgtactttatttttcttttacctccaaacagcatcaggatagaataaattattattgtacgattgaatgagttttgacaaggcattcattcgtgtaaccaaaactctcaagatagagaacatttccatcatatcggaaaatgcccttatgccgctttccaggcagccttttccttaccctccatccagcatgactgttttgatatattttttaaaccataaaacccacttttgctattagttttcttcaattagcccacccaaatgaagtaaaattttattttagttctgctatttgatttttagttagatctggatctctgcatgtttttcattttaagtagttgccctgaagattacatttacgttgttacttttcacaatttatttaggactaatactgtacaatttcatgtaaaatacaagacctttgcacaaataaggttttcatataacccctctaccgcttgttctgtatgctgtaattttcatatcttatacaagtacaagattacataagtaatttcatatcttatacaagtacatagataagtcattattaaatgggagtaattatagtacctattcaacaaaattggaatactaaatgcaggaaacagtgacagccaaatgttaacagtatagaaaattttacctcaacaaatagagaatatcagtaaagacatagaaattacaaaaattaaacaaattcaggaactgaaaaacaataattaatagaatatgtaagcatatcatatatatcacagtattatagattttcctttaaccaatcatgtgtgtattttaaagatactgaaaggaaaatgtagtcttttctatttaacatttttagtgctctttttttcctgaatatttccagataaaataggcattggaactcaatccccagatgtatcttttctacagtgggtagcaccagaggtctctgttcagttcttttagcatacttgggctgcttggaatctttcctacattcatgtatttcagaggtcaactagagatttgggcagagtggatacacagaatttagggctctcctttggtgcctgctttctgagatttcctcctttcctttctagatctgtgctgtccagtagaactttctgccattatggaaatgttgtataacgtacaccatccagaatggtagccatttgcctcatgtggctgttcagcacgtgaaatgtggctagtgcaactgagaaatgaaattttttattttagttaatctacatttgagtagtcacatttggctagtggcaactttattggacagaccatccttgcagaaaggtctgttagacagcactgttcttgatgctgtggtcattccaaactcagtcgccatttctgtctggggtttagcagacctgcagaatcagaacaggccctttccttaggtaaaaatgtattataaagaaggaaactcaagtagtgctttccctttttcccttccaactatgactgattttgattgctctccagagccttcaagtaatagttgttttgtatatttttgactagagtttataaatacatctgtgtctgatagaactactccactatttaacagaagcagaactctacctcttaatcatttaaatggtgacctaatgttaaggaattcatatttggtgctttgttaccataattctcttaccaatcactaattaaatatttttggctctgaaatatttagctgatatagccaacttgatctcccatttctttaagaaaaaactagttacctaatactatcattgtttagatgaaaaagcatttggaagacttatttttctgggtctcttaatagaatttttattttaaactatcatagccctgcttactaaaagtattattaacctttagtgttactgaatcttagtatgctaaatttgatattcccatctccagtcatgttagaatttaatggaattcttcaaagcaacaaactcctatcattgataacttgtttggtatactttgctttttctaggtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtatgtttcaggtgtaccttggagcctgactggctttctcacattccttttatttagaatcctggctctgtcagagttttaagtgatataaaccttaagaaattcatagcttgaactcaggaggtgatccattgtacttatgagatataggattctctatatttgtgcttcttggaatcatcttagagactattggtaacattacgttacaagaaataaagtgaactttgttgataaaacctaatgtaatagccttttttgttgttgttgttgttgttgttgttgagatggagtctctctctgtcacccaggctagagtgcagtggcacaatctcagctcactgcaacctccacccaccgggttcaagcgattcttgtgcctcagcctcccgagtagctgggattacaggcatgcatcaccatgcctggctaatttttgtatttttagtagaaatggggtttcaccgtgttggccaggctggtctcgaactcctggcctcaagtgatccacctgccttggcctcctaaagtgttgggattacaggcgtgagccaccccgcccagccagccatcttttcattacacactgttgatacttaacattatacactatttatttaatacatacagtatgtcacttcatgaaagaaatggaatttatatttagttttactttctaaaattaaaagataaaaattaaatttttaaacatataaaatgtctgttggatatatatgtatattcaagaatattggccaagcacaatggctcatgcctgtaatcccagcactttgggaggctgaggtgggagggtcacttgaggtcaggagtttgagaccagtctggctaagatggagaaaccccatctctattaaaaatacaaaaaaaaaaaaattagccgggtgtggtggcgggtgcctgtagtcccagctactcaggaggctgaggcaggagaatcacttgaacccgggaggtggaggttgcagtgagctgagattgcgccactgcactctagcctgggcaacagagcaagactccatctccaaaataaaaaaaataaaaagaataacctcctaacattttgtgaaaataaatatgacaattcattctgaaaagttggttttatcaacttttttcttagtctcactcttcagaatttatgatctatctaaaagagtgtttctcaacctcaatactactgagatttggggttggacaattctttgttgcaaggggctgtcttgtacgttgtaagactctggggcagcattcccagcctctacccactagataccagtagcacgctccctctgtacctgccttctagttgttataaccaaaagtgtgtccagacattgctatatatggcccctagaagacaaaattgccccctgttgagaatcacttatctaaagaacaaggctgtccctttcagactttatatgttagaaactcaaagctggaaaaataatttaatgcctattttgataagctttcactctatgaagaggatatcacaatttaaaaacttgaggtcttcataaacattctatttactccctccaaaaggtgacaataacaaaagaaacccattaatttttaagtgaacttggatactgagtattactaggaaaaacacagaacaccagttatttgtacatctttcaaaaacagtgttctccttggaatattatgtaactagggttaggaatgctttcacattttcttataatacattcacaagaagaatgggaaaagtgtcatttaaagctgaatttctttttttgccttcttcacaggaaacatttctttgattgtctttggcatcctgaaatctctggcccaatagagtttttattttctttgttgattaaatgatagtgtgcatgcctgtttcttggaaatgcctaataatttgaggtatgcagacctaattttctggaagcattacaaaacctagtcttgtgggatcacacactgtgctcataaatcagtctgtatttgggttctatatttgtgtgtgtgtgtttgtctttttgcctgtaggatgtccctcactacatttcttgtgtctgtagtaggcttatttgtgtactgcaggtgggatggtaagtatgtgaagaaaagggctctggtgagtggcctttggagacaattacgttttatttcattttttaaaaaatgtattgaatatcgggtttttcactgcaaggccttcttaaaaagtgaaactaattagattgagtgttaatgccaagagtgtagctgtaaatattaaccctacagctaccatacattagtgggcacacaagtattttgatctttttaaacccatcatcttatcttacagatgtaccattatatttgctttgttccttgcatagtgtctttccttttccttctatttgttttcaatatgaattatattagtttattatcttagccaaggttttattttggcatattgtataaagaaattcattttacacagtaaatcaataaatagatccttgaccttattccagtttcatataaaggccttgcagtggaagatcttttatgagatatttgatggaacagactgactgagaagatttccttcctcttttctccccctttccttttttctccccattccaatttcttctctctcacaggtcaacccctctgcttctcaccccggtgagtaacgtctgaagcttctgctcgcattgagtctgaatcgttcttttaatttaaggtaccccagagttcatggcccctgagatgtatgaggagaaatatgatgaatccgttgacgtttatgcttttgggatgtgcatgcttgagatggctacatctgaatatccttactcggagtgccaaaatgctgcacagatctaccgtcgcgtgaccagtgtaagtcttcccctaactgattgttgaacttggggcatatctaacaaagaatcccaaggtggatgacatcaaaccatgtaaaagaggacaatagtggaaggcatactgagtgaactgttggggttgggggggtggtgttgaggtatgtgtaaggctattgctcatgatacagtgaaagataaagatcaaagaaccactagtttatcctgtacccaccttgcattcatttaaatctttattatgtttaaaaacacaccctcattacctactttttaaccccctattaattcagctaaactcctgttgtctcccaccacataggtcagagttaaaagtaatgtttttaattcaagatgctttgtcaaattaatttgttcactgacttttctctgaatgacttgagttgatttattaaatcttatatattagtacctaccatatttaaggcataaataaataccttattgtagtttaaattactcatggtagttcatgtctgctgacagagatattttctacagctgtctaattgaaacctgaaaggtagttgttatgattcattttactttatcactacatgcttcattatgctactctaaaatacattttcttacataaccatattatgcctgaaaaaattaacaatcatttctgcatcatccaataccctgaacctgttcagatattctctccattgtttcaaaaatgtccgttgacagtgttcaaaataggctccatcaaggtccacaaaatatattttattgttgtagttcttaatctagaactattgcttttactttctttttctgcatgcatgtcagagatttattgagaaaattagattatttcgaggaatgttccacattctgaattttcctcgtggtgtcatttaactagtttattcttctatatttctgtaaggagaagtttaccttaaaatggttggggtaggttaacaatgtaaaaataattttgtcttttttactcgcattcacccaagagtgtacgttgttgttttccagaggctatatgatactgcacatatgatattgcagcagagtacatacagaagcatataaaagaattcatttgtagggccgggcgtggtggcttatgcctgtaatctcagcactttgggaggccgaggcaggtggatcccttgaggtcaggagtatgagactagactggccaacatggtgaaaccccatctctactaaaaatacaaaaattagccaggcgtggtggtgcacccctgtaatcctagctactttggaggctgaggcccgagaatctctggaacccgggagatggaggttgcagtgagccaagattgtgccactgcactccagcctgggtgacagagtaagactctgtctcaaaaaaaaaaaaaaattcctttgtcttccattaaaccatatatttaaaaagattacaaaaatgtaaaacaataccagtcttatcactaaatttttcttgttttggaaaatactgactttttaattttaaatatatatttgtaacataatgagttataatttttaatgaattaacatttttaaactttctcaggtttaccatctgccacggtaaatattaatagatgtaacacacatagacaaaatccctctgaggtccccaataatgttaattttaagagtataaaggggtcctgagacaaaagtttgagaaccactgttcaaaagtcttgataaaatttaggctaaacattttttgcaaggatacttaatatgtggtgctgtatatgttatattgcaccgagaagctcatagtatctcattatttcatttttagtgatgtaatttaattgaattttgatatagaagatgtaattatcaattgcttatttagattttgatagctgaacagaatggaaatgtttatttttaattttttatttatttatttattttttgagacggcgtctcgctctgtcgcccaggctggagtgcagtggcgccatctcggctcactgcaagctctgcctcctgggttcacgctattctcctgcctcagcctcccaagtagctgggactacaggtgcccgccaccacacctggctaattttttgtatttttagtagagatggggtttcactgtgttagccaggatggtctcgatctcctgaccttgtgatctgcccacctctgcctcccaaagtgctggaattacaggcatgagccagaaatgtttattattaaaaactgataggaaacattttgctttaggtagaccaaattttacctcttcataaaggcttgggagaaatctttggagtcaaagattaattataattatttattgctgtgaatattccttcaatatccttgttgtatatttgtatgtgattctgttgttgatggatatggagctactttggacaattagtttaatttcatatgaagtttgaggtttcatacccagtaaaaatgacagctattgtttatggagaaagtgtgtaactctcaagttacttctggctttgtaattgggatggtattttgtcagttattattattaggtgtatgtctacaagtgtctggcctgaggccttactgttaaatttattaacctcttcttaatactcacccagattctaatacacaatataattgtaatccctgaagcactgactctcaatttgggctgaatgggggcaggagaaatttttttatgccttcagatgattctgataagtaccctaatcattattctacatttatgcccttagaaagctcatctgctttgcctttcagagttctgtatcatcattcccagttcatgtctcttattattcccctttcttcccctgatgcgttgtaatttacattctctctttttttttttcctttgagcatagggtcgactgtttattgggtaatttcctcctttattttgtttaaaattgtagaaaacttaagaggtatatttgatttcttgttttttactcgctgcttccactacttccagtttataaggttcttgcttcagaatacctcttagatgcaagccttcttcattcccattgccacaactctgatttcacatcttccttactgcacaccttgcattatattccagaagtaatttacattgtgaatttatttttttatttcacttaaacttgttgagctttcttgctatcctttcttggtataaggaacttaagataccagtttgctgatatcagagcaagtacaaattcttaatctttgctattcttcatcttcatccaagcactctattttagttaaatcagttctcttcattatctcgcacatatgccacatcctttcctgtattcctatccatttgtaaatgttatataatactgtacctccactataagcttttctgctatccagtcaatccatatacttaacggtcttcctccatgacattttatctgattggtttcactgtataatgatctttgccttttctgagctgattcttctcaattgatatgaatgataaaattttgtttattagtggttattctacttataaattcataaattcaattaatgtacttgcttattatttttattgctttatattccttaaaatattttaatctagtacatctgtataatttcatccttatctgtagcactatcctaaatacaaaataaatctcagtgccagtaaatgcaacattttctgaatccctgctatgtcccatgcccagagcttgatactaagtaaaggtgaataatcatattccctgtcttcagaaaactacctctaatatagaagattaatatgtaaacaaagaattataattacattatggtgagtattgtaatggagacaagcactaaggagagtggaggaacaatggataaccctgctatggattagggaagatttcacaaaaagagctgttgtatgaactgtcaaaaagagaaggtagaagaatggtgagaggccattctaagaagcaggaataggatttacatgaatgctgagatgccaaacaccgtagtacaatggaaggaaaggcaaattgatcaaatagagtgaagctgttgtcttggacaaatcaatttttgatccaaggacaaatcaattgctacttagtttctcctgctcccaaatcctgtctcatctcagagcagagagtttccggttggtaattaagaggcaaacttctgactgctgatatgtgtttttactgctattatattgttgtattttaatggtgaaagagactttatctgtttataggcttttggaaggagcaagaggaagagagagagaagtagaaatcatggtgggtggtggtggatagggtagagtaatatccaggattcaatgggcttgtgacatggtataatggtaagtcttgatagggaaggttttctcctgaggtaagggaagcaagatgggttttggaagcaaagtcttgggttcacatccttgccctagttattgccatacgatcttgagcaattcacttaatttctctgtacttcaattattttgttctctgtaaaagagatactattaccctcttacagattgcttagcacagtagatagtactggtactgatagtaggctgtggttattgtctatgaaatatgagttgtcatcttcttgggggggtgtgtagaatgaaagatggcctttaaggatgataaaggcttaaaataacatctatgaaactttgaactgattaggaaataataattgtgaagcagcaccaggcatccagaatcttcctttttagtattgataaacactattatgtaaacaatgaatatattgtttgtacgcgtgtctatgtgtatgcaagtggaaaagggcaaatttttacctattacatacttctttcttgtgaataaccaataataggctgggcctgtaggctcacgcctgtaatcccagcactttgggaagccgaggtaggcagattgcttgagctcaggagttcaagactagcctgggcaacatgatgaaacattatctctacaaaaaatacaaaaattagttggccgtggtggtgcatagttggctgtggtgatgcatgcctgtagtcccagccactgggaggctgaggtagaaggatcgcctgagccggggaggtggaggttgcagtgagcctagattgtgccattgcactcgagcctggacaatagagtgaaagcctgtcttaaaaaaacaacaaaaaaacccacaatagcttagattgctaaagtagtcctcagttttctatattctgaattctgtgtatcagggtttgaagaatagaatagaagttattgacataaatgagttaggtttcataggagaaaagttaattttacttggtgtattttctactgaataagtttcatctgtgtatttgtgaatatttattaattataaactgtgaccaagcactatactaggtattggggatataccaagtcaaaaagttgtgcctcacctggagtttacattcagttttgttaaaaaaaaaaaaatgttgatagaagtcagtaagttggctgggcgtgatagctcacgcctgtaatcccagaactttgggaggccaagactgggggatcacttgaggtcaggagtttgagaccagcctggccaacatggtgaaaccccagtctctactaaaaatacaaaaattagctgggcatgatggcatgtgcctgtagttgcagctacttgggaggctgaggtaggagaatcacttgaacccaggagacagaaattgcagtgagctgagatagcgccattgcactccagcctgggtgacagcaagacttggtctaaaaaaaaaaaaaaattgataactctattagagtgataaggtttgtgtctagaatagatgggagataaagggtgagaagctgaactaggtttattgttacagcacagcaaattcaatcatttctttttgcccgaaatgtatgactaggtactaatacaatctgacttttttattaaaacatgtaatgaagtaattagggaggaaatataagccagtagattcaaaactgaggggaaaaataacaaaagttgtagtggatcaaagtagatttgtagatcaacatgctatatgagtgatactgctaaacagtaacaggtgtttctgttatgtgactcctgagccttaatttcctcatatgattatggtagtcataactgccaggcctactaaggttgcgaaaaacaaatctgttgaaattatataagaaagtacatttgaaaaagttgagaaatatatttgttgtatttgacatataactagattgactctgaaatgtcttctatctcaatagattcttgatgtttcagaagggtttgacttaggctttctgctacaaaagattgggaggatagtagcactaactggctttcttaagtgtaatgaggctcatatttgcacagaagttacaaaatctgtgattgtgatatattcaaggaattttatttttaaaaatgcctccaacttttcaataaaaaagtaaatagatggcaaattattctgtgtagagatgaatatctagatattaaaacttaaaagtatgattctgattacataatcaagtcataggctttcagtagtccttaaagtctgctttctatccttcagtgaatttttgaagtttgtttatagaatattttgtgcttatcatattaaatattagaagacctttggggacttgattgattctctgcatggcataacgtgccaagtcagagtattaatcagaaatattttttttttgtatgtgcatactaaaaatgtacatttaggtttttttctatcagtgttactgaatatattatatacctacccatctaaagtgtataattcactggttttagcatcttcacagtgttaaaagaaaaacttcagccaaattaaatttaaaggcgtttaattgagcaatgaacgattcgtgaattgagcagtccccagaatcacagcagattcagagagactccagggatgcctcatggtcagaacagatttatagataagaaaaagggatgtgacatacagaaaccagatgtgaggtacagaaacaactggattggttacagcttgctgtttgccttatttgaacactcagcaatgtatgagtggttgaaatacagccgtgagggctgggcgcagtggctcacgcctgtaattccagcactttgggaggctgaggcaggcagattacctgaggccaggagtttgagaccagcctggccgacatggtgaaaccccgtctctactaaaaatacaaaaattagccatgcgcggtggcgggcgcctgtaatcccagctactagggaggctgaggcaggagagtcacttgaacccgggaggcagaggttgcagtgagccgagatcacgccattgcactcctgcctgggtgacagagtgagaccctgtctaaaaaaaaaaaaaaaaaaaagaaaagaaaagaaaaaagatagaaatttggctgttgggattggccaagactcagcagttgttacgggcatactcctaagttaggttttcagtcttgtctacctgttaagttaggttgcaattagtccacacagactcaaattagaagtacaaagtccttctcgggccatatttagtttgctttaacaacaggtatgtgcagccatcaccacagtcaactttagaataattttatcacatgataaagatattctgcaccctgtagcaatcacttttctatacaaacattccccccactcctgtgcaacccctaatctgtttatgtcactataggtttttctattctggacatttcatctaaatagagtcatttaatatgtggtcttttattactagcttctttcactttgtatagtgttctcaaggttcgtccatgttgtagcaaatgttcatgcttcattcctctttaagtctgagtaatattccagtgtgtgtgtgtgtgtgtgtgtgtgtgtgtgtatgtataaacacaattgtttagccatttatcgattggtagacatttggactgttcctaccattggctgttgtgaatagagctgctacgaagaatattcatgtacaagtttttgtttgaatatctgtttttacttcctttagatatatacctagaagtgaaattaccatgtgtatatgctaatcctatgtttaaccatttgaagaactgccagcctattttccaatagctgtaccatattacattcccaccatcagtgtaagagaattgtgatctcttcatattcttgccaatccttgttgttattattattattattattttgagacagaatctcactctgtcacccagactggagtgcagtggcacaatctcggctcactgcagtttccatctcctgggctcaagtgattctcccgcctcagcctcctgagtatctgggaccatggacacacaccaccatgctggctaatttttttgtattttttgtagagacgaggttttgtcatgttgcccaggctggtctagaactcctcagatcaagcggtctgcctgctttggccttccaaagtgctgggattacaggtgtgagccactgtgccagcctgtgtcttctgttcttaaaaggacagcagtcattgggttaaggacccacactgctcctggatgacttcatcttaactaattacttaactaattttttttccaaaaaaattcatattgtaaggtactagagattggaaccacaacatatctttttgagggacacagttcaaccccataacaattcatgggttcattcagcaaatattcaagtctcttctatgttccagactgttttctagatcctagatattgaatattattgttatgtcaaacacagtccctgtctctaaagaacttaccaagggaaggggaacaaacaaataaagcaaacagttacaatacaatagaaaacacttattttagggataggtacttaatgaaagcatgtaagagtggtacctaatcaagtttggacaggttagggatatggtgttaaagaattagggaaagactaagatagtgttatatatgaagatgcatgattttgagtatcttgtcaagtttggaagtaggaaaaggacaaggcaagggataagggacaaaaggaaagcttagactttaatgtagagcactgaggggactgttttaaaagtgggtagctatcatgtatgtcaacacctacagacttaaattttagaaagattatttctgactgcagagtggagaatggatttctgaggaaagactaaatgttgaaaactcagttaaaaaggtattgaagtaatctaagggaaatgactaatagtctgaaataaggagttgtaagagagaaggccaaagtggatggattagagagattttgtttgtgaattagatttgagctaacctcatttgtttttttccacttaacatttatgaaaataaatgctcatgtacatatatatacttaagatcaaacaatatcaaacctgattgtgaggttaaatatataactttagatttggggactataaaatttataatttgtatatgaaatgttttatatattttatttactaacttaccaatcattactttttttgagacagagtcttactctgtctttcaggcaggagtgcatggttcagtcttgtctcactgcaacctccgcctcccaggttcaagtgattttcctgcctcaagcttcctgagtagctgggattgcaggctcccaccaccatgcctggctaattttttttttttttttttttttaagtagagatggagtttcaccatgttggccatgctgctctcgaactcctgacctcaagtgatccgcccacctcggcccccaaagtgctgggattacaggtgtgagccaccacacctggcccattctgtcgtattctaaatggagtagcaaactatgcttcttggccaaattcagcctggtgcccatttttgtacagcccatgacataagtatggtttttggttttgtttttaattttttgagagaaagtctcactctgtcaccgaggcttgagtgcagtggtacaatcatagctctctgtagccttgaacttctgggctcaagtgatcctcttgcctcagccttctgaatcgctaggactacagacatgtgccaccatgtccagctttttttttttttttttttttgtagaggtggggtctcactatgttgcccatgctggtctcaaactcctggcctcaagtgatcctcctactttagcctcccaaaatgctgggattacatttacgagtaccatgactggctggtttttatattttttaatgtttggggaaaatgtcaaaagaagagtattttgtatgatacgaaaactacatgaaattcaaatttcagtgtccataaataagtttttctggcatacagccacactcacttgcttccatattatttatggctgttttcacactataatggcagagttgaataattgcaacagactgtatgatacatacagcctacaatatttactattaggcccttaacaggaaaatttacttactcctgtgttaaacatatgtcaccagaactttgtaaaacatgttcccctgtagagtcctgtaagaaattactgatctacgaaagtagtggtgatgttcttctataagaatgcgttagcctctgtatttgtaaagacatgagaatcttggtgcaaacaagtagctacttaacaggtcagaaaatgtgtaggcagtcttttctctctgttaagagtagaactaaaactttaacatttttatttgccaaatgcaaactcaaaagctcagttgagaagaaaatcttcttaaatgaaagatgtctttgatagtaagtttaacagaacctggaaagactggtgtcactgtttctgtattctcagtatagtgtttaacctgttttcagttgttcagcagcttttgttttttattaaactgagacaaaaatcatatatcataaaattaaccattttaaccatttttaagtatactgttcactggtttttagtatatccacaatgttaatgcagttatcactactaattccagaaccttcccatcatccccaaaatgaagccccataccagttagcagtcatttcccattctcctctccaacccatcccctagcgaccactaatctgctttctgtctctggatttgattttcctattctaggtatttcatgtaaatggaattatacaataagtggcattttgtgtctggcttctttcacttagcaaaatgtttgcaaggtacatccatgtggtagcatgtatcagtactttttaatagttaaataatattctattgcatatatatactacattttgttctattcagcaggttttatttccctttagttctttagtttcttcctctttttctcaatgttaaactgcttgactctatagctgcctcttaatctggagagagattgagaacaatgttttagtccatttgggctgctatatcaaaaatgccataaactaggtggcatataaacaacaaccatttatttctcacagttctgaaggctggaaagcccaagatcaggtgccatcagatttggtatctagtgaggttctgttcctcatagaccggactttctcgtgtcattttcacatggtgaaagagtcaaaaagctccctccggactcatattataagggcagtaatccatttcacggttctgccctcatgacctgatctgctctcatgacctgatcacctcccaaagaccttcacctcttaatactgtctcattggacgttagatttcaacataaaaattttagggggacacaaacattcagactatagcatacatgaaggaggaaatatagagtgtcttaaaaggtattgtcctagagctaggtttattatatcgttgtttgtattcattgtgcacagcacaccgtaggcactcattaatattttgaagaataaatgattcaaagtaatgtcaaatatagtcaaaatcagacattatgtatatttgggagagttgtatttactctgtgaaagagaagtgaaatttgaggtgaccttcagaattatcctactaaaatgaagttgaatagcagcaagtagaaactgatgtacctataaaagcaatatattttatattaatggcaaaaaacacaattacttttgcatgaacctaatagaataggaaaaactatttggtgcaaataaagcagaaaacaataataggtagaaaggctatcccaggactagaaaggctcttctgtaggttctcaaatctcagttgtaatttctgaacaactagtttaactctttccattatggggctaggtctgtattttattttattttatttttttaggtatttccccttaatttttaccctataattactactctcactttgttctttcttccctgagacttcatagggcagaccaaattgtaatttcccttggtgtagtccgtaaaatgtttcaagacagtttttctaatgttaggagtccttttttgtcaagacccatcattgtcaatttgtaaaacttgttcctttgaatttcttgagggaaggggcttatatgcattattggaagagggagatgctcagcaactgttttcttgatcttcaggaggttacataagaaggaagagaaactgtaattgaacataagaacttggcaacattgtataatattgcagaggccttggtggtaaaggtttgagattctgtcatctgagaatttttgagaagggaccaagacagctaacagactcaagtgattttatttatttatttatttatttatttttggagacggagtctctcgctgtcgcccaggttggaatgtagtggcatgatcccagctcactgcaacctctgcctcctggattcaagcaattctcctgcctcagcctcccaggtagctgggattacaggcacccgccaccatgcccaactaatttttgtatttttagttaaaacgggggttttaccgtgttagtcaggctgttctggaactcctgaggtcaagtgatccacccaccttggcctcccaaagtgctgggattacaggtgtgagcgaccacgcctggcccaggcttgagtgattagttcagcatggtatcagtaatcctttacactctttaaagttattgaggaccccaaagagcttttatttacttgtgttctatctactttaccgtattataaattaaaatagaatttgcaaaagcatttaaaaatgataaataacataagccctgtatatgttggtatcaataacatttttatgacaaataactattttccaaaacaaaatttaaaaacttactgagaagaggggcatttccacatttttgcaaatctaatgtctagtctaaaagaagattgctaaattctcatatctgcttttctgttcagtctgttacaatatgctgtttgggttgaagtatatgaagaaaatctggcctcatgcagatatgtagttgcaaaaggaaatactttatagaccacaagaaaggatattgaggaccctgaagggtctttataccacacctttgagaaccacagttttagcaaaccaaccatgcaaagtgcagtcctcagaccaacagaatcagcatctcagggtgcttgtatttagtgtaaaattttggccccattccaggcctgttaaaatctgcattttacatagtccaagggtgattcatatgtacattaaagtttgagaagtatgagctgggtcagtaatcccttaaggtctttttcagttccatgtacctttatttggttaattaaataaaaagtaggctatatagtataataccaaaatgttatttaaataaactattgttcagtcattcatgtaaacttttaagtagcattataagtaaccaatttgacttaaaaattatattattatagcatttatatgcaattttgcattttttctgcctttttggttgttgctttttaaaaattttctttattttattttatttttttttgagacggggtcttgctctgtcgcccaggctggagtgcagtggtgcgatcttggctccctgcaacctacgcctcctgggttcaagtgattctcccgcttcaacctcccaagtaactgggagggacaataggcatgggccaccacagccggctaacatgtattttctggtagagatgggggtttcaccatgttggccaggctggtctcaaactcctgacctctagcaatccaccagccccggcctcccaaagttctgggattacaggcgtgaacgaccacgccaggcctggttgttgctttttaaaaaggaaaaccggtaaatcaagctgtagaaaatgtggaataaaaaacttgaagagtaagtccattggaactgtgctagaatccttagtttctaaggatgccgcaggtggcatgcatttgtgctttatttttcctctaagctatgaaaatttagttgtgtatgctctacagtccttaattctgcactgtccattaccatacttcttgcctaggaaatactgtctagattttaccaatctccattcccatcttctggcttctagtaaagaataaaaagggctgtggtctttgttactttcctaaaagttttcttatgttttgggtgctgagataaatgtggagggtttaaataagttcttagataatataatttatataattatataagcaatcatgatgattctgtgttgaaataggccttgaaatattgtaccttctctttttttttttttttttttttttgagacggagtctcgctctgtcacccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccggcctgtaccttctcttaagtcagcttgcaatttaaatttttagttagtaaatttaactaattttaaaatatgttagtgtctgtctgcttaactattgcatacttattaaagaaacatgcgtggttatccattggaagagatcgatcctagggcttcctgatacaaacacacccacagaccccagccactctagatttctggttttcatcccaggtctattgtgtataccctggctattagtaaccagtaaaccactctcccccttctgtagatttagtactaacttagaaaaaggatacaaagaagagtttgtatttaacagctcaggattgccttttcaggtggaagaaataggctctggagttggatctgcttcctttcaaattccggcaatgtcattgcctagctgtgagaccttgagcaaattatttacttctctgagcctaaagtatttgtgaagattaaatgagaaaggcaaagtgcctggcatacagttatcaatcagtacctaataggtatcaccattatcatcaacatcattattattaatacatatttagtagtgaaataaggtgtctctttttatgttaaccagtgacattcagcaaattgcattaatttaaatgtgcttcctaagtgtcacataaaatcaagctttaaatgggagaacaagctaacatttatttgtaatcttgtcgatcaccttgcaaagtgctttacatatactgttttaatcttttatatcatgataagtagataatgtcttcatttcacaggtaagaaaatagactcagagtttaagcattttgcctaaggacatgcaggagaaataatagtagtcagaaaccaaggttctgttaacatgatactaatacaaacattaacattattttcctttacctcttttttgttttgtttttaacctgttttctagaccgcaaggaaaactgagggtaaaaagtttaggagatgtgagtaacaaaagtctggtactgcagttttgagctctgagtaaaggttcattccccctatttaacagagaaaaacttattaattgtatgctatacttgtagtcttgacccagttgtcatgaaagtctatgccactgataatgagaagatccaagtaaaagtaggaatatatttagcaccactttggtgtgcttttaaaataataaaaaccgtagcaggcaatgatatcaactttttatatgaaggatagtgcgtttgaactggagcagtacacaagctttcatgtattcagagagtaacgagccttggggaatcgtgagtaagttaatttctttgatagagctagcttgatttggtagggagttcaaagaggcttgttttccaatgggatcatagggtatgttcaaattcctgtaaactaatggttcataactgtaagaatctggctgaatccagccctataacaaccaagttagaaataatggggatttttaattactttgtttgtgtaatttgactttgtcactgattccattagcttttggattgcaaggtttgaacattttgtctgggaaaaaacagaactaaagccattagggtaaaattccttttagtttttatataacagattgcaattcaccctacctttttactgaaacaagtgagactgattcctgattagatggtgtttaaaaagttgaaggaaactttgtatttatttctttagcagctagaatttgttgtgctatcagtgaaaatctattggaattagctgaactggttccttaataaattttgtttctatgtctatccagcaaatttaggttataattgtaaaagaaaagttccagtactagggggctatatcttaggaacattttgcatgattttcagaagcatttcattattctgctgtgatttaattaagattaaaggtggtagcattcccagtgttttaggtactaaataataattattaaatcattatttcagaattcctcaaaaaagctgaccttacttacctaccctgaatattgatctgtaattcacaaggcggtagactacagaataaaaacaaaggatatagaaagattgttttccatatttaaatacagcagtactgagttttctgatatactgtaaataacctaaatgctaaaggattcatatagatactttgtaattgctactttctctaatggattgtatgtatatatgatttgaggtataccctgaaagaagcataagactcagttgactgaaaaaagggggcagaataggaaaagtattcttgttggtagaagtgttcactaaagtattcagtgaacaagtaaccagtttgactgaacttactttggggagattgggtaaagatgtgggtggaagttaaattatgattttcacaccacttttaaaagcacaataacatggaccagaaataacattaaactagatgctggaaaatctggattctagtttttgttttaccattgattcggcccgtacttaactggagtataaattatatttatcttctaggtggtgaaggtggtgcagtgtatctagcagattgcctgatagctgttagactagatgagacactccatagtcaactagttgaattaatggattaattctcttttttttttttttttttttttttgagatatagtctcactctgtcgttaggctggagtgcagtggcatgatcttggctcactgcaacctccgcctcccaggtttaagtgataactcctgactcagcctcccgagtagctgggactacaggcatgtgccaacatgcccagctaatgtttgtgtttttagtagagacggggtttcaccatgttggctaggatggtctttcttgacctcctcgtgatctgcccgcttcggccctccaaagtgttgggattacaggcgtgagccaccgcgcctggctggctaatggattaattctaactttgacatagaattaacatttctgttatttgaacaaggaaggactcttaatctggtttattctagatctgtgatcctgtggtcatttagtaggtgtggagaactattaaccgtttttgagcagtgtgattatgagttaaatgataccagatgattggaaatggttaaatgtcagatgcttaaatggagtcagatggtaggagctagccacaatgtaaaacacaaattggagatgaagagaatggaaatatgaggcccatcttaaactggtctaggcttaaagagatgaggtattagaaatcagaactttgatggttacttttgtaatacaaaaacaatgacttgtgaggcagcaaagaagccagtaaaaacttttttttttttttttttttgcttggtcagagatctttggctgttggagaagagtaagaatactagtcacaaaaccatttcccagttgtttttaactttatctttgtgttaagagcccatagagaataatagtagtacttaaatattgtgggggaagaagcatccaatgatgactaaggtttcttctctggactatggaaataatgacacgattgaaagaaataggggaaatccagagaaaggcactgactttgagagaaagaggaataagtttagatatgtaaactgttatctgtgaatggtacttttgttgtaatatattgaaaactcttattttgatttatagaaaaggttgctctttatagaatctagatatttgtgcctacatcgtacctttgtctcctcaagccccccaaagccccctcagtttggtttatttgttgcctaatagagttttaaaactacccacatctttatatctgatggacctttgaggcaggacacgtggcacttgttttctagctctttcatttagccaagcatggtcctacacaggcttgctcatacagttaagttagaggtaggctgcacttttgcagcacacattgctgcatttctgagcaatacctgacatcctagactacttagtagtaacaaattgtgttgagccagagattagtggtagttgctttgagatagcttgttagaattagtagcatttctaacctttagatgtattacttccaaacagcttccaagccattatcttatgtactgttggtaattgaagccttagcattcactgtcttgatcaggattcaagcttacaaaattacaagggagagaggactttaatctgttacccattacaacaaagcaatgagcaatgctgtttctacaatctttgttaatgccctgaagaaaaactttcccttaatcactaaaattaaagtagtttttatttgggtctatgagatcttcctggcaaatggaatgtcttaattttgagacttttataggagggagaagaagaggcaaaaaatttgtaccacttgtgtacataaatactgttgatttttttttattataccttaagttttagggtacatgtgcacaacatgcaggttagttacatatgtatacatgtgccatgttggtgtgctgcacccattaactcatcatttaacattaggtatatctcctaatgctatccctcccccctacccccaccccacaacaggccccggtgtgtgatgttcctcttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatccttttttatggctgcatagtattccatggtgtatatgtgccacattttcttaatccagtctatcattgttggacatttggattagttccaagtctttgctattgtgaatactgccacaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagtttacagtccctccaacagtgtaaaagtgttcctatttctccacatcctgtccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcataacctttgcccactttttgatggggttgtttgatttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggctttttttgccattgcttttggtgttttagacatgaagtccttacccatgcctatgtcctgaatggtactgcctaggttttcttctagggtttttatggttttaggtctaacatttaagtctttaatccatcttgaattaatttttgtatgaggtgtaaggaagggatccagtttcagctttctacatatggctagccagttttcccagcaccatttattagatagggaatcctttccctatttcttgtttttgtcaggtttgtcaaagatcagatggttgtagatatgtggtgttacttctgagggctctgttctgttccattggtctatatctctgttttggtaccagtaccatgctgttttggttactagccttgtagtaatactgttgatttttaaaaaatgttctgtgaaagagtagtaaagtagtctaccttaatatcactgccttttaaattaggtgaacagaggaactattatctccactttaaaaacgaatttaagggatatggtccaggtcatgcaaacatagtatgtgatggattgaactgagaacccagccccagtattgtgattccctgtccagtgttcgtttggctacatattctgagtttacactttgttcattgaactcaatcccttttttcttttaaagtacactttcaaaatgattggaggaagggagtgtttttggtaaatgggtttctagtgtacatagagttaagcatccaagaaaggttttgataggtccaggagatagaaactgtgcgcaaagtaggtggagcattgagcaagtaaaaatcccattttgcttgtctaggatctattactgttggcagagaagcagaaggaatattaacagaatagttttcctgctgttgggcatgcagttttgtccatctagaataaatctgttgttggctgagtagagcaaattcctgtctgagagttggggaagcatggctagtgttaaacaagaaactgtgtttcagtctgactttgatgtctgccttccttatgctgtgggctgatgtacatcagagacattttttccttcattttcctccaataagaaatctgttttgccttttctgatggatattaaaaagaaagatttttgctcagtatttgtcatcataaattctcattgctgctgctgccctcaaaaggattgtataaatgaggtaggtaagaatttccagtatatgtaacagtttatattgtagcctttttggtgatattggtagaaagtttccaatattgaaattgttaactttcagttaaagtattgaaattgttaacttgagaatgctttaaaaatatttagagttctgtaatttagtgaatttatggtgtattctgtgtgaggagggggtaggcttttgtaaattctgaatggttagggaaaagtttacctttattaagagttaatgttaatgttaccctacgacatttgaagcatcagcttttaagaagcaagtgctggcaattcttaggatctgaaagattgcgtcagagaattctgtgttgtgactcacttttatttttctagcagattagttggcaaaacacagtatatagaattcaaatgagaagtcagcctataaaatgtgcatatgtttttgtggggtttttttagttcaaataatacaacataaaatttgataaacatttgtcttatatcggactctcaatgtgctattatagagttacagttgttcatttttttgtaccccatttaaaattgtgcagaagtggcctttgtgttttgtaatgagtgtacaatagatattcaagaaatacttatatttaatgaagaaaaataagctactgtcccatgtcaaaaaacatatgacactactgcctaaagataactcttgtgaattagaaaagtaagagaaaaatatctgtagagccagtgagttgttggctctggaggagtggaatgagagggctgtatgtccttaacaaactctagttttgttctgtgtaagatagtaacccaatttatctagcttagttcttttttcttcttttatcatgaaaacatcttgttatcattactttgttctgtctggtgcttaaaatcgtgtttaagaataatctagttcacctttcaaaaattatcagttataaaaattacattgagttctcatgtcttaagaacgagaaacctatgagtacattttaaaaactgtaactttgtatttattttaaacagctttctattacatgtcccagatgacttttctgtgggtcacttttaggatcagtgaggtttcataatcattccatgtacacatttacttttaatatacaatacctgtatatgcttgcttcttaaatgattcagaatacctcagctaggtattttaataatcctggcttattgatggttgctgactggtaaaattccttgttatatttttcagtatttaagtgggtagcattaagcagtcttaatcttttaataccagctactggactggtaaggtgtgtctcagttttattggctaacttggcacctatggtacattttttaaggcagtagtagtatctaaatatgtggtatagcattggtatggaattttctatacaaaactcttggctgtaggttgaaaaagcagcataacctaccaaatttaaggttgtattatgcacagttattggttttgctatatcttaatatcttttgcgcagtgagtattcctatttgtaaagtcatgaattcatatatgtttgcagggataggattaacaagaggattattattaaggataatcaaggatgaaagcaggttcaagaaaagattttccttcctttattatctttggtgattgcctttatactcagaggtagccttgggtcagcaaacttaatacttcaaggagctttgaacccagatacgacatttgaattcagttggacaggtgttatcattattggctagacaggaaacctgaagctcagaactacttctacttgtccagttcacactgaatgtcttttattgttaaatgtttttgtcctttcaatgtgcctatgctagattaaaacagaagaatcagtatacatttgctttgttaaattaatacatagttttattgccagtaggctacatacattcccttgaaatgtatgtgcttatggaagaaggaacttttttttttgagacagggtctcactgtgtcacccaggcgagagtgcagtggcacaatcatggctcactgcagcctttacctcccgggctgaaatgatcctctggcccagcctcctgagtaggtggacctacaggcgtatgtgccgccacaccccactagttttttgtctctttggagagacagggtcttgctttgtgcccatgctggtctcaaacagctgggctcaaacgatcctcctgcctcagcctcccaaagtgctgggactacagctttgagccaccacacctggccctagacttttaaaatgctatcaaaataatcagaagggccaattgtgttagctcatgccagtaatcccagcactttgggaggccaaggtaggaggatcggttgaacccagcagttcaagattagcctggggaacatagcaagactttgtttctccaaaaagacaaaaaattagctgggcatggtggcacacacctgtagtcccagctacttgggaggctgaggcaggaggagtttgaggctgcagtaagccacaatcccaccactgcactccagcctgggcaacagagcaagaacttatcattatctttttttttttgttttttttgagacagaggtttgctcagtcacccaggctggagtgcagtggcactatctgggctcactgcaacctctgcctcctgggttcaagcgattctcctgcctcagcctcccaagtagctgggattacaggcacccgccatcatgcccagctaatttttgtagagacggggtttcaccatgttggccaggctgtcttgcactcctgacctcaggtgatccacctgcctcggcctcccaaagtgctgggattataggtgtgagccaccatgcctggccaagaacttatctttacaaaaagaaagtttatgcagtttttatatgtttattgtagaaaactaaaaccaaatgtaaaccagaatacagttgttcctccctgtctggggagttggttccaggaccccacactcctgtggataccaaaatttgaagatgctcaagttccagaaatataaaatgacccatagtatttacatgtaaaaattatttacaatagctaatacaccgtgagtgctatgtaagcagttgttatactgtattgtttagataataatgacagggaaaagcctgtatgtgttcagtactgtgatacagttttctcttttgaattttcaatatacagttcgttgaatccacagacgtggaaaccatgaataaggagggccaactgtgctcagttttttactatcagagaatttttagtgtgtggcattcatttttttcttgcatttcctattttcataagtcttaagtttgaaataccagcttgctcaattaaagcaggcttttgcttcagcagcattattttgtcttcactagaattatatgaagataaaaacaagctgggaaaaacttaggtggagttggaaaaataagattgaggaaaatacagatagtgatctttgtagtcattctcataaatgaagcttttaaatacatgaatttaactttagggtcagccctgctacacagttccttgctgtgaaaagttagccctgcgagtagaattctccaaattgggtcttcggaataatacaatgagtaattgagcattatccagctttggatataactcttgtacttaaaagactttagagcttatcattttatgtatttcatttatttcatttagatctatgagagattacatgcatttctgtgatttattagtcactaattttgttttaccatatctgtcattgacactatagataatcagaatttatgtatatttaataacttaacttttctgaccaccccaccccaactccattccctttgttttatgtgtctgttgacttacagtgccacttgaacagcatatcagtgcttcaactcttgatccgtgtggtgacttagatgaggtcagaatagatgagatctttttctctttcaccccacctcttagacagtagcattttgttcttacatcttatgtatattttccacacattgctgttttgtttttgtttttgtttttgttttttttaaagatggagtcttgctctgtcaccaggctggagtgcagtggcttgatctcagctcactgcaacctctgcctcccgggttcaagagattctcctgcctcagcctcccgagtagctgggactacaggcatgcgccaccacgcccatctaatttttgtatttttagtagagacggggtttcaccatgttggccaggatggtctcgatctcttgacctcgtgatctgcccacctcagcctccccaaagtgctgggattacaggtgtgagccacggcgcccaacctgaaaatttatttttaaagaatttattggctgggtatggtggctcacgcctgtaatcccggcactttgggaggccgaggagggcggatcacctgaggtcaggtgttcgagaccagcctggccaacatggagaaacccccatcccatctgtactaaaaatacaaaaattagctgggcatggtggcgtatacctgtattcccggctactcaggaggctgaggcaggagaatcacgtgaacccaggaggcagaggttgtagtgagccaaggtcacaccactgcactccatactgggcaacagagcaagactccatctcgagggaaaaaaaaaaataagaaagaatttatttatactttataaagattttaaactattactgtgatgactactatgtagtatcacatgtgatagtggtaatgagttttcttctgagattaattgcagagcttgtctttcgtatgggtccaatatattacttttcattgtgttttatttgtgcaggacaatttgctcttcagttatcataccaaaacaatataaatcctcaactcctttgagtttgttaaagattactataataatataatccctgccaaactaagcatgtgaattcatgcccacacatgggttcagtgttcaaaatagttaaatgctgtattgatttatgtgtttagggaacaaggttgaacaaaagatcttctaaccaattagaacatttagctttcttttttaggcaataaattcctttacttgaaacacagcagaagatattaacatctgcctaaattttttcattgtcacatatggaagtaagtgaccctgctgtcactgttccatgttttcttgtgaagagctaagttgtcactacccaactgtgacactgcatggaccaactcctgcaggcgagtcagaaaaaaagccgggatagtaagaaaggaacctaaaagaaccttaattggaaatttaaaaaacaaagttcaaaggccctgcttttattaatgtatttctgtttatggttttcagggggtgaagccagccagttttgacaaagtagcaattcctgaagtgaaggaaattattgaaggatgcatacgacaaaacaaagatgaaaggtaagttgcctcttttgatctgggtgatacttgaacaaaacctaaaaagtaatgtgctttgagtacaacacacattctacggtgtatttaatatttgtgattggtttctctatttgtgcctgtaacatttttaaaggtagggttttgttcattgtggttattcagatttgatatactggaacactgtaaaaatatggtttggtagagtttcagtaaaccagaaccaccataaacatagctacattccatgagaactgcttacttaaaacatcagcatgatttataaaactcaaaaaagagtttaatatctaacacaggaaatcttttcttagtcctttaccattgaattctaagtggtgaaataaaactttggctctttaaagtcagctcagctattacaggtctgatttgccgtccttacgccagaattgaagaagagcaaaacatcaaaattccttgagtaaaaagagaagacttggcccaggggttggaaggagatgtggcttagtcatttgtactaacagagggcttctcttagaggagtggcaagtatctgatctgccatgtagctgattcatcacccgtcaggcatggcgaaggtccagtgtctgtttctgaaaaacagtctatctttgccacccccttccatcctccaaaaaagaaaaaggagaccagctagtacaaatacaaattgcaaattgagcataatctaccacttgaagaatgagagctatcagatgtatcaaccgaattaaagaattccatcttttcacctctccagtctcgttctttttataacatcgttatttagaagagcttaacttcatggtttttaagcctttattaagtaaaaatttagtttgagttttcatttttatatatgctgggtacttaaatctctttaagaactttttactataaacaaaggaatgtttgtttcaactcttttttttttttttggacacagtcttgtcacgtcgcctaggctggagtacagtggcatagtctcagcttactgcaacctctgccttccaggttcaagcaattctcctgtctcagcctcctgagtagctgggactacagacgcacatcaccgcacctggctaatttttgtatttttagtagagacagggtttcaccatattggtcaggcgggttgcagactcctgacctgaggtgaaccacccaccttggcctcccaaagtactgggattacaggtgtgagccactgggcccagcctgtttcaactcttgttggagcagtttattagatgattggcatattgaaaccattttatcttaagattgtttcacaatcagacttctgcttgcccagtacacaaattattgaacaaggaattaagagaacttactggtgtaaataaagcttgctgtggtagaaagtaccaaactagaaacaaaaatatttattttctagtttctatttcagcatttacagcttttataactgtgagcaagattctcaacctttctgggcctccatttcctaataatcaggagatgatatcaaattgggtgttggtcagacaagatcataaatatgaagatttgtgttacttataaaatgctatataaatgatcatgtggtattttgaagctttaatagagccaattgtgttagcccaccattactagtatactattactaataagatcattggatttaaaaattatgttacaattgtgttagctcgccattactagtatactattactaatgagatcattggatttaaaaattatcactgtcagctcttattcatgaatgagattgttatgatgttttataacttcagagtaaacctctgtaggcacccttcaaattcagcaatgtaaaaatgagttatactttcccctgtattttttcccatttttttcttctgcgaataacaataattggccacatttgaaaattattttttcaaactaatggtgttttatttttgttccttttcttttccctctgtttggaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtaaattgacattagccattttaaaattgatttagacttatatatatcaatactatcattaagcaaaaaagcagttgatgaagtgccgtgtgtggcatatcccattgacataaaattgtgatggccctaaaagttatctttgattagtgggattttcgtgtgtgtgtgttttttttttttttaaacttctttgtattgcttttataatgggtgttagattttatagtcctttttaaaagtaaattttttttttttttgatggagagagagacagggtcttgctctgtcaccaggctggagtgcagtggcctgataatcatagcttactgcagccttaaactcctgaactcaagcaatccttctgccttagcctgccgagaagctgggaccatagggacgtgccaccacacctgactaatttttgtatttttagtatagacagggtttcaccatgttggccaggcttgtctcgaactccttatgtcaagtgatcatcccacctcagcctcccaaagtgctgggagtacaggtgtgagccacttcgcccggccaaaagttatttttgagaaaatatgtagatatatatatacatagggatagatagatgagatagataggtagaactagtagaatgcattccgaagtcattttgaaaagtctgtaagattgagtgactcccagtttgtataagcatcattcattaagaatgacaagttatgtttctacatattggtacattagcctttgatcagttatctggatgaactctataaacagacataggaccatgaattgtttttactttgaagagagttttcctgatcaaatactagtaggaagcctttgatgtattattatttgaagtatgtctaaaagatcactcttccataaggaaacccttccccaaatttatgcttgccatagtgcccaaaatagctgattattatggaaagataactcagaatatctctactcggatttatcagaaccattcaaaagtggtagttgcctctgagaggagatcaggtatgagttacttatgtttaattgttagctgtttgtattgtctgagcttttttgcttttttggaggggaggagcagtgttaaatcttcatattcgtaccacagttgttttagcagattaagtagttgccttgtaaaagaaagtgaaatcaacacaggttaatgttagtggttacgtgtgagggggaaatacagtgaatagaacagagtaccttacttggtttaggaactgaggttttagttgccctattgtttcgttgtttgttataaggagtgaaggtatacctacccttcgagtttctgcaaaaatggtggtacccacccctcaagtatctacaaagatggtagggaaatgcataatgcagattttacagttcggttaaggccagtcctgagagaattctttcttcctcctcttctctactttttttacaatgccttttttttttttggcggggggtggtggtggggggtgttgttttctttcaatatactactgcttaatttacccttttattctgtaggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatgtacgtatcttgggaagtggacagataggctaatgattctcctaattggtttttttagcttcttgttattttgcactggctttttggttttgaattatgaatcctactattatacaaaatttgaaatggttgtcgtctagcttctctttattcttatatctgtgactaggagaatagaaggatggggtggtaaggaaatgtgattaggatacaaaataattttataagcttcaacatcttggaggtttcaatttgtagatttctacttttcacaatttatttaaataaaacagatttaataatgaagaatgaacaagcttggctactaaaattgaacccatcagtctggttgagctcttttagcaaagctgaatggtatatagactaaaaactaatgagaacactggttattaatttaattacttgtttaatactgagaacctcctggcctccataattaagactttgaaagctgtgtcaaatttaaggcttatagtgtttcatgctgtttcccttactcctcaggtggtaagattctgtgatagccatatggattcctcatttaaatatagaaatctactgaatatggctacaattcattttttatttagttcaaatctgtgcaaggaataactagttacccctaatataatgggtctaaatatgagaaaatgtgaacctccattttgtgatttgtctttctctctctcttttttttggcgattcatttttccttcagctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggtaagtaaatgcttaagagcatgtaatactacaatgagagccaatggatagtctgctaaattaaaattctttgtacaaaccaagtaacagtatgagtctgaagtagaaaatataaaatgctgtgtctctaaagccttattatagagtaggatatagacattaatgtgtgggcattagctgaactgcctacatgaagcagctatgtgcaagatttagattagtctgcatttttactaaagggaacgctctctttagcacttaagatgttgaaactattcacagcaacaaaagctggacatacaaatgttttgcgggtggggcgagaagagtttttcaaaagcttgttaaaatgattactaagtatttcctgtaagattccctattgtacaaaacacaggtaagaccttcaaaccattatagaatgctgcatgtgagtactctagattgagggaatcctttatttgaatgactgtttaatttagcgcttgtgttgagttaatcatcagttgctgtgtgtgttcctgccttttaaagtctgtgttggacacaagttccttccccagtatatgttcttttgctttttccctttagttggtaactgttttattactgatttattttcagaatcaacttatagaaattatttcctgaaacattttatgcttgtatacacatacacacacacaattatcctgtgttttacattagacactcttgtttctcatatagagaatgttaaagtagatcatcagataataccccatttcttttgttgacctcagaggaaaataaaatacgtcatctgcctctgaaaggtattagaaaataagtaacttgtcactgtacagcacttgtttagtgagatctttaagcagacagattttccccttctcagaaagcttttaatctaaactttgtggaattcttgctcttctttaaatgaaaatctttctctgttaagaaaatacttctgcttgttcgattttttatcctacagcttggaataaaagatgttcatttgtttcagagtccgtttaatcctgctttggctaggtctcaaaatgaatggccacagtaacacaaataaaaaactaatatactaactttttaaaacaatctactttctgtctttaaaataattgagggtagaatagaagaactttataaagactgcacagaaaatatatttctgtgttctgacaaatattacttgtcagcatttcttgtcagtttctacctttaattgttttttttctggattattataactagattttgctaagactttttttttaaaattttctcttgtctatactcatcatgggggagcattaggtctctattttagaaagcaagtagaatgacatgaagatattatttgagccattaatctagctatatttattgatgctctaaaagcagacgttcttgctttttaatgacagtattctatggaggtattatgaagaattattaaatattgagaatttaaaaatttgtctaattctattcttgtctcatttcaggaatgtggcttacaataatatggacaaattataagtgaaattttagaaattagaataaaagaaataaggctagagagaaatcaaaacaggaatgaaactaaacaatcatatgatgatatgtaaatacttggtattggtgggccacagatttggcccaaagcattctacacagccaagttttggaaatgaaaacatagtttcatagttcacaacatctaaaaggaaaataacagtcttattcaagacaacctttatggtattgatcatactgccttatagccatattaaaccctgtgcctgaacatttttttaagtttttttttttttttttgacagcgtctcactctgtctcccaggtgggaatacagtggcgtgatcttggctcactgcaactttcacctcctgggttcaagtgattctcctgcctcagcctccccagtagctaagattacaggcacccatcaccacgcccagctaatttttgtattttttttagtagagacacagtttcaccgtgttggctaggctggtcttgaactcttgacctcaagtgatccacctgcctcggcctcccaaagtgccaggattacaggtgtgagccaccatgcccggcctaaattattatttagagattcagattgaagatattctcccattgattactttgtaaaagtacaaaatatttcctatatccagttgtgaatttcttctagaaagctaaactttttcctagtagatcatgacttttttacctttacaaataaagagtggcaagtataagaaatactgtgagccaacaactttccatctcatgtcttctaaaatagaaatgagaatctttttctgaggtttccagagctcttgcaaaataatccaatcttaaaattctctgtatcttttaatgtactttaaactaatagaattcattcttgttgaatcttaagtttgccaaagttgcaagctaatattcattgttttccctgtctgcacccttcagtcagttggtcattcttaaattcatacacttgtaacacttggtgttatttcagaatatttagcatgataactgatcattatcatgatcattcattaaacctgtccttgactgacaacgcagaatagttgtgaatagttgtgatctgtcagatgtgctatgttgagttatagctctcctcaaaaaaaaaactgactttgtggaattgggagaggatggaacatttcttcatgcaactatgccctgttatcattgtacttttgtttattttgttttcacagtactgtgtttttcatgtgtgtgtttgttttgtgttgagcctcgtcgtggccgtagcatgtcggtttgtgttcccatctttctgctgttgcctctgtgtcccgcatctctcccagtgctcttccaccccaccgccagtactgtctgcacctctttctccttccctcctccggactgccccgaggaaacttttgccgaaaagctttctaaagcattggagagtgtcctgcctatgcactctgcctctcagcgcaagcaccgacgctccagcctgccttccctctttgtcagtactgtatgtaactgtaaacttctgacaaatgaacaattattaccaatgaatacatccaggcaacaagaattttaattaaaattgaataaagaacaggactaaacttggttatattatgcttctaggataccagttattcctgtaggaaacttttttgtaataaggctttaagggggaataaaaagcaaggaggtaatgagagagaatacctataatgtccttggcacataccagcatgtgtccaataaaatttacctttcattatatcttcctgtttcctatcgacataaaattctttcattttcatattctagttttaaaaggattaattttaaagttattgccttaatcaaaagcaaattttatcaaacattacccaaacattttttctcctcactttattctaaggagacactaataaaactggatgagtcctttttttttttaataaccttagtcagcaaagaataaccttggagtgaacatttattttaatttaatcatttatgtaagatgatgtatcagcaaaccaaagaactacataatgttcccccatggaagtattttttccttaggtttcaacctaaggtgggactgtagctctaatgaatgcattagatgcatatatagtatgtatgactttctttggctccattaatgtttataaaagatctatcttataaaattattttaagcatgtgggtccttgctgcttttccaaataaagaatatagttaactttctgaactagcaaccccagaattttcagatttttacttaggagaatgaagaactatacagtgttattatggctttgagacataccatgagtaaataacaataaaatgagcattctgactgaaaatagaaatccttatttagctattgtgaacagttgatctactttgccagctcgataaggatcttccctatggaagaatgaaactgaattcttttaaaaagcgggggaggctgtgatagtgaattcttactattatttacttatttatttatgttttggagatggaatctcgctctgtcgccaggctggagtgcagtggcacgatctcgactcacggcaacctctgcctcctgggttcaagtgattctcctgcctcagcctcccgagtagctaggactacaggcgcatgccaccacacccagctaatttttgtattttagtagagatgggtttcaccatgtttggccaggatggtcttgatctcctgacattgtgatccacccccttcagcctcccacagtgctgggattacaggcgtgagccaccgcgcccagcgggtaatgaattattatagtgtatattgtttgcatttggcaagctgtgtttctaaatttagtcttaaatctagaactgcttctagaataaaaagtgctatcaaataaaattggctgtcatttatattacccttttcagttgattagaacaccaggatgtcagaatcagaaaattcatggttacggccgggctcagtggctcacgcctgtaatcctagcactttgggaggccgaagtgagcagatcacctgaggtcaggagttcgagaccagcctggccaacatggcgaaatgtgtctctactaaaaatacaaaaattagctgggcgtggtggcgcacgcgtgtagtcccagctacttgggaggctgaggcagaagaatcccttgaacccaggaggcggaggttgcagtaagccaagattgtcactgcactccagcctgggcgaaagaggaagactccatctcaaaaaaaagaaaaaagaaatttcatggttatgcaactcttatttatgatcagaaaaatggacattttgtgatttaactctgtaacatgtttcatgtagtaaaaatataataaaactattaatcatctagcttgggagagataggagaaagacattactgtcactagtcaaattatatatcttttactatccaccaaaaatctcttctgatttctggttagaaggcatactattaattgataagaaaataaaactgaaggcctctaacatatcacagggtaataagaatatagggaaagttagttcaatagtttaaattaaagcacacttcttacagtatagaactagtcgggcttttatgccttgttttagttcttactcttcctttaactctttttctgttgatgtaatttacattaatgcttaagagtgaactttttaagtgtgggtaaaaacgaaataattacttacaaagtttaattcttccatttcctttgagagaggaaagttatggaaaagcagctcttatctaaagcaaagagcccacagattgatttcattggccctggatgtatttaatggatttttactatgcacataatttccagaagcattgttatttatttattaattataaatttagtgtaaccatttcatagggttacacagaactacccagttgtgcatgtctgatgtaatttcacatatgaatgtatgaattacttgtcttattcatgttgatacagcctcagtccatggcgcatccgtgtggggggaccccaacatacccagaatcacagatatttttcccaactattcatgaacgtccagtttctttttcaccacctcccacctgcccaccgaaagtagccatttcccagcggcgtaagagcacctccttcctggaagcccaaactcaccacttccaacccctgctgaggactgttggccaaagtcttcttccacctggtggcagcccaactaactggacaccagaggccgtagttatgttgggtactacagccagtagagtaactggagagtcatgtgagatacaggtccatcctatgtttgaaccatctcaagtttacagtgactatagacctggactagtacttccagaagaagctcactattttattcctcaggaagcagtgtatgtagctggggtacattaccaggcccgggtggcagaacagtatgagggcattccatacaactcatcagtactgtcaagtcctatgaaacagatacctgaacagaagccagtacaagggggccctacttcaagttctgtctttgaatttccatctggacaggctttcctggtaggacaccttcagaatctaagattagattctggattgggtccgggatctcccctctctagtatttctgcacctatcagtacagatgctacacgtttgaaatttcaccctgtctttgttcctcattctgcgcctgctgtgttaactcataacaatgagagcagaagcaactgtgtatttgaatttcatgttcacacaccaagctcctcttcaggagaaggaggtggaattttacctcagcgtgtttaccgaaatcggcaggttgcagtggacttgaatcaagaagaactgcctcctcaatcagttggattacatggctacttgcagcctgtgactgaagaaaagcataattaccatgccccagaattgaccgtttctgtggtagagcctatcggacagaactggccaataggaagcccagaatattccagtgattcctcacaaatcacttcttcagaccccagtgattttcagtcacctccccctacagggggagcagctgcaccttttggctctgacgtctcaatgccctttatccatctgcctcagacagtgttacaagaatccccacttttcttctgtttcccccaaggaaccacatctcagcaggtcttaactgcctcattttcttcaggaggatctgcacttcatccacaggttataggaaaacttccacaattattttaaactaccctactttgcaccataacatttaaattttctattccttatttccctgaatcatggattttggagaaatattgtttaattttatcagtagagtttccccatctttggggggttgtgaactacatatatgcatttaaaaacaaaatgtgagagaagctacctgatttacctattatatgtgaaaaccagtggaaaaaacacaaaaactagaattttagtcattcttcacaatcacgacttctatgcacgttattttcaaccagtagtgaaaatgcaagtgtatgtaatgtatggttgacccagcattatttaggaatacaaatcttaagtattactttcttcctccaaacaagtttttaaaaaataggataaattttttttctataaaatataaaacatggaaaatagggaatgctgtttttgaggtaatattaataatacacagaattttcattagtgtcgaaggatctaaaaagacaaagtatatcatgggaataaaaaaagatagaaaaggaaacagtttaggaatttgccttaacaaatgaaaatgcctttttaaaatggcatcagtcaagcaagttgctgtgcattattatatgtccaaataaaatgctaattcataaaattaaggactgattctaatttttagcaactaacaatctagtgagtggtgggctttttttttttgttataagaatttgtgatatgttgcaagctaaggaacagtagacatcttaggccttgtattttcctcaacaaatttaattttagttatttatgtgtatgagcatatacacacttagcaaataaagacaatgtaatgaatgtaatagaattcaaaagtacagtcagtgtttactgtttcatatattcatttggtatattttatcaaatgtgtacatcttataaaatctacatagaagactatgcagttatatattgaagacatttggatatcctacataaagtactatgtgttgttcttcctactttcttcctatgttcttccctcatcaggagcataaacaactcccaaaatgtgcacaaattatcaattatttagtgctgtactaagacacaaaaagatccagaagcttgacagctatacatgggcatgcagtatattcacatcagtattcaagttgcagcccctattataaatattaatgtattgccagtaattatcctttagactttccaaagtaaaaaataccaggtagttaatttatagacatactacagaaggaatcaatatttataatagttaagctgcagtggaatgtgatattatatccatgtaagctttaaggaaccccttgtaaactgaaatggaatgacaaaagtggtagccttttcatttcgttaacatacctatatatagtcctgcatcatttctcactttctagtgagaaacactgtagttggggtttctcagactcaacactgttgacatctgaggttggataattctttgttgtggtgggctgttctatgtattgtaggctatttagaacatccttggtttatacctcctaaatactagtagcagcaatctccctcagttgtgacaaccagaaatgtctccacatattgccaagtgcccccctgggggtggcaggattgctcctggatagcaatgatcgccctaggtacttggcagttgatgataacagattttttgatacttttgataaaagtcattgtggcactacaagaagtattaccaaattagcattaccaaatacctttctttaattcttcagataaatttcagattgatagtattaatactttgttcctgattattgtatttctaataacaaattttattatgaatctgacgattctagccagctaaaattacagcctgagcagcattgacagcttaggttttcactgtcagtgggttttgcatgggttgggatcagaacatgttgtgtggtatgatccttttctaaatttttcttacaaaagttgacccagaggcctctcccatacataatcaggttaatgtttcattttgatcaagcaaactctgaggagattaaatattcattgcaaaagcctgacctctatacacttactttaggccttctctaatttgttgtgttcacttctttccttcaggcacaggggcagagccagggtcagccatcctcaagtagcttaacaggggtttcatcttcccaacccatacaacatcctcagcaggtgagaacaatgcattgcaacattttatgaattagcagtggccagaacactattttaacttttgtgatttgttatataaatggcctgctaagtttttgaaaggaaaattaagaggcataccatgtcttgtgttcagtaacaaagaaaaaaaagagacttttctgtgtttcagaaaaatctcttttgtttaatatacttttgaacaatttagtagacatacattattactgatataattatctttttaaaagaggattctacaccttttttttgagacaaagtctcactctgtcacccaggctggagtgcagtggtgcaatcttagctcactgcaaccaccgcctcccaggttcaagcagtcctcctgcctcagctttccacgtagctgggactacaggtgcctgccaccacactcagctaatttttgtatttttagtagagacggggtttcaccatgctggccaggctggtctcaaactcctgacctcaggtaatccaccctcctcggcttcccaaagtgctgggattacaggcatgcgccacctcacccagcctggattctacacataatttacggtacaaagagtatgtcattccttttctctttttttccactgcttgcagcagtgatttgtcattaccttcattgtgcttgcctctactaatcctgcacttctttttaattatttctaatctgtagaatgatgtgtcagattttacgctaagaagcatctaatgaaaacctaagaacaattacttcaagaacatttatttatttatttatttttatttattttgagacagccttgctctgttgcccaggctggagtgcagtggtgcaatcttggctcactgcaacttccatctcccaggttcaagctattctcacgcctcagccgcccgagtagctgggactacaggcgcgtgccactatgcccagctaatttttgtattacgttctacttatgcctggctaatttagtagagatggcgtttcaccatgttggccaggctggtcttgaactcctgacctcaagtgatccacccgctttggcctcccaaagtgctgggagccactgtgcccagccaaaatattttaacttttgttttggggggcttgttccagaaagttcaaggaattcaagagattagtgtcatcctgatacatccaacagtaaaactggtaattctaaaattaaatatttatagtgcatcactgatattagttaatagtaattatttgcaagggaataatgcatttttggcataattgaatacttattagctattctacataaaatttgtagccactatgtatgtaatgcaaacttcctaatgttagttccccatgtgggttttttaatcagcaaactctaaactggcttctgtttctattagtttttggttttgaaacaaagttttcggttcttaattacaaatggccctttttcagtccaacatatggtcatgtagtcattcgatactggtttaagatcaggagttgcttgtacaagatgaaaatcacttaaaggcactttctacagaaacagttgattagtttgtttatacatgcattcactccgtgaactgaaggactgggacttatatgctttgttttgcacctgtcctttcttccaaacaagactggttaaattcaagtaaacatatttttgccaaccttaacaaaatctgttttattctattaacagttcctaattagaatgcaaattacaagtcacataaagctggttgagaatggaagtactgagtactaatctcctaacttgcttatctttggatgtagacgaacaccaatgaactgagcaaattgtatgtgctctgttttttcttttccaaaggaattggttatctgtcttgtatttggggatatgtatgtatacttactatcaaatgaagaagataataaaataattcattgagtttcatgttaagaaagagtgtgagaaaagaagagagcagtaccataaatgtcagattaaaagaattaggtagctacctctccaggagaaaaaaatatggctaaatgctatctctacagcagaaacaaaaattaatttttgtttcagtgatgtttttgttttagatacttttatagcatgtgttgtagaatcacaaaattgagccctcgatatatataggaagtgtattcggtctagaataattaacttctccaaagtcacttagataataagggagctacaaattataacccagaattcaagattcctagaatagtattgtttcttccattttaaataaagttctgcagggacttaatgattctgcaaatgtacctcagaagctgtctttatttgttttaattattggagttccacgtttgaaaaaagaaaggttgaaaactttttgtactatatggatagtctatttttagacatgatttttgttttacgtactttcaggtcccaatcccaccttagagaaccatatctcttgttttattttagtgaggaaagaaatatacttttgctaaaatttactttatttcatgcgtttcttgaacatagtaaatgaggaattgcttttttgtgtgtttttgtagggtctcgtatagtgatatactagatcttagcaaggtaccaaaaatagctgcctcctgctgaaaagctttgtgaccacaaacaaagttgtgaactttgtcagacacagtgccagctacttggaaggctgaggcaggaagatcacttgagcccaggagttcaaggctacagtgaactatgatattgccaccatactccagcctgggcaacagagcatgactcatctcaaaaaaaaaaaagcaccgaagttgtgaactacctaccctactatccataaagtctgtttgaactggtttcatgaggcaagcttgggcagagcatgatgctaaactgttaagctagaccacccctgcctggctgaagtgctgattattagtcagtgggactgcgcacagcagatcatcatgtacttctggcatatccagaggtgacacttctccccagatgctctaagatgtaacattaaccgttagccattgtaaacaactggtttagagatctctttaagatgttaatacaagggtcactgtcatagatgcctctcagttgtcttaagcaaagaaataatttgtccataaaactgctcatttttgacagtcctttcagctttttttcctaattgagttcagatactgaaggtctaccgagctggaccaggtatgactactttgaaagagtctaaataatatagtaaatatatatgtaaatttctaaaaaacaaataaggataatagctaatattaaagtgctttgtacattgtacctacattctcatttaatcgttttaagaaccctataagtatagatgctataattatttccattttactgatgggaaagctgagatctggagaaggtgagtagtttacccaaacttacagcttataagaggtaaaaacagaatttaaatccaaataatctaattccacagctcaccatttgactactacccaattatgtccaaaaaaagggaagaaattaacatctctcccaagcaggaaagggaatatcaggaagactttaggaaaaaggaggcatttgaaatggactttgattataagttagactcagatgtagaaataaagaatattccaggccagaagataaaaaaattatactgtgagcaatgtgaaaggccctaagatagaaaaatagggtacaaaaacaaatgtgcctttagtttggtttaactagagcatagatatgtgaaggtataagttcaggaaagagttgatagagtctaaattttgatatgagcataattttgaattaaggaggatgtattgggggctgggagcatatgattaccatatgcccaaagataacatgggaattcttcctcaaatttatccgttagaaaagaggggaataaccatgtattcagacctttatcgtactctcatattacagggttttcactgtcctttactttgaacaacaacaaaccaaaaaaggttaatgaaataaaatgaaacaggtgagaacaaatgtgcctgcaaagacttcagctcatgtagttagaaatgttcattgagaacatcagacagaatatttttaaggaataaacataaatttagtccttattctcagcaatatgacttcactattctgaggactgtatgtgattttaaacaactggcttaaagatctctttaagatgtcaatataagggttacatgaataaaaacctataagagaaaggaaaaaaaaatctagttttattttaatgttatgtaaataggtgcttttcactgcacattttacctgaagatacaacttagatggaatgtgttatgttatgccagaaaactgcaggagcgttcataatttagcttcagtgaaggtaaagatgctggtgtctttacctatgtagagtttgggggagagggagcagtatttctgaattaatatatttaatatgcaatcttatttacgtgtgtaaattaatgagttagataattatagatatctcattcacattccttaaagtttaaatttgttcaagttggcaaataaaaaaggttttctggttttttagttcctttttctcaggtgggaaattaacaaatttgtcttatattcagagcacctttagaattggctacatgtggtttatcttagtttgcagaaaataaatttcatgtaattcagcagccatttctgcttctttaaaagttaaaataagaatacattatcagaggccggggcgcggtggctcacgcctgtaatcctagcactttgggaggccgaggtgcacggatcacaaggtcaggagatcaagaccatcctggctaacatggtgaaaacccgtctctactaaaaacacaaaaaattagccgggcgtggtggcaggcgcctgtagtcccagctgctcaggaggctgaggcaggagaatggcatgaacctgggaggcggaacttgcagtgagccaagatcgcgccactgcactccagcctgggcaacggagcgagactccgtgtcaaaaaaaaagaatacattatcagaaataattaaataggaataaaccaaacatgactgctgttgccattatattttagcattcttttggtgattttaattgacataaatataagaagagcaaaaatattatttgtagattatcacctaacaaaatctaagacacttatcaaggtggcaagatacataataaatgtacaaataaatagcttatctttataccagcagtaaccaattagtcgtatgggtataccagcacatacgtaaaaggctgttggttgcagcattattttaagtagcaaaaatgaaacaaccaaagtgtttatcattaggagactgatgccatttagaaattaaagtagtatgctatagaacactatgtataggaaaggcatgtttttgttttgtttattttaacaaaaaaagaaaactatgtgaaaatggccacttacgcatagaaaaaaatccatgaaggttatgcaccaaacgactaatagtggttacctctggagaataggattaggggtattttcattaactttataatatgatgtactagttaaaatttttattacaagcagatgttgtattaaagaaaaaatataaattaggtattagaagatcttgaaagtcagccctaaacttcatttttttttttttttttttttttttttggagacagagtttcgatcttgttgcccatgctggagtgcaatggtgcaatctcggctcactgcaacctccgcctcccaggttcaagcaattttcctgcctcagcctcctgagtagctgggattatagatatgtgccaccacgcccggctaattttttgcaattttagtagcgatggggtttctccatgttggtcaggctggtcttgaactctggaccgcaggtgatctgcccacctcagcctcccaaagtgctgggattacaggcgtgagccaccgcgcccagcctcaagtttttatttgttagacagaaggggcagtactctaggggtcatagtcctgttttgtttggttttgtttgcttgatttattacagaatttagtattcgagtacagttatgttccatgcattaaattaggtgtataattacgcaccatgcattaaattatacttgagtccctagtacatagtagattcccaggtgtcattccctttgccccactttgagttaaaaaataatgtccttgtttcaaaaagagaaacttcatttttttaataaaataagcaatctaaggcattaacagctagtaaatattaaagctaaaatttgaaaatgtctgttattccaaatccagtgctttcctccctattttgtagctataatcaaagctattcttcaagcatattaattatacagttgataaaatagggtaaggaaaaaagattaaaggaagctattggatctatctgatataggtgccaaagagagagctgatgccaagagatagggaaaagggaatggcagggatgggatggggaaaggaactgtctggatatgttatgtaaatgtctttgtaaagacctattgttggggtgagggagataattgggtgaagagccaatggtaacttgagtattaaaagattggttaatttttcctggtggcaccatcacaaagaacatcagagggaaaacaaatatataatggaaattgatgaatttgggtttgtgcatgtcttgattactaaaatcatcattatttacagacactgaaggctttaggtaaacatgcttccttagaaacatgctgttattgatttgaaataaaactgaatcattgtattttattcttagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacaggtaaactttttttttttttttaaacaggtaaactcttaatttctgaaagggtgctaaaagggatttccatgtaacttgtcctttcatgtggatagacttctaccttttcttctaagggtaaccaacccttgaagtaggttaatctcattgcagaaatgaagtgaagatcacctcattggtgcatatgcattatttaatgtaaatgggtacgttactgacagcagtgacaatccaaagtttcacttctagtcttaccagtccaaaattgatgtaacaggtattagaaataacaggttaaataaaggtgctctggtaactgaacctatgacattccctagaattgtgtcagctatgtctgatattctaggtttgaaactatgctttattttcatgtagatttctgcactgtttactgtgtggaatgtttttttttcttaagtagtcctcctaatcacttgagaagtaccctgtagaaggtatgcttttctgaatgaccttttttcaactttatttttgagtactgttgtgcatgtatgtgcacagtgtattgttaccctaatatttcatcacatctgagatgctatcaactttaaaatgtaccatattttatgtaccacattatcagttataaagtagatcccaatttctcacatgttaaaatgatcaggtagtggagagggatgattgcatcctagaatgagtgaaatatgtgaattataccaatttttattgagccatgttggacttaagaattttagaaataatacgaatgaaatcttaattccactgggaaggaattcatttgaatttcagtaactactgtaacagcagtcgtaactttagtgatagcattatggtatataaaatatattccaataaagctgttaaaaaaaaaagccaaccccttgtctatggaagggtcctcttctattgccaaatgctgaagcattagcaaatatttctatgacaaaaggtgtagaacagtaatagtctatttagcctctttctctcctgctctcctttccatattcttatgtggcatattaacttaacactaatgtatgcagggttttgttggtttggtgtttttttttttgtttgttttttccttctttttggctaatacataaatcttgcttttggcagccttgcttttttttttttttttttttttttaagcctgtctgttttgtttttctttaccttcccagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccaggtattgtgttagttagcaaaagagggcaccacagagtttgatcctagtagatcatcaggaacatggaaatctaatagttgagtgtcagaataactagcaataacatgtcaactagagaagcaaaatagtaaaattctgagaaaggattggataatgatgttcagtgattcctgatccatttttctcaagacacttcttcagagaaaaatggttctctcagtattcactgtaagctgattgaatgctagatgtggttaatagtacacctggcaacttttacatatatgggtagaataaatagaatagccaacatggtatcaacaaaaagcttcggggtttagactgggaaaattagcatttcatgatatgactgttatgtggaagaatttttgcatttttccatttaagattggctaggaagaaattgtgttcctcctatttaaatcatctctaggtgaagataaccgacaataaagtagtattgtagagtcctgtctcttctgttggaaccagtctactacttcatttcaagaatgtggtctttatatgccctttagattattagaaagagattggctactattcttctttgctgtgtgcttcttttttttttttttgcatgtcttgctgttttgctaatttattgacccccaacctgctctaactcaccttcctcatttctgtcacagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggaggtaaatagaattactgcatgtttatatgtaaaacgtatatatgtaattggacaacaatgataaaggagaaagaaacaggctcccctggtttagaacttatttggagaccatgtcaaactaacttctgcatgactttttcttacagcagaatgaaatgccaatgtggggtccttgtttccactggctgttctgttgggaagtgagtgtgccttggagaagatgaaccctattagcacttcacttctctagctagtactttagccattattcttgtcctttcacaaactttttccattggcagtcataagagtatcttaccctcctgtgctctcagcaatcatttttgccctgctaggagaagatctgaattcatctttgtactatgctctgtctgcgctattgcacactcttggtaagatgctggctgcatggcaagttgtaggttcacactgcctagcagatatgttggctgacctcataccatgcagtctataccagagactagctttagcaacttcctttggaattttaagaccattatctctagatgctgaatattgagaatttactagtaaatttagtgcttctaggacgtagtggggagggataaggaaaaaaataagtagattattggggatagtgaatgataaatctattactaccgagatttgagttatcttttcgattcacagagtactcagggagtctctcaggttgctcctgcagagccagttgcagtagcacagacccaagctacccagccgaccactttggcttcctctgtagacaggtacgtaaaactagaattctccttccttgactggtaaataagacggtatgaaacgccaaactgtcagacctttaaatctcatattataaactgcacttttttttctttttaaatttcaaagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtaagtattcctaatttgtgagtttcatgttgttaaaggaatttgacactgaaaaagattttagaggtcatcaaatccaaaccactcacttcataaaataaagataactatctgtgtgtgacagataattttttttttttttagacggagtctcgctctgtcgcccaggctggagtgcagtggcatgatctcttctcactgtgattgcagtgcctcctgggttcaagcgattctcctgcctcagcctcccaagtagctgggactacagacacgtgccaccacgcacggctagtttttgtatttttagtagagacagggtttcaccatattggtcaggctggtttcaaactcctgacctcaggtgactcacctgcctcagcctcccaaaccactgggattacaggcacccagccagataatttatatagtactcttctcatttcatgcccacagtctctttgacttaaatatcacatttttagaaaaatgaaaaggtagttcataaagctatgatagggccagcagttaatatcatttaaatatttcttaaggcttagatgaattgatgaatgtataggatcttataattagccaaatgatattcttacattccatatttctatgataaagcactacttatcttttagaaaaagaatagagagttttagtaagtagctcaaaggctaacgtcttctcaaagatttttcttgctaccagtttaagagacaaagtactagtgctccaaggaacagcgataacactatgcttccttagacataaagtcaagtgctaatctgcattgcttttctgaaattcagtaataaagctgaatatggtctttggagatgatgtaccttttttctttttaggtttcaaataaaggagaccgagtagtagaatgtcaattagagactcataataggaaaatggttacattcaaatttgacctagatggtgacaaccccgaggagatagcaacaattatggtacgtctgcatttggagttctaggtttttccttagtacttgatcttaatagccattgctctaggcaaatatgccatattttataatccatgtttttttaaagttatgcatttacttcaatgtgaataaaactatcacacccaacctgtgatttagtgatgtttttgtctaggctatgtctaactagatattgaagttcttaaaaagagaagagctaacttgagtacaaaataaataaaaatataggtaagtatgcagataggacagaagtcataaaagtgacataaagtttgagaaatgacactaattagactgacatcacatttcttttacaggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcaggtaggttcaccactcccatagtgaaactttgttgatttaaaatattttcatagttctaaatttgctatgcaaaatgtccagtgatatcacctgacacccatgaccgacaacaaacttttatgttctcttcacatgtggcagtttgctttgcctagtcattgagattgcatttgagaatgtatttaatcacttttgtttgttgtagaaattggaaggagagttcaaacaaccaattcctgcgtcttccatgccacagcaaataggtgaatttattttctttccttgtttttacctttgacttaagaagccattagccgagggtggtggcaggcttctgtagtcccagctactcaggaggccgaggcacgagaatcgcttgaacccaggaggcggaggttgcagtgagctgagatcgcgccactgcactccagcctgggtgagagaatgagaccgtgcctcaaaaaaagcagttgtatgtgccaataatgaagtctaacaatatttataataataatgctattaagttacgtttgtttgtttgtttttgaccaggcattcctaccagttctttaactcaagttgttcattctgcgggaaggcggtttatagtgagtcctgtgccagaaagccgattacgagaatcaaaagttttccccagtgaaataacagatacaggtaagggattgattctgccacattgttatgtaaattctacagtgcctctgctatgttgaaagcttaatcataaagcagtaatttatgatgacacagataataaaaaagaatagaaaactgaagttataaccaacagataaacatatgggagagggaaatagatgaagaatacagagaattacagaaaaagccaagaagcacggccataccaagatatagtctgtataatagatattgtagtatgtgtttatttctgcacttagtactgttgtctatgttttaagattactccatattttttatcaaaaacagatatttataggagctgacttaggctagcagacaatcttttgaatccatccttttaaaatcagctgattcttatctttttgtattcctttgcagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtaaaattattgttataaaataattagataaatatgatcagttttttttctccctaatgagtacatttttcacttcagccttgtaagttagaaacatatttataaaggtacctggcttatagtatttattaaattgacagcagtttgagggtatatctacaatgaacatgagatttttttttcaagtgtggcaggattttagggttaattatgctgcacagttttccaagatggtataattatcgggtaaaatacaggtatttcttctgaattggtacaaactgaagaagtctgtatcccaaaagggagctaaatgcatctgtcagcaaaatgtacgtaaataatagcagttcatagtctttgtttcagtgagaatgaagcaaatttttggttttgttgtagattccacagttgtacagtttgggggttataaaaaattggaagttagtaaggaaattgatacagaggagaaataaataatctaatcctaggactgaagtaactaaaatttattatctaattatgctgtggtggatttcctcttgttctgccaccttctccaaataacaaggctgtgttacgtctactgtattgtatgcttcagcctctttctgcattgccattgatgtgaggttctttttatagtaggataatgcagaatcttcactcagataaaatagaaattcttgataatagtattagatttctgatgccttttgttatcagacctgcccattggttatttcttaaccagttactgttttcttttctcagaaaatcttgttttacatggcgaaagtctgatacatactgtaccaaataagtagctcaagaatatctggacactgccacttatgtacatatagcctttgttctgttctccctaggggacaactttttactgtattttactattcattttataggtatatcgtagtaacccctataataacaacattagttgtcacaccgtttttttaagacagataccagagagtaacctcagtgataaacatgtcttaactatatatattttattcttatgtttgtgcattcaaattagttgatttgctcttcagtacgcagtctttatatttagcgtctcacggacttgattttccctttgttgtctgtaggtgctgccagtgggtactgaacttccagcaggtactctacccagcgagcagctgccaccttttccaggaccttctctaacccaggtgcctcaagacttgacaaatttcttcctgtgccctactttctttgacaaagcttgctgaagttctccactacgtggtcttggcttttgcctatttgtctttgacttagtaacacctttcttttaaaatgttataaccaatgacccagttcctacttaagtaagaagcttcatagctcttttgtttgtaatgttgcttccggttatccaaaaacacttgatactaattttttttttatatcttatgaaggaagaaaacagcaaagcaaacattttgtcagacccatatagctccctttatcactcacacttctgtagaatagcgaaattgcgtatataatcaaaattaactttgagagtgccctagaaaggagaagcacaatatggcaactgagaaactttttccgcgagtccagagcaaccagtctcttcttgaatgttgatcatttctttcactagccacctaatgaaggaattagcttacttataggtaggtataggggtgatgtttcatgaaaactatgtgtgctgtctcttttaaaataaaagccaccgagctcagtgagatgctaacattatgagatcactcatggaggaactgagaccagcctcatgaacttgagattcccatctcacacagttctgctcacttgagtgcagtggtggacagaattacctgtaatatttattatttctctttcccaccgcagtccaccgccaacacatttgttgaatttccataagaaaagtactaattgtgaatctgttgtgaccaggaaaaatcttctgacatgagacaagccagtaaacttttaaactaaattaggaatttatttttgaatcatatataagaaataagaaaaacatggtaaattgcttacttgagaagctgagttggaatttatccctatttctttggtcccaatgtacaggggaacactatttgaggaacttgccacaatgaagtaaaaaccccaacagagaaagcactccatcagccaccacatttgggggaaagtgcattgtgaaagtccgtaaatcaggagttagaaaattagttttaaacttattttctcatttaaaaacatggattcagatttctaagggagtataaagtgtgacaaaaaatagcaagtgagacatgtggaggggtaagggtaaatagctagtgcctagatagagggaaaggcctaagcaaagactgtgcaagaatagattgatagaagccaagacagatgtaggattagactgtggaagggtagaaggaagctgtgtgcttgcggtggatggaatggttaacaggatggaatacccagacctccttgccaccatctgtagggaagaagtatacatgtaagaaagaggaaaataataccctgtgatagtgacagaatatgttaatgccatcttttattcataggggcaccttcccagaaagatgtataaaactgagaaagaaaagagggaacatgagatacagtgaatctaccagtagatctttgtacatttttcacaatatattttaaaggtcgcacaaataaataactctttctaccgttttgagtaacatcaaacatagaatgtaataagacttctcttaaactgcaaaaacatgaactactctgagccttgagagtctgacatacaatcttgagaaactggcaaaataatcaaagcagtacactaaatttgagtatagttttgtatgttccataaagacaaatgttatgttgtgccaatataaagcataaaacagtgtgtcctatctaaattggctatatatcgtgactctgaaggtgccacggaactgtatttactgtgattgttttcattcagtcccagcaacctctagaggatcttgatgctcaattgagaagaacacttagtccagagatgatcacagtgacttctgcggttggtgtaagttttgaaaatcttgataaaatctcctcataaccctaatatattatatgcctgggacacaaactgtaacctaaaccattattaatacctttaacatgtattcagagttcctgcttattctagccaaaagaaatgagactgattaatgaaagattcatgctgactcaggagtatcactatggaaaagattttatttgaaaggtgcttttttagttgtacgtctggtcagattgtgccatagatcaattctatggatttcgtatttttgtttcagaggaggctaaattttgtcagataaaataatgttttgggctaggtgcagtggctcacgcctgtaatcccagcactttgggaggccgaggcgggcggatcacaaggtcaggagatcgagaccgtcctggctaacacggtgaaaccccatctctagtaaaaatacaaaaaattatccaggtgtggtggtgcacgcctgtagtcccagctactcgggaggctgaggcaggacaatggcgtaaaacccaggaggcagagcttgcagtgagccgagattgcaccactgcagtccagcctgtgtgacagagcgagactccatctcaaaaataataataatgttttgattgaaactgtttttctgtgaatatccaagttatacccttaagcatcctatgagaaaaattaagaaagcaatcaagaattaagagtagaaattcattcttttaaaatgtaccttttttttttttttttttgagacaggagtcttgcgctgttacccaggctgtagtgcagtggcacgatcttggctcactgcaaccatcacctcccaggttcaagtgattcttctacctcagcctcccgagtagctgggattacaggtgcccgccaccacacccggctaatttttgtgtttttattagaggcggggtttcgccatgttggccaggccggtctcgaactcctgacctcaaatgatctgcccaccttgacctcccaaaatgctgggattacaggtgtgagccaccatgcctggccctaaaaggtgcctttctttacatcagacttttagactttaaaagaaaaaggaaagaagataaaatgttctcagacataagtgtttcatcacatatactgtctttctgcccttttacaaagaccataggaaaggcaacgaggcaaaagtttgagtgactgaagctaaagatttgtggtgtctgtctgtgtgtgttttacagcctgtgtccatggcggctccaacagcaatcacagaagcaggaacacagcctcagaagggtggtgagaaacatccttcctccttttatattactaattccagccctacccgtagttgattcaggaggtttaccgtttcaaagacacatttccacgtatttgataactgaggagcattggtagtaatatctaaagcttgaaagattagcaaattaataaatctgttccgttattatttgtcagaggaaaggttatacaggaggtaatgataagacccttcattattagctatgccagatccttgctattagagattaggaaattaaagcatactgtatttagaaaagtaaatttactgataacctcttagcttttgtgacactggatatatagggatagaagcttgaatagtctggacatatatttgtattgaaatacaaatgtaagatttcagttaatcaatttaaacatttttattttcaaggcaattatattctcaattggctctcattttaaaagtgatttgcaaatcattagaatggtctagaaatggaaaaatgaaaggggaatgtagattatcaaaatatgtagagtatcaagtatgtacaatgaaaataataaagattactaccaataaaaagagaatgtagaatatgaaaaaggtagcttttcaaatcattggaagatggaatatttctttttttttgaagtggagtttgctcttgttgcccaggctggagtgcagtggcatcatctcgactcattgcaacctccacctcccaggttcaagcgattttcctgcctcagcctcccaagtatctgggattacaggcatgcaccaccacacctggataattttgtatttttagtagagacagggtttctccctgttggtcaggctggtcgcaaactcctgacctcaggtgatctgcccgcctcggcctcccagagtgctgggattacaggcgtgagccaccgcgcctggctgaaagatggaatatttttataagtggtttagaacaacttgaaagccatctggaaaaaagcaaaggtggatcactagcctagacataagtaaagtccaagtggaccaaagatgaaatattatatcataaaatagtactatatgaaatcataaggggattttttttctttttttttttttttttagttttttaatttattagtaataacaacttgagaattgcatagtattaaggcatcagttcttggagtgtgggctgaggacccttttggggtgcctatgagggcaacactattttacagtaaaactaagacattattttcctttttcactatagacaaaaatttagccagctgtggtggtgtatgcctgtagtcctagctaatcgggaggctgagacgaggattgcctgagcccaggagttccaggctacagtgagctatggttttgccactgcactccatcctaggtggcagagtgagaccctgtctcaaaaaaaaaatcatgcatgaacaaaaaaatgtataggtcaatggattttaatggccacagttatgaatatcttattactattatttcagatcccacattataactaacttttttttttttttgtggcttggaaatcttttttttttttaattttattattattatacttttaagttttagggtacatgtgcacaacgtgcaggtttgttacatatgtatacatgtgccatgttggtgtgctgcacccattaactcgtcatttagcattaggtatatctcctaatgccatccctcccccgtcccaaggggatttttttcaactatctagagcagggttcacaaactctttttctgtaaagggcgagatggtacaaattttaggctttctagaccatatagtctcttgcaacttactcagatctcacaagtagcaatggacaatacataaataaatgagtttgtgtttcaatagaatttatttacaaaaacaggcagtaggctgaatttggtccatggatcagtttggagttctcagataagtttaatagaggtgttaagttcaatgtctaatccagaagcaagtagtaatagatataaaattttcttcatggaagaaaagtgccaccgattgcaaatataaatgaaaaactggggaaatatatatatttgtgggagggggaggggtatgtgtagtcatatcacaaaaagaactcgttttgctaatacaaagagttcctaaaattcaacatgaaccaaaaaacaatcaaaagataacagaaaaggaaacttagacatgaaaatatttaatgtccgtaatgatagaaacacaaagtaaggctacaagtgatagcaattcccacctctcattggtaaattcaggggtctaatagccaccagtgacttggtacagcctctggggggatcagtttataatagtgatgtctactacagtcttaaatggaaataattcagcactttcattgtggtatatttattgtacagatctataagagaatatttatttctaaaatagcaagaaattctgggccgggcatggtggctcacacctctaatcccagcactttgggaggccaaagcaggtggattgcttgagcccaggatttcgagaccagcctgggcaatatagtgagacccccatctctgcaagaaattttaaaaattagccggatgtggtggtgtgcacctgttgttctagcttctcaggaggctgaggaggaaggatcacctgagcctgggaggttgagattgtggtgagctgtgatggcatcactgtactccagcctgggtgacagagtgagaccctgtctcagggaaaaaagaaaagaaattctgaataatttaaatgcccatcagtagaagcctgattaaatatgaaatatatatatggtatatacatagggtatgacactatgcaatcattaaaaagaatgaggcattgatatggaatgatctcaaagatatagaattacatgaaaacataaaaatcgctcaatgttctactagctgtataaaataaatatatctctagaaagaaactcaaagcattgttccccggaaaggtttttaaattgcccaaaactaaataattctgagggctgggtgcagtggctcacgcctgtaatcccagcactttgggaggctgaggcgggcagatcacgaggtcaggagatcgagaccatcctgactaagacggtgaaaccccgtctctactaaaaatacaaaaaattagtcgggtgtggtggtgggcgcctgtggtcccagctactcgagaggctgaggcaggagaatggcatgaacctgggaggtgtagcttgcagtgagccaagatcgcaccactgcactgcaacctgggcaacagagtgagactccatctcaaataataataataataataataattctgagaactgtactatcctattctagaatttgccagtgttacattgagaaaataaaattagctggttttcatttaacaatggatcttggctggacatggtgattcacacctgtaatcccagcactttgggaggctgaggcaggcatattacctgaggtcaggagttcaagaccagcctggacaacgtggtgaaactccgtctctactaaaaatataaaaattagccgggtgtggtggcacacgcctgtaatcccagctactcaggaggctgaggcaggaggatcacctgaacccagtaggtggaggttgcaatgagctgagatcgcaccactgcactccagcctggccaacagagcgaaactccatctcaataaaataaagatgggtccttaatgtcctcagtaaaatctcatccttcatttcacttacttatatatctgaattaaagaatgagtaattgagtttttaaagcctgttaacctttgtttttatagtatatgttaatgttgtagttggtatctagtagtagagcaaacaataactcttttcccctgttggacagagcctcatggagggaggagataaggaagttctctttgcctctaacagctttcctcatgtgtagtttgattttgctgtatttctagctaaagggaaaagaagttaactggaaggagacacttatgttttcctcatccatgtatttgtttcagtttctcaagtcaaagaaggccctgtcctagcaactagttcaggagctggtgtttttaagatgggacgatttcaggtaagacagtcactttgtgttgccttgattccttcctttggaggagttgtctatataataaaattactgcctacctatttgggacacaattgccagtctagtgatttctgtcacatagtactttatagctctttttagcattttcctaataaaagtaatatatactaaataaaatatagaaatacttagaacagtagagacacggtagatagtcgtactatctatccacccacctcccaagattactttttggggtgtatttccttccactccttgttttctgtacaagtgtttatctaaaattaactaccatttctcctgttccaaatgttacagctttttttcccatccagtaattggtttacctaaccagtctctatcatcatttctcatttttccaacataataagttaagtaacagcaaacatctttgtgtataaaaatgttttccacgtttaaaataattgtcctaagattaattctttaaattaaaacacatgataccatatcactttattttaccaggttgtccaacatgtgagcattttctggctggggagagtaggtgatatttttctcatttgtaaacaggtcctgaacctttataggtgggctgagtttgtatttgtaaatacatggacaaaccagaacaaggatctggatcctcttttttagttaccagttagttgtgttgattcttgaggcataccaggcatttaacatttaccttgtagtttttcttattcacaggcaaccctaaaaattctacaatgccttgctaatttattttatttatttacttttattttatttttttatttttatctatttatttatttttgagacggagtctcactctgtcacccaggctggaatgcagtggcatgatctcagcccactgcagcctctgcctcccgggtttaagtgattctcctgcctcagcctcccaagtagctgggattacaggcacacgctaccatgcctggctaatttttgtatttttagtagagacagggtttcaccacgttggccaggctgatctgaaactcctgacctcaagtgatccacctgcttcagcctcccaaaatggtgggcttacaggcatgagccactatgcctggccctgaccttttgttatgtatatgttgactaagacataaatctgaattctgtgtatgacatcaaatacgaaagtaaattatttactttataagcgtagccagccacacagaatctgcatctcagtacccatgtgttctctatgatggtattcaatttttcttcctagtcaaaagtggaggcgctatgtaaagagacaatcagcctactctttgacagggaaataaagtgattctttttttccttttttaaattgtctgtgatagaaattggatattgagaacttaagtttttaatctttgtccttttttatcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataagtaagtatattttctcttgtgaaagaatgtcagataaggttttcagacctagatcccagggccaagattaataatatttttcgccacaatatgctaatgtctcatttcttttaaagagacagtgccacagaagccccaccccatacctccccaccacacacacacacacacacacacacacacacacacacacacacacacacacacgattcccaaccactgactcacaggcacaggcagcttctcttgcactcatacagacccatagcatttctagttctagaacttcttcattgttactatattattactgtattattgttactgtattgtattattatttttattaatagcatattgtatcactattaactgctctttatttattagtccactaaatgaatctggcactgggatgtatgattatttggcacgttttgtttggcagattgggtcagagtagcaaattcagctattgtgtgcgtggcctcaaaagtcaggaaatgtttttctcctaaaacattatcaaccatttgttgttggctaggagcttgttggaacatggcttgggtaatgcaggccagcaaggtgagttgacaaactagaatctcgtggtagtacatttggggaaaaggttcattagtaactactacatacttgaaagcaggtttaggaatatgctgttaattcttgtctgaatgaagaggattatggtattttgaattatgtttggttatctttcacagacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaaaaagccctggactaggtcagccacagctgtcctatcttttgtttctgtctccagctgtatgtgacctgctgaacatttgttgtttttgttaaatttcaaaggaatttggctctcctgatatttttgcttccttgactgctgtacttacatttattgtacctctttttgagtctatagaagtagacttagtgaatacaatggcttattccattgtaatccatattgctatctactggtaatctttatttatagttattcttaaggatagacatttagctttgcctgttaactcgtataactcacatttaaccaaactcttgggcagttggaagaaaatacattattctctgtttagtaaaacttgggtagattctttgttttaatggatgacttagtcataattgcaacttagatgaatgtaatcgtcatatagatatttgtgtgtatgtctaagtggtaacttcttgattaaggtttttatttcatttatattgggttaaagaacttgctagtcattggttaggcacggtggctcacgcctgtaatcccagaactttgggaggctgaggcaggcagatcacgaggtcaggagatcaagaccatcctgactaacacggtgaaaccctgtctctactaaaaataaaaaaattaggtgggcatggtggcaggcgcctatagtcccagctactcaggaggctgaggcaggagaatggcatgagcccgggaggcggagcttgcagtgagctgagattgcaccactgcactccagcctcggtgacagagcaagactctgtctcaaaaaaaaaaaaaaaaagaagaacttgctagtcattaaaatcaaagaaatagttaagtgatactcttttgtaatgtagtatatatatatatttatttattttaagagacagggcctcactctgttgcccagactggagtgcagtggtgtgatcatagcacacaacacaacagcctcaaactcctaggctcaggtggtcctcctaccttagcttcctgggtagctgggattacaggcacacactaccatgccctgctaactttgaattttttttttgagacagaatcccgctctgttgcccaggctggagtgcagtggcacgatctcggctcactgcattctccgcctcccagtttcaagtgatcctcctgcctcagccccgcatagtagctgggattacaggcacatgtcaccatgcctggctaatttttgtatttttagtagagatggggtttcactatgttggccaggctggtctcaaactcctggctcaggtgatccacccaccttggcctcccaaagtgctgggattacaggcgtgagccaccgtgcccggccctggactatattttaattgggatagatagagagtttctaatcctttggtgaaattatggtagtgttaacacaattagttgaaaagtaaaagaaggttaaaatatgttaaaaagcagttgcaaacttcttagcagttccattctctggaaaggttcacagatatccaaatgtagcacattagggccagttcatgcagcccattagtagagatgtgattgtaagagaaatcagctaatttctgatctgatcccaatcagatcttttttgtttttgtttttgtttttttgaggcagagtcggcagtggctcaacctccaactcccaggttcaagcaattctcatgccccagcctcccaagtagctgggattacaagcatgtaatcccaaaccaaatgtataagaacacctggctaatttttgtatttttgtatttttagttgcactatgttggccagactggtctgaaacttctggcctcaggtgatccgcccgcctcagcctcccaaagtgcggattacaggcatgagccactatgcccagctatgatcctaatcaaattctaatcctaattttgacatactttttgagtggacttgaattcaactgggaaccggggagcagagagtcaattttaggacaaccgacctattgaaagcaacctaccaaaaataattttaaacacccattgctctgtagtgacctccatcatttttgaacacctcttttgtatttgctctgatgcacgtttataggaaagtctaagcagagactgcctagcaaacctttttgtataatgattcaacacattttctaatagggtaaaaaaaaaagcaatcatggaattgcagaatggaatctgggtatccactaggtactctggtcttcttacgctgctcagacatgtggcccatctaggttttctaaagctaaaaagctctggaatagtacatatggccctattacctatggattcttttctttttttttttttttttttgagtgcagtggcatgatgtcggctcactgcagcctctgcctctgggttcaagcaattctccttcctcagcctcctgagtagctgggattataggcaccctccaccacgcctggctaatttttatatttttagtagagacagggtttcatcatgttggccaggctggtctcgaactcctgacctcaggtgatccgcccaccttggcctcccaaagtgctgggatattataggcgtgagccacaacacccagcctatctattgagtcttagtgtcattcctcacttctcccgttagtgaggactttgttcttctcatcagtttgtagcttttgacccatcattcatcactcagtggaacaaaccaaatgtataagaacagtgcctgatgagtgcatgggaagagctggacatgtttcctcatgccactttatcttttggcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggtaataaagcaaccatcatcgtccaaaaacaataaaatggagatgttgccatacctgggacaaaagcctgttaaggcgggttgggagactagctgaccagaacacagcctgtgtgttgtacactgaagaatctgggtgaaaagggaagtggagtgataatgagaatcggtgggctcactgctcccattaggtgaaattactttttttcaaggaattacagtgaaaagttacatctgtgtggcctatatgacttgctcatttgggatttggaacttaggctttaatattaggctgagatttcctggatgaaattctaaggtgttttagcagtttctgaagctaatacattttcttagccattgtagaattttgttacttttaagtatgggagtggcatactaaaatgaataaccttacaattcagttttttatccataatctactttccaaatatagctctgtttattagtgattgctgaaaaaattcccacagaggaaagagcttttagtcatattagaacaagaattgaaaagacttgggcatctgggtgagaagaatgaaaaaaatataggtactggcttatgtgcctttgccacagtttcacagaaattagagatcagtctcttcacaggaagaatgcacttgattggtaaggagggcaaactagctagcattattcgaactaagaaaagcttccgcattttgcagatgggtagaattaagacctaatatttcatctcttacatatctgaccttccccccagaagcttgttcttctgtgtgccatcttagtgcatttcaccactccagcctcaagtttctaacatcttgtagttgtgttctgtctcttctcctctctctgttctaccctgtttttcccctctcacaggctgtgcgaagtttaactgtgcatctgaacaggtgacattcaaacctggtggcaggaggacccgatttctgagtacgccctgcttggctctttgtgtgtaacacctttactccttccttgtccttgtgtttctgctgcttggatctgatgtttcacgcagtccattttcatttgtctctttttgtatatcatctactcagtggcttggctgaattactgttaccctcagaagtttgggcccccacattaattatgataaaaaatgtcaaaataacaagttatctacaaatttcaatgtaactttctggtagaagtgcttcttcatggatctgtgacagagagtggatatggtatctaggcaatagattgctgggtcatttagaataatgaagactgaactccacagtcgtagtcagtgctgtctgtctgccctagcattagaaatgagagaaatcagccagacacggtggcgtacacctgtaatcccagcactttgggaggccgaggcgggaagattgcttgaggccaggagctcgagaccaaccctgggcaacatggtgataccccatctctaaaaaaaaaaaaaaagttagcctggcatggtggtgtgcacctatagtcccagctgcccaggaggctgaggcgggaggattaccaccttaagaccaggaggttgagactgcagtgagccatgattgcaccactgcaccccagcctgagcgacagagtgagactctatctcaaaaaaaagaaacgaaatgaagaaagcattttgaccaatgatgctcttagatcctggcagcaggtaaaaattatgtaccatttttttccattctttgtcagagtagattgaaatcttatttttcttctctattaagcctaagcagctaccagttgaaaagatgctaggatctcttcattggatcattccaccactactgtcctctaaccccataaaatcaaaagcggtttttagtttggttattctgataaagcacttagtctaataaagatcaaagcccagcatctgcaagtgaaaattctccttctaacatgatttctgggattttgcagctttctacttaaaaacaaggcacaatagcaagtcaccccatcttccccatatgtgaaatggagatgatgccagtgtcctagggccatcgtacaaatcaagctaagatcatgtacagagaaacaggtagcgcttgaaaagcactcatggtttctctctgatgagtcagtgcctacctggcacagaacaggtagtcaataactgttcgtggaagaacagtttaaaacaaacaaaaacatagttcaagtagaaaaacctttgttataatttgaataaagatcttctctgttaaggcctcaaacttctgatgtgattattgaagtgctttttacatgcatgtgctcaggccatcactgtttctgagtatgggtcagaggcccttgggcctcttcacggtgggaagaatttacaacctccctttgttctctgtagtgactagatttaaagcgaagcatatgacacgtttaactgccatttccctcacacatacccctgttatttttacctgcattagaaatggattggctccttccagcacccctattatttgtacctgtattagtaatgagttagctgtacttgagaggcagtctttactgactttccccacatgcactagtcccaggctgtttaacaaagaagcgggtggaaggcattacccaattcgatcgttttccaggcttgtgtgattttttttttgaggactcagatcaataatttttctggtcagactttcctggactgtgcatattagcactttgacagttgaataagcatttaatttgcatgtccacctagaaagttgcaaggggggtgtttttgaagtagaatgtgacatgtcaggcctatggtctacagcctgaagtgtctgagagggaagaaagagaaccaaagcttctgtttctgaaatataatgtgacaaataccactttaattaaattccataaattctcatcccacttttaaaggtaggtggtattacccctgttgttcaaatgaaagtggtcagaaatattgaatcttgtcacttccctttgggtgcaaaatgaaaggccctacatccttagaagtcacatcaggatacatcatgtaagcctggtaaacaaatcccaagagacatacttgaaatatggaaaggaaacaggtacttgaaagagtagggcaccttactagcttgagatgtattattctatgctctcaaaatagataatggtttggaagcacggcttggcttactgctatatttatgttcagaggttgcttgttttccacgtacttttaaaaactattctggaagggaaggggttagtatatatatgtgggatgtggaaatataatagccaatttaaatgaacttaaagctgtaacagtgatactatcagtctactgtggtggggttgctaatgcatttaactgagtgctttttaacagcccagctggagaaacaggaagtgggacaggatcagtggaaacgctgcttgggtatttgaaattcaagcagtgagacctgagagactggagttcctcgccaattccagaacctcagtgcagggcattactcttttagatacaaagattgggtgtagaaactccacatctgtcagccacgtaacacagcccatcagataatcatgttaaggctaacagccagttcgaaacattctgtagaactatatctgttcaagggctaccaggtcctacctatctgtctcacctcctgctttctcttgctgggcgtttgtgtgctgtttggagattctaaatattttacactgatgtttctttatctttaacacattgcttctctctttgtgcttcagggaagatggtgaaaaaagtctgtccttgcaaccagctctgtagtaattatcttttctgttatttttggtccttgattgcaaagcctgttaaccatgagttctttcaactctgcagtctcatagctccctgattcctaacttccatctatctctgtatcctattctaataaatatttaacatgcttaattgagaaatcatctcctagtcggtgccctcagtgataaccccatgtgagcctagcttgtgacagacatggattggtaatggccatgggtatatatagggaggtcagggatgcctagttcctatgggagagcgatcctttggtcagcaaatatgtgccgggcagtgttattaccccaactggaaactcagcagtgacgaaagcatacaaaagtccatgccctcccacgttcacactgaagtgggagatgtgtgctagattgacgaggagaaaaacaccactttctagagtttgtcttcttagactgtggcttctcatactttaatgagaaggccacttacagtgttgtaggtagggtcaacagggaaattctgtacttgggatgttgggctgtaagttatggttcataataggttattgttagtaggatctggtgatgtgggaataggggaaatgtattataatggcaggaggaaatttaaaaatgaatcttgggggtaagtctatactacttattagggcttttcagaagaactaaaaaaggttaagaagttagcatattctctcaaaggcctttctacatcttttatagtcaagtctccttttcttaggagttaatttctggtcagaaaatgataggtttgtttcattctttaatgggaggcctgtatacagaagccagaacgtgaaggtttagctgtatggttgactcttcctcatggtttctctttcctcatagagaatcctgtattaggtaatgtagggtaaaatgaaaagtgaaatttcgttctaaaggggcctcgcagcatcaggggcgacagactagagaggtgtgtctcccagcatgagctctgtggataagcaatggtcacgcctcctgagcttcttgtatttagcttttgacagctctgctcccctgtgattatttctgttttttgttttgattgtctctcacatcaagctcaccaagcaataattgttcaaacaggatgacaatccccatgcatgtgatatgcttgctttctagattgagtcactcactgtcatgactgcccatcctcattgcctgtgcttcccacttcaccactctctcacattggctgttcatggaaggctgttttctgtgctctcatgcttctcccctcgcgtttcctgtactgtagggagcttactcttcccttcacactgtatgtgcaatagcaatccccttgtggctccagcagacaccaagaaatgagctgacactcacactgcagtagttccgtgtcttgccatagcggtaagaagcatgtgaccttcctcactgcagcttcacctcagaattagctgttactgcagcacagacctgcttgtgtgtgccattccccaggtggtaggatataagcttgacttgagaccagcgatggtcagtaacaggctttgaagtggcaggattgcgttaggtgtgctgctgtgatctggtgctgctttgaccttgaaagcaggataacgcatgcacttacttacccccgcattacttgggtaccttaaggactagtggttcacaacttactttaggagcttttatttattctgtaacacgtgagatctggtaagacagtggggggtaaggaaaacagacaagaccatgactcttctttccctcttccccaaaacgtgcctcttggaataatcttcagtgtgccctccagcagagccgaaatcaggcaggcatagactccctcctctctcatcaaaccgcagaaatagagttccttcatcataaccgcaaagcttcctcctcccctttgcaccctgcctcagctgcattttcttgtcgcttctacatgggagtgcttgctgttctgggaagagtggggagaagcggtgggaatccttgagccaattgaaactgaggtcatcttcaggaaaaccatgtcttcctgaagttgaaagattcaggcacaccatacagtcctttcctcatgaataatcttgttctttactcatgggaaattgggagaggttaacccctcccaagtttatgtttgcaaattcatgtttatgggtccaggtgaaaaacttttctgaacacagcatgctacttctcttattacctctctctatttaaagaatggctaggctgagcatggtggctcacacctgtaatcccagcactttgggaggctgacatggcaggattgcctgagcccagcagttcatgactaagcaacatatggagattctgtctatataaaaaagtaaaaaattaactgggtgtggaagtgcatacgtctagtcccaagctacttgggaggctgaggcaggaggagttggaggctgcagtgagacgtgattgtgccgctgtatccagcctgggtgacagaaaaagaagagacccttcctttaaaaaaaaaaaaaagccgggcgtggtggctcacgtctgtaatcccagcactttgggaggccaaggcgggcggatcacctgaggtcaggagttcttgagaccagcctggccaacacggcaaaaccctgtctctactaaaatacaaaaattaactgggcatggtggtgcacacctacaatcccagctactctggaggctgagacaggagaatcgcttgaacccaggaggcaggggttgcagttaggtaggatcgtaccactgcactccagcctgagtaatagagtgagactccatctcaaaaaaaaaaaaaaaggctaaagaatgtggcagtgtccaatggtttggaaacccaccttctccttatccttagccaagcatcttttcctactcctactttaaccgtgcccaatgcacaagaaaacctctttttccctgcattctgcaaaattccagagcaactagccttgctgattgtatcacacctccatcagcaacgtgatgctgggaatagcgtactggcgagcagttccaatactcttaggtgctttgtgaatggactgaaagaggcccctgcctgtgtacctaccgtcatcctgagttgttcagccttagcagcagctactgaagagaaactgttttcatcaccctattataccaaaacaaatggctaaacaaaaccttggaatcttccctcttgcatggcttcccagttcatcctcttctcattctgtggcttgccattcatcatcccgtgaagttttccctcttcctgaaattgtaacctaggcttcttttaatgctcgtattctgttgcttataataggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgaggtaagtctctcttttgccgcagagaatccgtaacacacatctgagtcaaggtgatagaaacaactaagctgctgcttaacgtcttacgccacgaccttcttcaattttaatactttagaaaaacaaggcaaaaatcccccaggtacccttttatttttccttccctgaattcctaacctcttgttggtcagctcaactttttcttcttcgtttttccttcgtcatcctcaactacacacacacagacacacacgcacatgacatccctccctctcatgaggattattttcacccttacttggtaaatataaagagccaataaatactacagaagactgttctgctgtatcttacaggattatactagaagtatatgttagcgccacacattttataccatggcccacaccagacttgacacgtggtggttttgttttcagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttagtaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 1377 - DNA, 158530 bp, Homo sapiens; identical to SEQ ID NO: 1376

SEQ ID NO: 1378 - DNA, 158530 bp, Homo sapiens; identical to SEQ ID NO: 1376

SEQ ID NO: 1379 - DNA, 158530 bp, Homo sapiens; identical to SEQ ID NO: 1376

SEQ ID NO: 1380 - DNA, 129661 bp, Homo sapiens
ttctttcaagtggtaaatagccatttattgagtattcttgctttgattgtctacgtaagcatgtaagactacaacattacgacccatctcttcaagaggaagtctggtattatggaaaaacattttgtcattcagatttttttttcttacagtatgcccatcacaaaccaggcagcaagcaaggtattgggtgctactcaatccagtgaagtcttgagggtcccttccctctgtgaagcatataatctagtggggtagactgctagctactaactatgaaaacaacatagtctgacttgagagtggggaaagtggaacaagggagtaatttttatatttttcttcacatttaaaaatattttctaaacaatccaatataatcttttctataatttccaatacaatcaacatgtattacttgtaaaataatagcatacatatatcgacagactgaagaaggtatactattagagaacatttgcagaaaagaattccacatcttttttttgagacagagttctgctgtcacccaggctggagtgcagtggcagcaatctaggctcactgcaacctccacctcttgggttcaagcaattctcctgcctcagcctcctgagtagctgggcctacaggcacgcgccaccacacccagataatttttgtatttttagtagagacggggtttcaccatgttggccaggctggtcttgaactcctgacctcagatgatccacccaccttggcctcccaaagtgatggaattacaggcgtgagccactgcacctggccgagaattccacattttaagaatatggtaaaagagttttattctcttcagtaagatgaggttgagaataaaaaattaaaaagattaagcaaatgacactttcacatcatagggtagtaataatgaactttaataatcttaaaaaaatacttattggggataagaaatgtggtttacaagtaaactgttactttctagacttaacccaagaagttaatggagtaggtgtgtttcagtaaagtaacaggaaatggtacagaaaccaccaatggtcatcatgcttgagagtcaatacagcacataattcacagcacagatgaggctgggtgcagcaattcatgcctgcaattctaccactttgggaagctcaggcgagaggatcacttgagcccaggaatttgagaccagcgtgggcaacaaggctagaccccatctctacaaaatatatatttaaaattagttgggtgttacccaggcatggtggctcacacctataatcccagtactttgggtagccgggggaggtggatcacttgaggtcaggagtttgagatcagcctggccaacaaggtgaaaccttgtctctacgaaaaatacaaaaatcagccaggcattatggtgggtacctgtaatctcagctactttggaggctgaagcacgagaattgcttgatcttgggaggcagaggttgcagtgagccaagattgtgccactgtactccggcctgggcaacagagtgagacttcaactcaaaaaaacaaaaataaataaaaatgaaaaataaaaaaatatatatataaaattaggtacgtgtggtggtgcatgcctgtggttccacctaatcaagaggcagtggcaggaggattgcttgagcccaggagtttacggctgcagtgagctatgatcacgctactacactccagcctgggcaacagagcaagaggttgtcttttttttttttttctttctgagacaggatctcactctgttgcccaggttggaaagcagtggcatgatctcagctcactgctgcctcagtctcccaggctcaagtgatcctcccacctcagtctcccaagtagctggaactacaggtgcacaccatcacatccagttatttttttttttttgacggagtctcgcactgttgcccaggctggagcgcaatggcacgatctcagctcactgcaacctccacctcccaggttcaagcaattctcctgcctcagactcctgagtagctgggattacaggcactcaccgccatgcccagctaattttttgtatttttagtagagacggggtttcactatgttggtcaggctggtctcgaactcctgaccttgtgatccgcccaccttggcctcccaaagtgctgggattacaggcatgagccactgcacctggcctaatttttgtatttttttttttagcagagataggattttgccatgttgcccaggctggtctcaaactcctgagcccaagtgatccacctgccttggcctcccgaagtgctgggattacaggcatgagccaccatgccccaccaagacaaacaaaacaaaacaaaacaaaacaaaacaaaacaaaaacagtatagatgaaaggcagccagcctgggttcaaatcctaccgttgctacttattattaaataaacgtaagaatcttatggacgttactttacctctctagcaccttgactttcaaatctgcaaaacaggataataacacctatttctttataacattgttataaggattaagtaggttaatatatgtgaaatacttagagtaatgtctggtacacagtaggcactaaataagtgttagcagccaggtgcggtggctcacaaggtcaggagtttgtgaccacactggccaacatagtgaaaccctgtctctactaaaaatataaaaattagctgggcatggtggcgtgtgcctgtagtcccagctactcgggaggctgaggcaggagaatcacttaaacccggaaggcggcggttgtggtgagctgagatcgcaccactgcactccagcccaagcaacagagcgagactccgtctcaaaaaaaaaaaaaaaaaaaaaagtatagctactattataatcctgtgaaaataatcaatataaaattaaaaatcaacagacagcccatattgcccttttttggcctaacaaaaaacagatttctaagaagacagtaagaaatcagtattaatttaaacattgtacaggacaggagatcaaaagcacaggtatacaaatggttcatttaaaaaaactgatactcaaattgacaccctgaaaatgtcagataatttttcagaatgattaaactcactaaacatctgtaaacaataaatttatttcatttcttttaaagatttaatgatatacaaaacgtatatagtatctttaagtaatacactttttctttctccccacccccaatcaatattaaacactatttaaacagcttatcatctcttgccttgtctgtatctatgagatacactactaaatacaaataagctttatactgctcccttccaaataaaaattaaaattagtaccaaggaaacaaaagaaaaagaaaaaaaaagaaaaaaaattaaagcataaaacttagatgaaaagcttttcttgttattgttgaatattcaacaatatctggggctgttaaattacattttattggcataaggttgcactgcaatctgccagtatcacataatgataatccaactgaattaatttcttaagtaccacaaacagcattcatgttcaaatgttccaacacaattttaaatatatgcaagagttcatgtttacattctgatttgatataacaatcaataaaatctttggagaagtttgtaagttctgggttgttgctatagatacagatagggaaaaaagtactttaactttcctcaaaaggtaacttcccttgacgagtgagttaggtttctgcttttataatttaggttatgtatcagtttaccatggctttcttctacttaacagtgacttgataaaacaatgtttaaaaaacccaattaacatttttacacaatttgggttctatttaaaaaaaaaaactggctctatctttaaatatggagcctaaccctgattcataaataccgtccctcttgaaaatggtcttcagttcaggcttctcatacctctgtgaacctagaattagaacaagtcatttcccttcccgtggccaacaagcatctagttgggaaccagtgatatcatcactgaacacactaaatacactgaggaaaattttgactgccatttaaccaaaaggctgcgtgatttcttcatttccctagttgaatggcaataaaacagctgccaataaaatctgcatggacacctacctttggttaatggtattgtaccacataagagagagcatcaccctcatcaaaacaaagtcaaatgagatcctctgctatacaaagagccctttaaaaagttataaatactaattatcaattacctttaaaatttctcagctgccagctctatcctatagggactttctgactgattaatcaggtcaaaagaatattgaccttttaactgtgctggagtcagcaaattcaacttgcatacacctttctatattaccaaacaatttcctcccgagggaaaagtgacacagtaacatttctgtgaggtgcaggcaaaaccaatgattcagtaatattaatattataacatcagacgaacagaattagttgattctgattctttggtggaatttccaggctgaagattcaaatctgaaggctcatcctgaggaaatataattttatcaggcgtataatcattcctcttcagatctacattgaacacccacaacaattaaaaaaaaaaaagaaagagaaaagaaaaaagttagtatttcttagaaatggagaattaggaaccttttattttcttttcaagacggagtttcgctcttgttgcccaagctggagtgcaatggcgcgatctcggttcactgcaacctccacctcccgggttcaagcgattctcctacctcagcctcccaaatagctgggattacaggcatgcaccaccatgcccggctaattttttgtatttttagtagagacagggtttcaccatgttggtcaggctggtcttgaactcccgtcctcaggtgatccacctgcctcggcctcccaaagtgctgggattataggtgtgagccaccatgcccggctgaattaggatcatttctaatcaatttttctccaaacatgtcagacttgttttccatcaggttgttataaattcagtagtcaccaaatttatacacataaaaatgaagtcattcattcattcaacaaataattacatattgaccatgagtcagaaactcatgtaggcgtgggaatgtagcagtgaacaaaccagacaagctcactggtctcagtgagcttatattctagtgggtgacaaaaaataagcaaacagaaaaatgacagaattataagcagtaaaaagtgccttgaaggcagggtgcagtggctcatgcctgtaatctcagcactttgaaaggccaaggtgagagaatcatttgaggtcaggagttcaagagcagcctggccaacatggtgaagtctcttgtctctacaaaaaatacaaaaattagccaggtgtggtgatgtgcgcctgtagtcccagctactcagaaggccgaggtgggaggactgtttgagccccagtaggcagagattgcaatgacccaagatcatgccactgtacttcaacctgggcgacagagtgagatcctgtctcaaaaaaaaaaaaaaaagtgctttgaagagaagagtgtagtgaattataatgagggacagatggaagatggtatagggtgattgtttcaaacaggtctgggcaggaaagccagaggaagagatttgagtaaataccttaatattgagaagtgaactatcaaagctctaggaggagtgttctaggcagagggagggttaactgcaaagactgtcagaaggaatggacttagtgtgctttgcgaatggtaagaagacagtgtggcttctacatagtgaatgagaggaaaactagtagaaattgagctcaagcagcagttaatggcccaagattgtcaactacagattgtgggccaaatctggtctgttgcctgtttttgtaagtagttttactggaatgcagtcacactcatttgttcacagtctgtggttatttccacaccacgacggtagaactgtgtagctgggacagaccacatggtctacaaagcctaaaatatttgctaccttgccctttacagaagtttgctgatcttcatttatacatcatagatacaagctatgatgagaagtacagatacaatacaaatccactggaaggttttaagcagtctcaagagaggaacatcatcagatttgtttcaagaactattctgatgactatgaaaactcttgtgagaggatgggtggcagcagtccaggaaacaaggtggtagccatgaagacagagaagagcagatgaattctagggagatttcaaaattagaacagacagaatttgatgaattggctatgaagggcaagggaaaagaagaattggatagttttaggttttggacttgagcaactgggtaaccattaataagatagggaaacagagttctatgtagggtgggagatataaatcaagaattttggattggacacgttactaaagatgctttatagcaagcctgcccgaccctcggcccacaggccacatgcaacccaacacaaattcataaactttcttaaaacatgatggcatttttttgcatttttttaagctcatcagctatggtagtgacagtgtattttatgtgtagcccaagacaattcttcttttttttttgagacaaggtcttgttgttgcccaggctgaagtgcagtggcacgatctcggctcactgaaacccctacctctgtggttcaagcgattcttgtgactcagcctccccaagtagctgggattacaggcctgtgacaccacacatggccaatttttatatttttagtagagactggtttttgccataattggcaaagctgctcttgaactcctggcctcaagtgatctgcccacttcggcctcccaaagtgctgagattacaggcatgagccatggtgcctgcccaacaatttttcttccaatgtggcccagggaagccaaaaggatggacccctctgcttcagcctgggtgacagagtgagactgtctcaaaaaataaaataaaataaaataaaataaaataaaataaaataaaataaaataaaataaaataaaatagtatccaagtagaaatataggtagctgaacagaaacaggagcttgggaaatatgtcaagtcttcagacagatttgctatgataagtacataaacatatttataggtatgggacaagaagaaatcacttaagaagttacagacatagatgaaaatagttgcagaactggaaacaatgcagtaatatcaacattataaactaaccaagtcatgcattaacatatatatatgtatgtttttatttttttaaaaaaaaggatacacgtgcagaacatgcaggtttgttatataggtatatgtgtgtcatggcgtaaacccttatatttttatctccatataaaatataactgatactcagaatatgaactaatttattttttaaaaaataaaaatatttgacctcactgaatcataaactgttaattttaatctaagaaacagcctatattaaacaatccaaacatatttgcaactatattaattatttttgataaattttaaattcaagactatgtcagtatggctttagggatataagctaatctgcgattactgtacaaagaacagtggagagaaacacaattatagctcaccttaattatattgttaactagtaagtgtatcaatgagcaaatcatctcaactttaattatattatctagaaaatgaaggatctgggccagattgctttttttttttgagatggagtctcactctgtctcacagtggtgcaatctctcctcactgcaacctgtgcctctcgggttcaagcaattcgcctgcctcagcctcccaagtagctgggattacaggcacccaccaccacgcccagctaatttttgtatttttagtagagataggttttcaccatgttggccaggctggtctcgaactcctgacctcaaatgatctgccctccttagcctcccaaagtgctgggattacaggggtaccgtgctggcttaaaaaatggaaactgtttaaatttaaaacaaaatcaagaacctcagtatatgctgtctacaagaaacccaccttaaatataattatatatagatgtgtgtgtgtatgttttgaaaaaaagactggcaaaaggtatatgatgaaaacattaatcaaaagatagctggagtggttatgttaatattagaaaaagtatacgtcaaaataaggaaaattaccatgatattattaatacacaatgataaaataatcaattcgccaagaagacattaacaatagtatatgtgtatgcatctaagaacaacgcctcaaaacacatgaaggaaaaactgacagaactgaaaagcaagacagacaaatccaattatatttggagacttcctttctagttaatcaatagaactaatacacagaaaaccagcaaggatacaagaactccgaacactagcaacaaactttaattaatatttacagaatactccatccaacaatagcagaatatacattactttccaaagcacatggaatgctcagagaccataaactctttttgtttttttttttttgagacggagtcttgctctgtcgcccaggccagagtgcagtggcgcaatcttggctcattgcaacctctgcctcccaggtcccagtgattctcctgccttggcttactgagtagctgggattacaggcacccactgccacacccagctaatttttgtattttttagtagagatggggtttcactatgttggccaggttggtatcgacctcctgacttcaggtgatccacctgcctcggcctcccaaagtgctgggattacaggtgtgagccactgaacccagctccataaacttgtacttcaattaaaaaaaatttaattgaaatagtacaaagtatgtttcttttataatagaattaagcaagaaatcaattaaagacatttgtaaaattttaaactatttaagaactaaacaagacaatccatacatcaaagaggaataacaactgaaattataattattttaaagtaaataaaaatgaaaataaaatatactcaaatttgagggatggagctaaaacaatgcttagagggaaaattatagcactcaatctcttgttagaaataaacatctgaggccgggcgcagtggcttacacctgtaatcccagcactttgggaggccgagtcgggtagatcacgaggtcaagagatcaagacaatcctggccaacatggtgaaaccctgactctactaaaagtaacaaaattagctgggtgtggtggcacgtacctgtagtgccagttactcaagaggctgaagcaggagaatcgtttgaacctgggaggtggagggtgcagtgagcagagattacgccactgcactccagcctggtgacagagtgagactccatctcaaaataaataaataaaataaagatccgagaatcaataatctaagtttctactttaataaactagaaaaagaacaaactacacctaaagcgagtataaacatggaaaaataaaaagaataaatcaaataaattgaaaacagaaaagcaagagtaaaacaatgacaacgaaaactgattctttgaaggtatcaataaaattgataaacctctagccaggctgatcaagaaacaaagagcacagaccaaactgccataaggaaaaaggggatttgccacagacctaacggatattaaaaagatagtaaggtaacagcataaataactttatgcccccaaatttgacaattaaaaaaaaaaatggaccaattccttaaaagacacaaactaccaaaactcactcaaaaacaatttgataatcaacagtcctatctctattaaagaaattaaatgcttagtttatttttttattttttatttttaaaattattttttattattatactttaagttttagggtacatgtgcacaatgtgcaggtttgttacacatgtatacatgtgccatgttggtgtgctgcacccatcaactcgtcatttagcattaggtatatctcccaatgctacccctgtcccctccccactaaatgcttagtttaaaaccatgtgacaaagaaaacttcaggccaagatggtttgactggaaaatcctatcaaacattcatggtagggacaatatcaattctatacaatctattcccgaaaataaaacttattttataagtattatcctaatactaaaagaaaacaaacatagtgccccataaaacaaacctaccacagaccaatattcttcatgaacacagatgcaaaatcctcaacctattattgaaaactgaatctaacaataaataaaaaagatatgtatcacaacaaagtgtggtttgtcctaggaatgcaatactggctcaacattaaaaaaatcaatcgatgtaatacactatattaacctattaaaggagaaaaaccacatgatcataccaaaagatgcagaaaaaaaaatctgacaaaattcaatatccattcaagataaatattctcaagaaacaaggagtaggccgggcacggtggctcatgcctgtaatcccagcactttgggaggccgaggcaggcggatcacaaggtcaggagatcgagaccatggtgaaaccccacctctactaaaaatacaaaaaaaaattagccgggcgcggtggcaggcgcctgtagtcccagctactcgggaggctgaggccggagaatggcgtgaacccgggaggtggagcttgcagtgagcggagaccacaccactgcactctagcctgggcaacagagcgagactccgtctcaaaaaaaaaaaaaaaagagcgagactctgtctcaaaaaaaaaaaaaaaaaaaaacaaggagtagaaggaaatttcttcagcctcataaagtgcatctacaaaatccttaaagttaacatcatcttaatggtgaaaagacagaatgccttccccttaacatcagaaacaaagcaaattatgtttactctcactacactcattctatactgtgctggaaatccttgccagtgcaaaaagtcaagaaaaaaaaaaagatacacagaaagaaactgtctttattgtctatacaaaaaaaatcctgagaagtctattacaaaaagctcctaaaaaagagttaagtaaggttgcagggacatatgctcaaaaaaatcaatggcatttctgtataccagcaataataaaaaacaaattttaaaaactagtaccatttacatacctaataatgcttattatatggctggtactaagtatctcacaaaaccaactcattaagtcctcaaaaactccttggtgatgtaggtattctctggagccatgcatcctggctcttgagtctaagctcttaactattacaatactgggcatacgaagtgggactttcaaaaatacacaagggctgggcgtggtggctcacgcctgtaatcctagcactttgggaggctgacgcaggtggatcacttgagcccaggaattcgagagcagcctgggtgacatggcaaaaccccatctctacaaaaaaaaaaccaaaacaacaattagccaggtgttgtggcacgtgcctgtagtcccagctacttgggaggctgaggtgggaggatcacttgagcctgggaggtggaagctgcagtgagctgagatcgcaccactgcactccagcctgagcaacagagtgagaccctgtctcaaaaacaaacaaataaacaaacaaacaaacagctcaagggtgggccccagacatgtgtaattttttttttaaatttaatttttaaaagagacagggtctcactatgttgcccaaactgaagtaggcactacagctttgaactcctgagctcaagcgatcctctggtatcagcctcctgagtagctgggactacaggcatgtgtcactgctcctggtaggggaatttttttttaaagttccacaggggactatgatgcacatcaaagagagacaaccacaggtttgtgctttaactaacaattaaataataacttgtaattctctgcatacaaagatgatgttaatatcatgagacaatatatttacagttcctgttcctgcttgatcaaatagccttttctcaattcttctgcaaggctaacttgaaggtctattcattctccaagtaaaggcaaatacgttagtttcccaggatcattcccggacctgggtttgagttaagggacctgcttacatgttctatagcactctgttctgttttttcctctctcttggcatttatcagtcctgtaactccctgctaatcttgtcaatattcaacatgaggctaaactccatgagggcagagacatagctgtctggttcaatattctactttcaacactgagcacaattcctggcattctgcagacacataatatattaaattaatgaactttgtataaagaaagaaggaaaacacagattcatttataaccaacaatatgtatttgcaaaagagctgctgaagctggcacaattagagaccattacattaaacatttgtacctctggccttatgaggtattgtagtaaccaagtttcgtaacaatttatatactatactgattaagaaattttttacctggaagtttaagctttctacagcaagaattacagtgatgttttgctctgaagtttttaattgcatcttctcctagatttgctgggccaaaaaccatatcacaggatctgtagaattggtaattttaaaaaaaacaacaaaaaaaagggggcagtttatacaggtacaaatataaaatgtgaaattatgccttaatgaaatagttaaaacttattacctcttttcttctgcttttatcacagatgggtcagtcaaattttcaccaacacctttatatgtgtatataaaaaagacaaataatttatattatataattgacataaatactgacatctgcataataaaaatcatcttaagagatgttatagtatcatcaatcattacaatgttaaactattcaaaggagtgtagttcttctcttttgatatttcataacttgatttatgactctggcattctaccagggagaggcatatctccttgtaatgtgaacaagagttaaacgtcagagttggtaggtaggcattaagttccttatcctacagcaccaaggatgcaaatacctccttacttgtaaaaggtctggtcaatctgcccttgtttcatcttagttagcaaagaacaatttggtacatgaaggaataatccataggactttaaaagtgtttgggattggccaggcgcagtggctcacgcctgtaatcccagcactttgggcggccaaggcggatggatcacctgaggtcaggagttcgagaccagcctgaccaacatggtgaaacttcattcctaaaaaaaaaaaaaaaaaaaaaaaaagttagccggacatggtggggggcgcctgtagtcccagctactttcgggaggctgagacgggagaatcgcttgaacctgggaggcggaggttgcagtgagccaaaatcgtactactgcactctagcctgggcaacagagtgaaattcgtctcaaaaaaaaaacaaaaacaaaaacaaaaaacaagtgtttgggatttaagggaaaaaaaccacacacattaacacatatcacattttcttgcaaaacattcatgtaacacagagtaagattgtgaaaatctttcttcacctccagccctctccagaagtattatgattaaatccttccagtctcttacatattcatgtgtgtatatataaacacatacacacacacacttaacacctactgatattttgaataatcacaaatatttaacccattagagcaaaatctaataaaatggttcaatttcacaaaaggaaaaaccagaattaaaacacgatactattttccatccaacagaatggcaaacattaagaatattccatactggaaagactgtagagaagcaggaacttccgtagaaggctgagtatgatttctgataagcttttgggaaagtactctggcagttgttattaaaattaaaattgtactaatctcttttctacaccaatttaggaacttactttaaggaaataaaagtagcagtgcatgagaatggtttgctgcaagcactgtttgtagaagcaaaaaactaaaagtagagtgaatgtttatcaacacagatgtaaatcatgctatagctgctacactatagactatcacgcagcttactaaagaaataactctagaaaatgcctatgatatatcgttaggcagaaaaaaaaagtggaaaaaaaaaaatctcatgatcccagttggggtaaaaccaacacaacaaaacaaaataataaaaaagagggaaaaaagtctccgtttgtgtatatgtcttcacagaagtagagaaataaaaaagatgggaacactttgttctttatatattgctacattgtttaacttgtaatcatctaagatattcctatgtaaaaattgttcaataaacattatgttgagatggaatctactcggtgaagataccgtgaacattgttcaaatcacaagggatttagaatatacataaactttgttgataaagcagcagggtttgagaaggttcactccaattttgaaagaagttccactgtgggtaaaatgttatcaaatggcactgcgtgctacagaagtccttcatgaaaggaagaatcaatccatgtggcaaacttcactgtggccagagagtggctcatgcccgtaatcctagcactgtgggaggactgcttgaggccaggagttcaagactagcctgacccacctagttagacacccatctctacaaaaatttttaaaaattagctgcatgcagtgacgtgagcctgtagtcccagctatgcaggaggctgaggcaggaggatggcttgagccgaaggagtttgaggttgcagtgagttgtgattgagctactgcactccagcctgggcaacagaaagagaccctgcctctattttttaaaaaagaaagaaaaagaaattgctgcagtcatcgcaaacttcagcaactatcagttagcagtcatcaacatggaggccagatccttcaccaggaaaaagactacaacttgatgaaggcttagataattcttactattttttaacaataaggtatttttaaattaaggtatgtacactgttcttcatacacaatgctatcacacactttagactacagtatagtgtaaatttaacttttatatgtactgcaaatccaaaaaattcatgtgatatgctttattgcaatatttgcttcgttgcagtagtctggaactgagcctgcagtatctctaatgtatgcttgtaatttttaaacttaactggattggcctaactcataatggacatcagagagtttttcacaacatacaccaccataatcatttttataaaggtatgaactactgaaaaaagtatagttgtttttacatagattttcattcttgagctgaaacctgtttgcttttcaacaaatcttttatatttatacctgtacactaaagagtcactgagtaataaacattctaaacaattgttctcatgtgatttaaaatctggtctgtgtttacatttgaaattaagtctgctcttcagggagaaaaattatggaagccataatgaagagaagagctggcaacttgctcaatttaacttcctttgactcactgtgaagctcagcagacattactccaagcaaacctgccctcttgcagtcaccatttcttttttttctttcatatatatgaaagtcttttttcttttatatgtatgaaacacagtctatctgctaagatggctatgagcaatttttccctctatagatgcatatcgttctacccatcaactgctgaatctacttcgcctccccttgaatgtgggctacccttgtaagttgccttgatcagtaaaatgtggcagaaggcatctcaatcctgggcctagccttaagaggttctgctttctctctagaagaagccagctgctatgtaagaagtctaaatacctgaaactaccatgctgtgagcaagcccaagctagctagccatgtagacagagaacactgaagaactgaggaatttagttgacagtgaacagagacctcagacatttgactccagtcaagctgttcaatgtctccagccattccagtcttttgaggtgacagcagagagagacattcccactatgtcccatccaaatttctgaatgaaagaactataaggaaataaaatggcagttgttttaaatccactaaatttttaggtagtttagttcacaataacaggttaacataaacaccaggaacaatagaggtatttgttatttttaaagaaacggtctttatacttttgaaatactagactgcatatcttagaatagggaatttttacatgtttttgcttatcaaaacatctgtattatcttaaccataatttagatagccaggccgggtgtggtggctcactcctgtaatcccagcactttgggaggctgaggcgggcagatcacaaggtcagaagctcaagaccagcctggccaacatggtgaaaccttgtctactaaaaatacaaaaattagctgggcgtggtggcaggtgcctgtaatcccaactactcgggaggctgaggcaagagaattgcttgaatccgggaggcggaagttgcagtgagctgagattgcaccactacactccagcctgggtgactgagcaagactccctctgggggtgggggagggggcgggggaacaaaaaaagatagccagattctattactcaaggccctgatggctatatgctatgactgtgattaacttgcttttttatagcttctattggcctaagattttatttatctataaattagcagattctgtataacatatgaataggtgagaacctactgcagaatttcaccttagcaatattttaataaatttaccttgcaaatcaagtaccagtaactcccctcttgtatattcgtaagtccagtggctaaaggctagcatgatctcttccagagtattagttggaataatctcatctccattattattgttgtattttctaaattctccagtcatacattcttccacagcaaaccactgtcctgctgaatggcaatacagcaggaaaacttcaaggaaccttataaaaaatagttataaatattactagcagttttgttaataaaattctaattgatctacaaaatggataattaaatattcaacatcaaaaatgaaggtcaaaagggactgctatccatataataaaagatcccagaaaaaaattaaagatttaccttggagaatatggtatggatttgggtttcatttgattaaaggcaaacgtaagcttttgtgctgctctctgttgttgaatttcctataaaagggagggtggggagaacccttgtttaatatttaaactaagattatatttggcttattgatatttcagaagttaaaatataaagcttaaattatgttccactattaaatattcactgacacttactctcagacagagatgcagaactgtatcttctttgtaaatacttgaccatgtattaaccacctctggaagaaaagatttgataatataaagatgccctgatttgaggatatcatgttctgaccaggtacactgtactttgacagctcttcgtaaacctcctcccatctcctctttgcttaaaaactctattttggcacagaggcctagttgtgaccaagaagacatgctgttatttagtatgttgggtgaactctcttccaaacgatacactgtgacaggctcccctgcaacacaaatggaaaaagtttaagattaaattgtgactttttaaaaacgacaaagtaaaataaaaattagcaggcatctttgattaaggaacagaagataaaatggaccaagatgtagttttatacaaagaaatttaatagcaataggtaagaaatcaaggatactttcataatatctttgaattcatgtgtaatgttaggcatttttgaaattctggcattttagagaaaacctttaaaaaagcaactaaaattctacacacttctgaattaaacttagaagttagagctgtttcatggacactgtgatgtcagtttatataaattactagatagtggatcaagaactttttagaattagaatatattgttgcttctgaatatgccagtaatggagaaactcaatatttctgatgcttcccttcttctattcaaacatacctcacccttgtggtagtcagattaatcaagaatttatttgaaattgatacttcttaatgtaatcccacccacattctatattatagctaaaaatcattaaagggttaattttcacttatttatttctttaatttttggatttacctcttggaggcacaggtgtaaatggaatgctctgtgataacctcatcaagttatttctttccacagctgcataaaaatgagagagaaataattaaatctgtaaaggtccaaaatgctattaaattttgtttttaatattactgacctgaataatagtaatttgtatccatagctggcttaaatggagaagtgagacctagaatggcaaataaacaaacgagaccatttaaaaagtactagtacagcaaaaattttaacccggataatctcataaaatcattttgaatttccatagtgtaactgttcctcacaaaaacagaaaaattagggataaaatatgtccactgtgctatattaccctatttcattatgccagattagtgacagctgtgcatttagacacctacaagtgaagagcacattatgctgcacactatcctaactcctgccataaactcactcctcccatacctcccattcagaaagaaaaatctctctttgattctgatgtttgggggttggggactgtagccatgtaaatattttagcaggtctaccatgagaagatgaacttctggaatgtgaaacatacccatcaaaagcccttcccccatctttttgtgtgtgtgtgtggaattgacctttaaatgttgcaagaagacaaagacaagtcaaatctgctatgtgctaagtttctagaacacaaataaaaagaaacctactgtcttgcaggaaaaggaagttagccaacagttttaatactgtataaaaatatactttaaaaatgtgtatatacacatacatgtgtgcacatactgtacgactatataggagtacctaatgccttttggttgagaagacgtcaaagctatctcagagtaagagaagggggaagattgacctatagtgctttttggacatacatccacccagatgtcactccaaaatattctaattctgtaggtatgtgtcatcatagaaatgattctctacaaatgatttgaatatgcagctaagactacaaattaatgggcaagagtacagggataactgcaggaggtgaagctacagaaacagggaatatcaaattgttaagaggaggccaggcacagtggctcacacctatcatcattaacactttgggaggctgaggtggaaagactgctttggggccaggagttcaagaccagcctggataacatggcaaggccccattatcaacaaaaaagatttttaaaattagctgagcaaggtggcacccacctgtagtcctagccactcagaaggcagaggtgggaggaatgcttgagcctaggaggttgaggctgcagtgagcaaagtctgtgccactgcactccaacctggtgacagagagatcctgtctttggcaggggagggggcgggaggcgtggaattaagagcctaaagtgtgtgtgggggggtaattaaaagcctaatatgtcatgttaaggaagaacactggatttcattaaacaacaatggggaaaaaatgtaaagtggaggagtgacctttagaaaaatcaggccaggtgcggtggctctcgcctgtaatctcagcactttgggaggtggaggtgggcagatcatgaggtcaggagttagagaccagcctggccaacgtggtgaaatctcgtctctacagaaacacagaaattagccggatgtggtggtgcatgcctgtaatcccagctactcgggaggctgaggcaggagaactgcttgaacctgggaggcggaggttgcagtgagccaagatcacaccactatactccctactccagcctggacgacagagcaagactccttctcacccgggggcagggaagggtggcagaatagaacattgatgagaagcaaaactacaggcagggaccccaaactggtataaccactctgaaaacctatttggtagtaattaccaaatgtgaacacatgctaactctgactcagcaattccactcctaggcatatgccaataataaataaatacatatgtttatcaaacaacatgaacaagaatgcttgtagcagcaagtcataatagccatacagtggaagctactgaaatgaccaccaaatagcagaatggaagtaaattcaatatatttacataagaaaattttatatagtagtgagaatgcacaaattaccactatccacagcaatattgatgaattttataacaatatgttaagaagaagaagcaagacacagaacagtatatactgtacaatttcatttatatagccaatatgcacatacatgcaaacactcacacacgcacatacaccccaaaataggtgaaactattgttttaggggcagggactataagaagtagaaacaaaggaatggagatataggcaaaattgtttttaggtgctgattacatggctatacttactttgaaagaattcactgaattctgcactattctgtatgcactatacacttcgataaaaggttgacaaagtaatggtctaagctgaaagcagcagtgggatgtatagtggaggatggattttagagacatgtaggaagtaaatgcaataggactttgtgagtacaaagtcaaggtggtcaagaataactcagctgactaaaagtttcatttgttaaaacagatggaatattagaaaaggagcaggctgtatagcagagaccaagtagcagggaggaagtgtgacagtaaagatatcatcattcacagggtgattcgtgtgtttgtgaaacatctacagtaaggagaaagtatatgagggaagaactcttcaataccttggctttttctagcttgaagtctaaaatatcttacctagaataatgtggtgtttgctgtaacagatcatgtaagattctcatttttttcacgttcaatctaccacacagactcaccatttaatgttccttcttcagatggcctaaagaaacaccaaaaaatatagtataagctgtgctatgatttaagttttggctatcatttaattttttgattttatacaattattatataaaaaatattattaaggaaattctgaaattgattccctttgaatatttgccatttcccttaagccaatcccaatccatatatagatatatatatctatatatatatatccatatgtatctacttattaataacttgtatctccaatttatgcataaatattattagcagtttggtgccaaattgaaggctctatactaataaactatttcataacttctgtattcgtggagattcattccagtactgtaacaatacattgagatgactttgcaggatgctagaaatatttcaatagaattgatggacaaagaactgagagaaaagtaagtagatgtcattttgcctcttagtttctaatgttgaaaaatatttctcccaatgttaactgtatttatttataacaacatacactggcaccaaatgcaggttcttttacttccaaggattccagtgtcaactagacacacaggtagagtggaaaagagaacagaatgagaataaaggaaaacgggttagaggcttagcactttcattacacagctatgtagccttgctcaggaatgaaaggaccagatccagaaaggaccttgggagtagataacctgtctctttccagctcctacattctatctgaccctgttgtttcctgttgattttcaccttaatagaaacattttcttacaaaaagtattttgaacctaacatcattcctttgcctgctgctaatcaatcactcttttctcagcactcaaagggctgccaatcagctccacctttatgggtaattctcagggtcagcattctgcaagacaatgttctgttgttagacaccggaattaacaccaacttgaagtgcctattttgtacttacatcccatggctttggttataaaagaaaatattccttgaagaggtctgactataggtgggccttccaaatgccattccagggtcaggaaactcaatttgagcagctgcttatcctgtggcccaggtttattttcttctttatatattcagatttatttattttcttttttaaaaaaaattatttgttttgagactaggtctcgctgttgcccaggctggagtgaagtggtgcaatcatggctcactactcctgcgctcaaacaatccttctgcctcaagcctcctgagtagctaggaccacaagcgcacaccactatacccagctaatttagagatggggtctcactatgtttctcaggctggtccccaacacctgggctcaagcgatccacccaccttggcctcccaaagtgctgggatcacaggtgtgaagcaccatgcctggcccagatttatttctgattcacagaaggggaaaaacactgcagaataataatttcccccaaattggcttctctgctcaagtaatccatatgacagaataactctaccatgcttccagtatcaggtgggtgtcaaaacaagacttttttttttatttttttgcatatcctttggaattctacaatactaattcctaggatggaaacacagagattatcttagatttgtctttacccttatgtctaatatgtactaaaaagttttactttctggggacaataacctgtcagattgcctatagtttccacttttggttttggattaccacatcagctttctagtggatcttcctgtatgcaggctttctaatgcatactgtgtattactgctctaatcatcaaagtgcttaccaaaagcagatgcaaggttttgactagaatgatggatagagaaatcaagcaagtacaaaactaaagtctcaaactaggtctctcaacaaatttattcaggaataagttagaaacaggactaaataataaaatcagaattgtatcactattaggaagaccttagtagagttgtaattatggtacaactatatgaaaataataaattttaacttttatattaattcataataaacttgttcccctaatctcatctatgtgaagagaggagatgctagaataaataatcatcactcataaagaaatgttaaagagatgatgtaaagagcaggaaaaaagacaacattcaataactatgatacttcgcaagctaatggtaagaaaaagcttacttacatttctctgtttgatggtctatcttgtaaccaatccttcagtaaaaaaaaaacacacacacacaaaaaccttaaagacaaaaatctctagatgaagcataacggtttaactttttttcttatattttaagaatgaaaggccaaaaaactaacatacagttcttgtttcataaaacaataaatttatttattataactgtatttactgtaaatgtaactaccataagactattcaacaaggtggaataaaaaattctgttatttcccacaacattgtctttctattctttatgaatttttatattgtttgaagacaattctattctcttaaaatatatatttgtggccgggtacggtggctcacacctataatcccagcactttgggaggccgaggtgggtggatcacctgaggtcaggagttcgagaccagcctggccaatctggtgaaacctcgtctctactaaaaatacaaaaattagctgggcgtggtggcgggcgcctataatcccagctacttgggaggctgaggcaggagaatcacttgaatctgggaggtggaggttgcagtgagccaagatcgtgccattgcactccagcctaggcgacagagcgagactccatctcgaaaaaaaaaataataaatatatatatgtatatatacatatacatataaacatcaaaatacaaacagaaaaattaaaatcatgtaagctgtgaatgctcatgacatttaggcatatttcactgcagcctttgttgtgtatatgtgcatatggtttttattctgcagttgtataatgttcctaggtgtgggtttatttttacttccccagtttgagactcattctgcccgaatttgaatcttcacatattttatcattttgtaaaattctaaaccatttctaatctcttcaaattttgtctactctctcaaggccagttagatatgtcttccatgtctctttacctttaatatattttccatctgactatgtagtttatctttttttttttactttaatctgttgcattctgatccagtttagtaattttcccttcagatgtgcctaatctgttaattaactcccactgagtggggtttttttgagatggagtttcactctgaagcccaggctggagtgcagtggcgcaatctcggctcactgcaacctccacctccctggttcaggagactctcctgcttcagcctcccgagtagctgaattacaggcatgtgccaccacacccagataagttttgatttttagtagagacagggttttgtcaggttggccaggctgcttgaactcctgatctcaagtgatccacccgcttcggcctcccaaaatgctgggattacaggcatgagccactgcacacagcccccaccgagttttttttttatttctagtttttcaaatttgccagtctttttgaatagtatctccttcttttctcatgttttatatttaaaacttttttatgtccatcatcactttaaacatacttattttgtcatctataaccaataattccactatcttatcagaaatcaaataccgtttatgtaagttgactcccatgagttctaaattgccattgtgaggtcatcttcggttaggctttaatttgttgcaaagttgtgcagctcagggtcaggaagagtccctccagaaaggaggatttgttactgtgaatctctttgttaactaacctctttccccactgaaataacttttttcaataacatgattttaacaacataatctctctatgccagaacagatatattttgaatgtaagtcaatattttcttgagcaaaattatgagcactgacttatatataatacttgattataaaggagtaatttttctgccttttcctgagctttttgtcttgtcagtgtgtgcttttaaagggaatttgcaaaatcaatcattatcgcagttagctggaaatgagttcatataattagcttcaattcaaacaaaaagagattcctgcctttattctgcataaatttttctttaaaattcctgactattcactgtaagaaacttttctgtaactgctactatgctaaagtcagttttcttaagaaaaatttttttgaatttttgatatagtcccaaatatcaccactttgtagatcttatctaaaaaagtttaatgtatttaataatatatatctgtttagttgaaatctacaaaccggtattaaagctgctttggaatctacttcatgagtgtcttcggtagatggccttctactgattttttctgctaaaagaaaattaaaaaatataaaaaagctacacaactgaagttttatgaataccaactaaccaaacacaaagtattctaggcacagtataaccttcataagataactcaacctttcctcaacacgctgaacacaagagttacatgaggcccataaattattcaatttattttgagtaaactattcaatttattgtgaaaaggcaacaataaatgagagtatgaagtaaaaaaaaatttctccccctcctgttcccaatcaccctgactggggacagtaaaggtaattcatttcttgcatattcttcctgggatatttgtatgtgtatacacatacccccgccaatatttaacataaatggtagagaaacatatatgtctggagggttttgttattttaaactttaagcttagagttttgtttttttttttttgagacagagtttcactcttgttgcccaggctggagagcagtggcacaatctcagctcaccacaacctctgcctcctgagttcaagcgattctcctgcctcagcctccctagtagctggcattacaggcatgtgccaccatgcccggctaattttgttttcagtagagactgggtttctccttgttgttcaggctggtctcaaactcctgacctcaggtgatccacccgcctcaacctcccaaagtactgggattacaggtgtgagccactgcgcctagccagcttagagattttctacagaacagagaagatttcccaattatctttcgatgctctctttatttcatattggatacacattaatgtatttaaacaaactcctactgatggaaatttgatctgtttccaatctcttcctatgataaacagtgccgcaatgaataatccttttccccaatttatgataatacctttgttgtcatatcttatttatccgaaatgaactttagaattaagcctacttccaaaaaaagtcaggtcattaagttacaaatcaacttagagaaagcttacaattttacagtacaacaaaggataacctcagaatgaagaaaggaaaatctcagaacaaaatttgtattccaggtgtagaggacaaaaagaccagactgagatatattagaagactctgggcaaaatgttttcaatatgatgaaactgacagaatacattatattctgaatatcatgaagaaatctggttaaataccagagaacctagagtgttgatttaaccaaaactgtaactatacttggtggaaaagggtgaacaggtgtgtgtgtgtatgttcgttctgggaatacagagtgagaaaagagagttcaattcttgtcttctttagtggaaggtcaacagatacggcctaaaactgaaatatgaggatgctgcaatacaggtaggtttgagtatttctagtgatcacttactagaaatgcttgggatcagaagtgtttcagatttctgtttttttttttttttttaaattttggaatatttgcattatactcacccaggtgagcatctgaaaatctgaaatctgaaacgctccaatgagcatttcctttcagtcagtactcaaaaattttggatttaggagcattttagattttgggatgttcaatccatataagcatactaacttaggaataacatctatgttaacttaaatactgagaattctttttcttccctcctaatccttctaccatttctttctctttttcttttttgtttgagatggagtctcgctcccattcccattgcacaggctggagtgcagtcgcgctatcttggctcactgcaacctccatctcctgggttcaagcgattcttcttcctcagcctcccgagtagctgggattacagacgtgcgccaccacatctagctaatttttgtattttttttttttttttttttttgagacggagtctcgctctgtcgcccaggccggactgcagactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttaaccaggatggtcttgaactcctgacctcaggtgatccacctgcctcggcctcccaaagtgctaggattacaggcgtaagccacctggcccactctaccatttattttacttgctttactgctctggctagaatgtaaaacagaaacagtaacagtcaaaatccttgtcttgctccccatcttgggctttcaatagttcactatgaagtttgatgctttgtgataattttttgttgatatcctttttgagattaagaatgaatactgaatgttaaccaaatcagctgttaagatgatctcatgatttttctcctttaatctgctactatcatgcattatcacaattatatttttgaatgttaagacaacttttattcctggaataaacccaatttggtcataatatgcattgctgaattcagtatgccaaaggaaaatgaaagtgatggtgagatggacaatgtagtactatttttcttaaggaacctttataattattcaacttttcaacgatgtgcatatataatcttgacttataaaaaattatgatatggaaacatcaccacaatatagtaaatgagaaattaatggtacaaggcaacatgtattgtctgtgaccttttgtgtaaaaaatgagaggtataagattgtactgtcatacatgactgtataagcatgaaactctaaagggtagacaaatagtggtaaatgtgggaacagagtgagagagaaaattttcagagtgtgtgtattttaattttgaaccaaaaatgtatgatttttaaaagttaaactagaaaaatatgttgaataagtgatgatacagattaaaacatgatacagatgaacagatacatttgcaaaagctaaaagcagcagatttacaaaaagtttttctattccatctttacagaataaacaatttgtaaaacatattctaataaaacattctaatgaatgctaggattacgacttattcaaggttacagtcactatggcagatcagaattttcgtcttctgactcctgcaccattcactgctcatgtgtttgacaaacataaaatacatttaaagtgtaaatgagtatgttttctgacactattcatatggtcaaaatactcaccttgttttgaatgaacaggaatggaagttctgtgacagtcagtaaatccagcaagagaactcactcgtttcaaagtgttttcagaagtattgttattctgcaaatattgtgcagacatataatttgaaaataattgaactaaatttcaacccattactctaagtagtattagagtcccttgatctatttagctcaatatgctttattctacctggacaccaatgggtgtattatagattatggttattttcttcaatgccaatttcaaaagctgcaccaaaacaccttattttcctactgttcataaatccatccaaatgaattttttataataataaaaactcagactgggcatggtgactcacacctgtaatcccagcactttgggaggtcgaggcgggcggatcatgatgtcaagagatcgagaccatcttggccaacatggtgaaaccccatctctactaaaaatacaaaatcagctggttgtggtggcgcatgcctgtagtcccagctactcaggaggctgaggcaggagaatcacttgaacccgggaggcgtagggtgcagtgagccaagatcaagccactgcactccagcctgctggcagaacgagactccgtctcaagaaaaaaacaaaaacaaaagaaaacaaaaaacctcacaaaaaagttggaaaaatatacaaaactgtggagaaaaaacgcaatcattatgaattcacctcacccccaaagaagctattatcttacatgtatcttgacacactgataacattaatggtgggggaactatttccttttggggatcttggtaactttcttattgctttgtatgagctatttatacaacaaggttatctatatgctcactattttgtcagatttcaatttgtatttcaaatttcttttgactatgttttttaggtacttaaatctctacattttcccttaatatttttctattatttatgtgtttggaaagccctgaaggctttactggctcaataaatactgctttttttttttttttttttgagatggagtcttgctccatctcaaaaaaaaagttgtttaaatcaaaacacagctactgcttttctgctaactcacagaaacttgcaatgtcttgtttttatcaaggagtacctgccacttaaaaattttcagcacgttttttctttaagttcattattaaaaaggtgaaatctgtgggaaaactctgatgctttaccttttcccattaagaaatgtccatttatcctaaattttatgtcttacttctatcaagtgcttcgcaatagcaaaatgataccaccagagtgtggcaatatgacaataatttgtgtaaagaaaaagaaaatgtgatgaacttaggtttaaataattctacattataaacagctttactaaaacttatgaaagtccataaaacatttcatttacctataaaatctacttcaaccctatatggaatacagatattccatatgtcatatggcaataattataaaaccaatttggtagacagcagtctgttctttcttctttctagcactttttctcattcccgcttttcttctttctctttttatcgtgtgtcagctaaggctacctaagtgaacttgatccatttatttagctctcagtctaaatatgccataattaaaatggttagaaaacactgcaaattatagtcttatgataggtccgctgaacctacacctatttcctccatctaaaagcacatgggtatattttaagctgactttctgacttctgcatatactaaagagactttacctcatatttaggcatctctgtatactccataatcacatttcttacatcattctgctgctcctatttgaggtaagaaaattatgcaactattctcaaacttaaaggcaaatacagaaaggaaaaaacccaggtaatcattacacctcaatttgcatataataaccaattaaataccaagttatcaatatctagttaatagatattaaattaagttaattgatttagtacaatactttaatcaaaatatgataataaaaatacaaaatgttacaatataaaaatgcatttgagtctactttttatatgtagggtagtaagtaatatggcctgacagcaattacataattcacctggatcacataaaaagtaatcattcatagaaactcctacgtcattatcatttccttggttctagctttaggaaaggtcctgttttcactgtgtatgtcacttaacatttctataatgtaagttctttaagggctagagaagcttaacacctttctaggtgtttttaattatcttgttgtagccacattaccactccaaaggctctaaatagccacaagtaatatatgagagcaacatttaagaaataaaaccaactttgcaggcaagaatacaccttttttgccagctgttctacatattttgaaacttatttaacaaacatttatcaaattatcttgcacttgtacataatatacagcttctcactgctagacaataggtttctaagagtcagggtcatgttcaaataaaacttttggatctgggaagagtgagctcattaagtatttaatcagtggaaaacatatggggagaagaaatttttaaaaaagaaatgtaggccgggcacagtggctcacgcctataatcccagcaccttgggaagccgaggcaggcggatcgcttgaggtcaggaatttgaggccagcctggacaacatggtaaaacctcatctctactaaaaatacagaaattagccaggcatggtgatgcgcacctgtaatcccagctactcaagaggctgaggcaggagaatcacttgaacccgggaggtggaggttgcagtaagcggagatcacaccactgtactccagcccaggtgacagcgagactccgtctcaaaaaaaaaaaaaaaaaaaaaagagagaaatgttaaatagctgatgttttttatttagtgagtataattacgcaagctgtttgtaccttttcatgttcctcaattgttcattttttcaaactgaggacagcttcaaatatttggtatcagcatgttaatgatatctgctaaaactgtatttttgctgaaaaaatgtttaattaaattttgaactaaacatcaagacagtaaaataaatagaactgtgggtgttttaataaggatttacttacggatagtatttttatcttgtttgatgtttctttaaacctctgtaaatccatgctatctctgtgtcctttaatagaaaaaaagatgttgcaatgagaaatttttatttttcttcaccgaaataatggcactgcttaaagtttataaaaacaataggtttatgctgtttttcaagtacacttgatggctctgcagtctcctttagctcttttgataaataaaattgaaaattgccaagaagctggtgaaggttacagttttttttgttttttgtttttttaaatttgagaacaagtctcgttctgttgcccaggctggagtgcagtggtgtgaccttggctcacttcaacctctgcctcccgggttcaagcaattctcctgcctcagcctcctgagtagctgggactacaggcacgtgccaccatgcctgactaatttttgtatttttagtagagacagggtttcaccatgttagccaggctggtcttgaactcctgaactcaagatctgcctgtcttggcctcccaaagtgctgggattacaggcctgagccaccgcacctggccaagattatagttaagtttacagtaacgttaaaagccaaagtccttataaaacaaaccaacatgtgatatgaataaatagctcgaaatttaaaagaaaaaaggggaccaagcatttttactattaataaaaaaaaaagcattacatatatacggataatcactcaaaaaggaatgatttattcttatgcctataacttaaacaaaaacagaacaaaaatattttggcaataacactttaatgaccttaatgaaaactgttccacacatagagattgttcagacaacatgttaataagcccatgtataatctccacattaagaccagtctagcaagttattcaggcactgaacatgctgatacttactgctaggctatatggaattcactctagatatacagatatgtaacttttcctatataatatacatgtagagaaaatatatatgatatatacatacaccccactggtaatacattaacaaataggctaaaatgcatttttaaaaataaattggaaattagccaggtgtggtggcgtgtgcctgtaatctcagctactcaggaggctgaggcaggagaatcacttgaatctgggaggcagaggttgcagcgagccgagattgtgccactgcactcccgcctgggcgacagagggagactccgtcttttaaaaaaaaaaaaaaaagggggaatatatttaacgtaggaaaagttatatctatgtatctagagtgaatcccatatagcctagaagtaatatcaacatgtttagtgcctagataacttcctaggctggccttaatgtggcaattttccatgggcttattaacatactgtctgaataatctctatgcatgaaagttttcactaaggtctttaatgtgttactgccaaaataaacatttttttttgttcttatcttatttaagctatcataggtataagaataagtcattcctttttgaaatgttctctgtgaatatataaataggtacaccataagtactaattttcccagtagattcctagatttccattgttgttctgatataattattaatagtgcaccctttcacttttaaagtgtcttggtttgggtaaaaaaattatatggtcatctatttatagggcactgttcttttccagttgattctaacctcccctatgaggttctccaagtacttaagaatcacttaggttttcaacaagagttgatgaaacccaattgaagatattcaaattcaaaagacagaacctaaaattccatcaaagaggttatgtgccaatataactcttatagcctaattcagtctatttcccctacttctgatttttttttttttttcatttcatttctagagacagggtctcattctgtcacacaggctatggtgcagttgtgtgatcacagcccactgcagctttcagcttctgggtgcaagcagttcgcctgcctcagcctcctgagtagctgggacttcaggcacatgccactgcgcctggctacttccaaaaattttttgtagagatggggtcttgctatgttgctcaggctggtcctcaactcctgggctcaagcaatcctccccactcagcctcccaaagtaccagaatcacaggtgtctgattctttttaaaaattttataattatactctatgaaaagataatgacttgtaacagtacatatttctattatttctaaggtgaaaagtaaataatattgatatacaaatacgaatttgccaaacttacctacaaatgctccaaattctgtattatctccttctgtagctttagagcaaacagtttcttgatctttggttccagtttccaagtggcttttgcaacttggctgagatggtgtactaacaaaaaatttggttggtggggatgacagatgtggtatgctagtagatgaactgcctaatttttgatttttattaaatatttttaagagttctaccccatgtagtctctgtcgcagttctggaggggaaacagcacttgggaataaggcaccagaagaggaaccagcctctggaaaattaaattcttttctctggggtactgcaggtaagtcttgaccaaatatattacactggggatctttgtcatctttcattaaaatattacaatgaaaaggattattactttcaagatcaccttgaggaagagaggagctaagtgtatttacaacaccatgctttttccatacagaaggtcttacaggaccatcatcaataaggttttgagccaagtgtttggaaatgctcagttctcgtgtgatttcattatgaactttgctagcttccgacgctttctgggcagtgagtgtttttaatgtatctaccgtcagggctgaaagatcttgcaaatggccaatttgagaatctaatgattgtaatgatctttttatgtagttgacacgatctccaacttctttaatctgaatgcacatctgttccactctgtaggagagaaataagctttttttacaaatgtgaaaaaataatgtagaattttattttgtagcctcaaataataatgataaaaagagaaaaatttcacatgcatttaaacaagatataaaataaggtacagttatttaattatacaaggcctaccttatgtttaagaaggatccagtgctaatcttatattaaaatgcaagatttcaaaaaacgtttttgttccacaggctacttattccaattaccccacatcaaagtaacacaaaataatgtatatacagctacatatatacagaactaccattactgttactgtaactgttaccaaacaccatatgcttccagaatgtagtgaagccaacagaaaaaaagaaatgctggccaggcacagtggctcacgtctgtaatcccagaactttgggaggctgaggcgggcagatcacgaggtcaggagttcgagaccagcttggccaacatgttgaaaccctgtctctactaaaaatataaaaatcagctgggtgtggtggtgcacgccggtaatcctagctactcaggaaactgaggcaggagaatcacttgaacctgggaggcggaagttgcagtgagtggagattgtgccactgtactccagccggggcaaaagaggagactctgtctcaaaaaaataaaaataaaataaataataataataatgatgataataaaaaatgctgtaaaatagtgaggacagttttacttttctccctccaaacagtaaagaacagtaaactcttctatcttctgtaactagggtaaaaaaataagagactgaccaactgacttatatgaagtattaatagaactgaacgatctttccaatacatcatgtaaaactgtaactatgcttattgtttgacaaaataaatttaacaatgaccatgtataagaaatataacgaatagatcccattttgacatataaccgattttaactaaagggcttctgaacctttcaaaagtgacacgaattctctcttcactcccagaatgaaatttgtcatctttttcattgaaatacatttcaacacactgctcttcaaaatcatgaagtttcttttgatcttcttctgttaagaaaagttctatgggaggaaaaggagaagaaaatcaaggaagagctatcaaggtttcaactttagctcataattcttacgaattattcagggtttctaagactacatccatcatctgcactttttaaacttttactactatgcttctaaagcactagacaattatctttcttttttgcttcaccagtgtgatgtcagcagaatacaatcaggtacttcctcctcctcttctgatttccttttcctatacaacatccctccgctatctctctcatacctctccctcacgtatctactcagagaaatttaagaactaatttgaaagtccctgtaaaattttaagcataatttgacacagtatgattagtctcatgtacacagaatgtactaaaattgttattgtttacagagctgtaaaaatggtttgtagaacaacaaagaagttcggtttacattaccattttaacagaaacagagacgccattctcataacgaagtttaatgctaaatccatttttatagatatcatattgcacttaaaaattcctttatgtacaggcatatttaacaaaaatctaccataacattaatccactaagtcatttttgaataaaatcaatatatagcctttggtgtaaaaatgagaagtgataaaatgaaaacatttgccttaatatagtttacttacttggtccatcggaagtcttatctttctttcttctcttacatatgcagcaaaacagagaaactatatggctaagaatgataagtggaggaggcagaactggtttctcatgataagccataataaaatgataacgctggtacttccatacaatattggaaattgccttcacttgtaaatacacattgctagagaaataatgaataaaaataaaataaactttgttaatcatctcttaaagttttaaatactgatgatttcattgtaattctgtactaaataataattcaaaaaatatccttctgtaaacaaaactaatagcaaatgagaaactagaaaagatacaggcagtaagtataaggcaaagactaacattcagcagaaaaaaataatttaaaaaaatttaaaatattgtatgtaaatgggtaagacataagaaaatactcagacttattagtaatcaagtaagtgcaaattttaaaaaacaaaatcctggctgggcatggtggttcatgtctataatcttagcactttggaaggccaagaggcaggaggagtgcttgaggcctggagttcaagacgagcctgggcaccatagtgagaccctgtctatttaaaaacaaaaaagttagccaggcgtgatggtgtatgcctatagtcccagctactctggaggtgagacaggagggactacttgagcccagatggaagaggctacagtgagctgtgatagtgccactgcactccagcctgggcaacaggctgtctcaaaaaataaaataaaataattttatttactatcaaattggcaaccattaaaaaaaaaatactcagtgtgggccgagttgaggaaacaggcctatttagacttaagtgcaaaagccctaaaagtacatatactgaacagccctgcttttagaaaaacattctaaacaagcaagtattgctcacagatttaactacaatgtggtgtttaggagcaagaattacaatctaattgaccaatacaacatactagattgaaaaattatggtctatatcatggagtatcaggtagccattaaaaatagactggagaagaatatttgtttatctgaaataatgttcatgatgctttgcttagttataaaacagtacataaaatataaaaataggctaggcactgtggctcatgcctgtaatcccagcacttggggaagctgaagtggatggatcacatgaggccaggagtttgagtccagcccggccaacatggtgaaacctcatctctactaaaaatacaaaaaaaatcagccaggcgttgtggtgcacacctgtaatcccagctactcaagaggctgaggcatgagaatcccttgaaccctgaaaactaaggttgcagtgagccaagattgtgccactccaacctgggtgacagagggagactgtgtctcaaaaataaataaattaaataaaaatactatttctgaaaagaaaaatggtttacatatatttgcaaaaaaaatgatagaaaggtgtacacccaaatattaacagtggaattactgatgaattttctatattgaatgcgtatttgttggcaaccgaggaaaaatcccagataacgattaaatttataaagaaaactgcaggttgaaagataatcaaacttaaaatttagaactcatttgattagaaaaagcatctcctatttgtaatttttcaaatataattttagtagtttaagcctcaataaaatttttagattttaagttctataaatttccttcaaaatatgtagaattgcatattaaatcatcttataacaaacaattgaacaaaattcttacttgaaaaatgcaataagaagattaaccataatgatatactgtacaaagaggtagactgcttgaagaaatggagtcaaccacgtcccaggaccacagatttgagggataacagaatcatttgcacacactttagagagaaaaaaagaaaaaaacaaaaacaacttaaaaatagtaattcatcagtaactgctattcatgagtgtttctggttatttatttacttaaagtaagtttcgattatgtacaaatctgtttcacagattccagcaaaagcatctgggcaaggagacataggaaccccagcttaagagtgttcaaacacaaaaagatgttgtgagaaatgtgggtgctatctgttttacaactctattccagaaaagaaagtatatttaggtgttatatttacccttcgaggcagggtttaacctgacgagcactaaagagggtaaaattcctggatcaaccatatgataatatttctgtaagaaaaatgtccaaactttttttttcccctgagacggagtcttgctctgtcacccaggctggagtgcagtggcgcgatctcggctcactgcaacctccggctcctgggttaaagcaattctcctgcctcagccgcccgaatagctgggacaacaggcatgcgccaccatgcccagctaattttgcatttttagtagagaccggatttcatcatgttggccaggctggtctcgaactcctgacctcgtgatctgtcagcctcagcctcccaaagtgctgggattatacgcatgactcaactttaagagtatggttgactcatagcaaaacatatacatttaataaagaatattgagtttatcttattatgtcacaaaaatggggctgaagaaatagctaaaagtgcttctcaattataccgtgattagatttgaattccttgtttttcattacccctaactgaaaaatttctgaagccagaacatagctaattacaaacaaggaaaggaagagctttaatacccccaacagcattacaaggaataaagtaaattaggcagggcgaggattagaattaaataatgatgaattagtgataagttctagctaaatatttatagtacacttagcatttagtatttggtaatttttaaaaagtatatgcatcaatgacattcatacggttctatgattcctttaaatggttttacgggcaaattaatggtaaggtcttttcactcttaaataattttatgaatctatttccattctattcagattagtttgcggaagcaaatacccaagaaagagaatgcaggaaactaaaaaactatactcaatgctttataacaactacacaattagagtcatatcattagaaaaatagcagacagccaggcgtgatggctcacgtttgtaatcccagaactttgggaggccaaagcaggccaatcacttgaggtcaggagttcaagaccagcctggccaacatggtgaaactttgtctctacttaaaaaaacaaaaacaaaaaactagccaggcatgatggtatgcagctgtaatcccagctactccagaggctgaggcatgggaatcacttgaacctggaagacagaggttgcagtgagccaagaccacaccactgcactccagcctgggtgacacggtgagactcggtctcaaaaagaaaaaaaaaaagtagcagacaatgaaaccctggaaataacaccaaacagaagccattaaacacaaaatttgaccaggctggtaaaacaacattagtttaactaccgcccaagaacaaataatgaccacaaattttctatgtggccacccttggacctaaccacaatcctctcactacatggccaacccttgacctaatcacccataaatacgtaggaagggagtaacacagatattgggggaggtaagaatgaaggaagaagaaagaataagagtgagagagaatcaacaaaataaagattctatatctcaaatgtggaagtcagcagaatatcactgaaagctgacagcatcacttatgttcacaggttatctagtctcactgactaagacaatgtaagagtcaaaatgtgaatagtaacaaaattgaacaacaaacttaatattctaagaacagggttgaatcagtgggagttacgtcattgattatccagagaatgtactcacaagctgcaacaaaaatcttgagtatctgtcatctgtaaaactcaacatgctgtaagctttcagtattcacacaggatcattatttttgtaattaacgttgtgcttgacttctcaatatcgaatctacctgaatgatctacgctaatcatggtaatcccatcccccttgtctgtaaccattttagagataggcaggctgaagccaactcaagctaatgaaatgaaaggacaggttcaaaagggaatttctatgaaagggacattttcctctaaagagaaccatcgataaacagtgtctctttcctcctgttgctaatgacagtcttagaatcataagggaaacttatagagttggcagccggaagaaaaagaacaagtgtccttagctatgaattaaccaaccctaaagaccactagacctagctcaatattgttatgtgagttaataaatgcccttattgtgtcctaggacagtttagactagacttctaatacctgccactaaaaaaattctaaaatattttttcttccaattaatttgtatgtttcttctggagttcactaacgcctttgtgtggggcttaggttggtaatagtttgacttctgaaaatatgcaatattactataattcaatattggttttaaaacacaaaataaccaaaagataaatctgtaaatatacaattcttaccatcaatttcgtatgcataaacttcaccaaaaatcatccagtatgggtgaaaaactatatctttagcaagagtccaagatggtgcttcatgaggataaagtattgcctttctgggaacaccaaaactaagtaatacaagagccataatcactacaatgtagaacatattggccacctgttaaaaaatgaacactgttaaaatacaaggaagtttaaacactatgacaaatctttctaaaagcttctaatgttctaatagaccaaaaaaatccattaaacacaaaaaatctttgagattctttttgttcctagtgatagctttcagaagaatttcatcactatataaatcttaacatctaggagattacgtaaaaaaaaatctattaagctaagcaagtcatgggcatctttatctacataatgaattgtatcactggttcaaactgaagtgtacctatctctgtggtacgtgaagattttcaagaagtacagagacacagacagatttagggaatcaatttccacaactgccctttcctaaagcttctctgttcttataatggaagcacagactctctcttttccatgttgcctctggtaattgtactttgcccacttcacacaaaaaaagaacacttcccacccaccctgaatccatgggtgccttgtcctgggatatgaaaacttcctaggagccaaacaaaacaatctgaattattagcatgggtgttgaaaaactaaaagacaccaatgtctgggaaacaaatacttttgtaagtcatgtagtttgtaattctttaatttcaataaaattcaaaaagggcctaattgagctaaaacctagtaattcattgaaaaattattttcattgttaaattacaatgtacattttgacataattatttaaggattcaaagaattaagcagaatgctataataaaacttcacctcccatctacttatttaggtatataagttctccagcctgcactacttactgtctagcctagacaatataaaaaagtgaatatacgaccaggaacagtgactcaagcctgtaatcccagcacttcgggaggccgaggcaggtggatcacttgaggtcaggagttcgagactagcctggccaacatggtgaaaccctgtgtctactaaaaatataaaacttagccgggcgtggcggcacactcctgtaatcccagctactcaagaggctgaggcaggagaatcacttgaacccaggaggcggaggctgcagtgagccaagatcacgccactgcactccagtctgggagacagagcgagactccatcttaaaaaaaaaaaaaaaagggaatatacatataaaaaagtgaatgctttctcactctagcaatatgtaatattcattcataaataatcatctagctgaggagaaaagcctcatgcaaaagagaatacatttacaataaatctgtacattaacctactgtaaacttaaaataattgtaatgacaacttaaaataaattatgacatttccatatatttttaaaatgaatatacagtgacagcagaaatggaaagtaagatgtgaaaggtaaaggggacaataagtagtcaaggccggataaagtaattttataggggcttaagattagaaagaaaagttgtatagatagctgcgagtcttaaaatgtcaattcaaatgaagagatgagacttgatgcttcatctttaaaattctgttagatgaacaaataaattttctttttaaattaagagctggctctctgcaacttgcagaggcctaacacgctccaaaattcttaattgggtgttcttatttgcaaaatggacaaataatgccttcattgagcatttgagaacagtactgagagaatgcatgctttcaaataaacaaaatattgcaaaacaaaaagtatattaaaagattttaaaaggcaaaaaaagtattaaaacattattcatgctatttgatatattttagaatacaaatgcttgtaattaaaggaaaagccaagtcaaatattccaaatgaaacgcaaatctgtattgacgtaaactaaaattattcaaggtctatggttgatgattcatagtcatctttgcatttcacacagcttttcacataaagcctaaatgacaaccactttccttgtgcttgataggaatttaattaattaaaaatatgtgagtatcagcttgctcataaaaatgaggattcttaaagtaaaattttactgggcacggtggctcacgcctgtaatcccagcactttgggaggccgaggcaggcggatcacaaggtcaggggtgtgagaccagcctggccaatatggtgaaaccctgtctccactaaaaatacaaaaattagccgggcatggtggcgcacacctgtagtcccagctactcgggaggctgaggcagaagaatcgcttgaatccaggaggtggaggttgcagtgagcacagatcgcgccactgaactccagcctgggtgacacagcgagactccatcttaaaaaataaaataaaataaagtaaaatttttaaaaatgaggattcttataatgcatacagaatgagtgtgagaagtttagcatttaccatataattttcattagtctgctattaaaagatgtattaggttgatgcaaaagtaattgcagtttttgcaattacttttaatggcaaaaaccgcaattacttttgcactagcctataaagtgtgagggaggtttcttctttttaatcttttattgtcttcaagcttttcaaagctgtttcctctggttagaaactccctgctcagaagaaaaatcccacatattttcttttttttttttttaatgattatactttaagttctagggtaaagaaataccatttgacccagcaatcccattactgggtatatacccaaaggattataaatcatgctactataaagacacatgcacacgtatgtttactgtggcactattcacaatagcaaagacttggaaccaacccaaatgtccgtcaatgatagactggattaagaaaatgtggcacatatacaccatggaatactatgtagccataaaaaaggatgagttcatgttctttgcaggaacatggatgcagctggaaaccatcattctgagcaaactattgcaaggacagaaaaccaaacaccgcatgttctcactcacaggtgggaactgaacaacgagaacacttggacacagggtagggaacatcatacaccggggcctgtcatggggtagggggcagggggagggatagcattaggataaatacctaatgtaaatgatgagttaatgggtgcagcaaaccaacatggtgcatgtatacctatgtaaatcctacgtattttctaaactcctttgaaatgccataatctttgtgaaagccttcatgacagaattggttactagctcttctatcttcacgtaacaatttatcatatttttcaatagctacctatctgttcacatgtctatatttagagactcaattgttgagttccacgaagatctggaccatgtcttattcatctttgtagccccagcttagtttaactcttaacatgtaatagatacacaatgacgaaataatgaatgttagaactaaaacagtaaccattatgaaacttccaaaggggatgtaaagggaagctggcactagggaaaacacacaatgacggaacaaatgactagctgacaaggagaaagacatcctagcagagggtggttctagagaagatcacaaataaaggcttctgtacttcctaactcttccatttacattaccattaaagtaactagacaccactgagtcactaaataacctggtaagcataagagctacaacaccttttttgcatgctaaaatgttaggctaaaaccaattcttcccaaaaaaccttaactgccctatttttccttgaaataccataagaatgccaaaatgtgtgaataatgagtaatactttgatgtgaaaaacagtacaccagttattctcaattaagggggggaagacacattctcttggagggaaacagtgcagcgtgaaagtgcaaatataataatttatatttagaaaacctaaaaatcttgttttcaagatgcgaagataatcttgtgagcttagcagggttactcaagaaatatttaatttagaagactgatttttttttttaattattatactttaagttctagggtacatgtgcacaatgtgcaggtttgttacatatgtatacatgtgccatgttggtgtgctgcactcatttacattaggtatatctcctaatgctatccctccccctgccccccaccccatgacaggccccagcgtgtgatgttccccattccccaccgtgtgtccaagtgttctcattgttcaattcccacctatgagtgagaacatgcggtgtttggttttctgtccttgcaatagtttgctcagaatgatggtttccagcttcatccatgtccctacaaaggacatgaactcatccttttttgtggctgcacagtattccatggtgtatacgtgccgcattttcttaatccagtctatcattgatggacatttgggttggttccaagagaagactgattttctaagattaagggagtataagaaactctaagaatagctttttatatttattaaaatgggacaactattttaaaataattgagaaacagcatgtatttttaaagcatattttgataaaactactgtatatatttatttacaagaagtctgaaacaaacacatgtgttcatacacatcttgagagatggaaggatgtacgttaaactgttaatagtgaatgtctctgaatagtgatttgtctgcatttgctgaaatttcctaggatgaacaggaatttcagaataaggaatagcaatagctatattacaaattttgcctttttcaccactgaaaactaaaaggaattacggcaaggagtagacccaatatatttcagattcagtgtataaaaaaattacacattcaacttgacatctagattttaaaaaataaaacctgccactcagataagactaaggaaaagagcaaaatactgggcatactgtattaggaaaagattaggtattttgggtttaacttttaaaaaatagcctggatcaagcagggtgtggtggctcacgcctgtaatcccagcactttgggaggccaaggtgggcagatcatctgaggtcaggagtttgggaccagcctgaccaacatggtgaaaccctgtctctactaaaaatacaaaattagctgggcatggtggcacatgcctgtaatcccagctcctcgggtggctgaggcaggagaatcgctgaacctgagaggcagaggttgcagtgagccaagatagtgccattgcactccagcctgggtgacagagcgaaactctgtctcaaaaagaaaaaaaaaaaaaaaaagcctggatcagtgaagacaggaaaaaggagttacctacagacataaaccatagatggtatagctaacattatcttgcaaagcactaaatgggtataggggattgggattgagcatgagaaactcttaaggaatggcagatgtgaagtatgaggcaaacaaacacaaaataaaagacattcactggctcaaataaaactatgttaataacatttttgtgattttttaaaaaatcaataaacccacgagtattatcaaacatctgtcaacttaccatttttccaatcatcattacataaggtcctgcctgttgatttacagctagaaaatctagcaaacgcacataccaaaatattatgttaagacagtaaattaatcttccagccacaaaaacatgattatcatatgcatttgcaaagttccattttgctccaaatcttagtccaaatccaatgaagaaagaaattatggcaattgtatcactgatgttgaagtaatcactaaaccatactttaatcttctggtttactttcccagcttcagacataaagatctaaaggtttaacaacaacaaaaaaaagtgtaatcagtttattcctattaaaacacatacagcattcaactataacattacagtagaatttcacatagcttttatttattaacttatttattttgagacagagtctcgctctattgcccagggtggagtgcagtggctcaatctcggctcactgcaacctccgtctcccaggttccagagattcatccaactaagaagctgaaaattcagattacaacccagttctctagacctggattgtaaaatacttttgaaaaattgttttatttcaaattaaggcagcacctggatatcctggtagtagctgccaaacctgccttctttgtagaaagtaaataactcaatggtttaagtagctgtatttacctaactaatttaaaacatatgcctcttctcctgaatatatgaattttaagaatcatcttttgggaggaatggtaacacattcacaacttcaaaattcatggtgtatcataaatactgcaaagcatccgtttcactcttctcccttagccaattaattactcttcccactagaagcaaccactactattactgtctcatgaacacttgcagagctattttatgaatatacatattttaaaacgctttgcaatttgcttttatcatttaacaaatcaatttcttcaaacatgctgataaaacaacagatttaataaacatatggatcataacactcagaggaatttaaaatgcaaaataagctatctaataagaaattccttctggttcgagttggtgtttggaaaagaaaaaaaaaagaaattcttatgatatctaagtgagagagaagtacaacaccttctaattatttttgcaatttcttgtattctctaaatgtaaggtagagacatgaaataattcagaggtacttatgcaagtatgttataaaacaatattcatggccaggtgcggtggctcacgcctacaatcctagcacttcgggagacaaaggcgggcggatcatgaggtcaggagttcaagaccagcctcaccaacatggcgaaaccacatctctactaaaaatacaaaaattagccaggcttggtggcacgcacctgtaatcccagctactagtgagggtgaggcaggagaatcgcttgaacccgggaggcagtggttgcagtgagctgagattgtgccactgcactccagcctgggtcacagagggagactacgtctcaaaacaaacaaacaaacaaacaaacaaaacccaatattcatgtagctactacttcaaaaacaaagtataaatattacgaaaaagattttcttcaaaatcaggatattaaaaaagacctaactattttatttttattttgagatagagtatcactctttcgcccaggctggagtgcagtggtgcaatctcagttcactgcaacctctgcctcctgggttcaagtgattctcctgcctcagtcttccaagtagctgggattacaggtggccgccaccatgcctagctaatttttatatttttagtagagatggggtttcaccctgttggccagactggtcttgaactcctgacctcgagtgatccgcccgcctcagcctcctaaggtgctgccattacaggcgtgagccaccgcgcctggcctaaagacctatttataacttacctacctaattggctaaatcaggtaggtaaattaaaagtcatttagctaagtatatttaatactttttgaagagtgacagagagcaaaaatgtgaatgttcaggaaataaaacaaacaaacaaaatacaggttacatttttataggctacatttctaacacaaatcattttatctgtaatggcaacaaagtatacagcatactcactaatctctattcttttgccattattttgggaacagcaaaattacacaggttctacacttctacaatgtcatcatacacacacacacccccctacgtatacacccaaaacaaaacaaaacagaaaatcttccatgtatacagtaaattattggtagaaaaaaactaaagacatacctcacggactttctcaatggcataagtaaaaatataagcaataacaatccattcttgaactgaaggtaactgttccatttgtacaagaaccacaaatgtataaagcatcagaaatcctaaatatgccaactaatgaaaaagtaaaggttacataaataacattggttacaaaataaatcttttaattatgaacattttcaaacacacacaaaaacagacattaaatgaacctctgtaaattatctcctagtttcctttattaaaacaattttagaaatatctcttcttcagcacagacattgcatttattggtgtataaatggtccccagagtataaacgtgttgttctacaactcttgtcaacctttagaacgtcccacagaagggattttacaatcaggtttatgttctcagcatatgccacacaattctgcttaactcatacctacagtatcataatatattaaaattactgcagaatttcaccaccataatcatcaaggaacacatgtttcctgcctccttcctccccaaaccaaacagtattcctaaaaaagacaactggggcacgccgcggtggctcacgcctgtaatcccagaactttgggaagccaatgcaggcagatcatctgaggtcaggggttcgaaactagcctggccaacagggtgaaactccatctctactgaaaaaaaaaaaaaaaaaaaattagccagacgtggtggtgcatgcctgcaattccagccactcgggaggctgaggcacaagaattgcttgaacctgggaggtgcaggttgcagtgagctgagatcatgccattgtactctagcctgggcaacagagcgagactctgtcaaaaaaaaaaaaaaaaaagaaagaaagaaagaaaagaaaagaaaaaaagacaagacaagacagacagacaactggtattttcttagctcccagtcactaaagttgaaccccaaaaagtggaaaaaatgtgaagtggctttgacccaggtaaggaaacagcccacctttgatactctttacaaaacaggttacagagaggtgctaaagtttatgtataaatacatgtgagtatttatttcatttcagaggaaaacccacacttattgacccttgaaaaattatgggtaagaatcctctcatctgtcttttatttatttctagacttttatgtcttgtctccaccagtcctagaataagtcacatcctttatttgattatctgtggcaggctagggagtaaactgcagtaaagaaagaaaagagaaattcctgtagtcacccatgttggctattttaacgcagccattcacatgaatgcaaatgtaagcaaactgccctattttcatcagtggagacagaatttggagattagatcagataactgatatttgcaattccagcctctgaataggaaggaacaagaacattttcatatagaggtgtaaggaaatgttagtctcaggttaatggtcacatgtgtgggtgaaaaagcaatcaccaaagaaacaaattcttgttgatgaaaatgaaaaaatctccccaacaacaaagttaaaaaacatcttcattaagggttttcctatgacggggagttaagaactcatttactcagtccctggttaaaagtaggggctaatctcatttgctgtatcacctgttccttcaggttggtccattgctagggaaagtagcaccagcaagacagccaactaatatttcctagtgctcattctccacacaaaacaaccaaaacaacacataaacacctacatttcaaccaaaataacaggtgagtccatccttgtatggacatatgctctttaacctgctagtaaaatcaatttttccataaagcaagagaaaagccaattatatggaaggtaatcaagcatacactttaatacaattaaagaaataagccacagataaataaaaccatataaacaatctggattactttttatcatcatcaattaacactgcaaacaggtttatttctagacttttatgtatcatctgcaaaatcctaaagcacaaaaaattataactgtgtatcagaatctcttttggtccatcttttatcattatttttactagttgattagtatttgctaccaacttacaaaggccaatggtattgtatatttgttaagtacatttttggttccaattagaactaaaatttgttagtgtttatcactctagatgatgacaatttaaatgaaactaaggcaaatgtatcactcttttaaatgtgaaatgccttttcagtgatctaagttatatcaacattagtatggattccgaaccaatggtcccccaaagcctaactcttaaaaacattatgcttgtgtaatttaaaaacataccgtgttaaaccagaattttacaattggtgcatgataaaaggcataaaactttcgcgtaattggaagcttttttgatttcatttgtatctccatctcattctttccttcattactatccaaaatccgtacttctttaaacacttcctaaaattaaaaaaaaaaaaattcttttgtacaattattcagaacaaacttatatttactttaaaatgttttcctgcttaccatggggatctcttctgttatgttctgaaagttgttttcgctgtcatccattgtcatctgatgagcatcttgagattgtgggatatgggacatttcagccttagttttatactctaacagcaatatggcaggtggaactaaaatgcttagtatgacctaaatttttagaaacataattttgcatttaaaaattaatgaccttcaagaatataataaaaacaaaacaaagaataaaaacaataaaagattttaaatatcttgtgattagccattttgcccctagcagtagagggaaaaaaaacaacaaattgattttttacttatatattgtatttaaagaggcccaagtttaactgttttaaagagtaacaaaacatttgattattatgataataagggtataggatagatttaataattattatagacttgtcctttaaataaaatcagattacaatttgttcaaaaaatacattttgtttaaacaaaattcaagccttataaaggtgctatgtccttaattttatcctaaatctctttgcaagtgttccatgtcataatgtgattactcagcttgtgcctctataaacaaaaaggtttatttctaaaattttacttattacttgcaaaatcccaaagcatgaagaaattgtaattgtgtaacaggttttctgttggttattcagtggcctatggttaaactatttgcctgatttctgactcctacatttctgcaccttattttaaaagatataagataacaaaaagcaaagttcaaagcagtatctatcaccatgacaaaaccaaaggtacatgccattttacccaaatttttaatcataaaaacaggccacatggatatacttatctataatgggtatatcaatatactcatccaatatactttaagtaacttaaaagtaacagattattaaattagtagataggtcttgaatttcagaatttgggaataatcttttcataaagtagtaacttttttcaaggctgctaggggccataatctccaatatttgccatttgttccccttctagctcaaagagaggccataatcattatagacacctgaaaaggattcaaaagttaagtagaggaaaaaagaagcccattataccacttgggatgaaatgccaatcatccatcttgctccctctttaccccccaccattacactcacacatcaaggcattttactacacatttagactaattcttctgttctttttatctaatcacatgctttatatcaaattatttctaaagtataccttgtaccaggaatttttcctcatattcagccttcccatccacatatcagataacaacatttgtgtacaggtgtgagctacaaaaggtctaagtcttgaagaaactgctaacttaaggcaggttgaattactccagttcttcagttcataagtgagcaatttcatagccatggtttcatcttgtctgaaggactgttctaataattcaacggccaactgaccaaaatcactataaaaagataaaagccaaaatatactcagattaacaaactgcaattttaaaccactattcttatatacattaatacttcctactttttaatattctcacacacacttacagaattatgaggcattaaaaccataactctgttttcagacatctacatctatgtggaaatcacaaaatattaaaatatgtcgcattatgtacaagattgagaaggtgaatccagagcacattctcccggtcctagaaatcaaactataatctcaaagggaatcaaaactcacaatgctacaatgctctgttcaaaaaagtttatgtagtatttcaaacacagaaaacagttggtacctggtagagaggaaaaacaatgtgactagggactaacctaattatgaaaaacatctgaatcttgaagtcccactaagtaaccataggatccctgttaaagagttattttcagtaacaattatcactgccctctaaataccccacttggggagccggaggtcttagtatatattagaaaacttctacaaactacttttccagtttaatattccaacactgcccctctaagtaaattgtaaacttttatgaactatgtcgttactctgtgtatgtagttctagcttctgaagtgccttcccagttgaattcagtctattttcttataacacagctccaacttcacttccaccctttccttaccaattcaaatggaactttctaatccaattgctactatttgcaaaaattaaaatgaattctggcatttcttctttgtttcgagacagggtctattgctgtcacctaggctggagtgcaatggcatgatcacagctcactgcagccttaacctcccaggctcaagtgatccttccacctcagcctcctgagtagctgggaccacagacaagtaccaccacacccagttaatttttaaatttcatgtagagacggggtctgcctatgttgcccaggctgcatttcttctttcttgctgagatatttaattcttgagttgcaaatataataacctctttttcatagaggcagaaagtttcttttaattaaaaaaatatatacttatataattttctgtcaattgtaccaataagattatacatataaatacatcaccattaagtacgtggcactgtaacagccactcaaacaatacctactttgaatttttaaaatgttttcaaatgataaaataccacttacttggaatactgttttagttcttctgaagtatcatctaccaggtcactctgctttgcttcatatgccattgaacgatagatcttacaggcaactaatgctttagccattgattcttcaccatgttgccataaaaaacgggccatgacctgcctcttcataaggcaagcccaaattaaaagttcattaagtggataaggaaagcgcttggtttctggatcatcaatgtctacaatttcatctttggttcttttcttctttccttcttccataactgtatcaatcttccagggaaaataaagttataaagctcattataataaggccatatgaaatttatgtcagtgaaaattttagtaaaatatctttacattattcagctccataaaactgcacaatagcataaattttataaacttgatttttattatagctcataattcattttatgaaaatgctgtttcaacaaaaatgcctttgcaataaacattttccaaaatttaagggcctaaatatttcaactaatattctaatagaacataattttaataaagggttagataacatttttgttatacatgttcttaatcaagtaaaactggaatgaaaggagtcaggtaaacatttattaaaacattttaatttggttattatcatacctaaatatgaaaatgtacgctgggcgcggtggcccacgcctgtaatcccagcagtttgggaggctgaggaggatggatcacgaggtcaagagatcgagaccatactggccaacatggtgaaacccagtctctactaaaaatacaaaaaattagccagtgtagtgctgggtgcctgtagtctcagctactcgggaggctgaggcaggagaatcactcgaacctgggaggtggaggttgcagtgagccaaaattgtgccactacactccagcctggtgacagagcaagactcctgtctcaaaaaaaaaaaaaaaaaaaaaaaggaacagaatcattaacttataattaatatctctgtgtgtgagaaaatgacaattctaggacatatccaaaaacgaaaggtaattcttactaaatcaattagttttttttgtttaataatactaagtaatttagaaagaagaaaataaaaacccagaaagaataatatttaaataaatttacctttggtcggtagggctgtgctgtcttaatgaaatggttatgcctcattttttcctttttatctgccctattgccaaaagattcatgactctttcgcaactgaggagtgctgctggaggtatttcggccagacctctgaaaatgagatcttattagcttttatagatttaaacgtgctgacatgttataaaaattcaagaatcaatttatatatgtgtgcaaatgtgtttgtgtacacacacaaaatatgactgatttaggattttgacgacataatatttctaattgctcttagttgaaaatgttcaactttatgacagtgtaaccttctccgttctaatgttaattcttaacaattaaagtgcatgtgttaatattaaagcatatatatagatttccccacaaattttacatacccgattatttccaccaagactattatatattaatcgaaaacgtttcctagtataggtgcatctgtaggttcctcccatgagatattcaataacaagtcctatatcaatcagagtgatcttatatcctggaggaagatttccctagaaacaaaacatttgttttaaatagatcagatagcacttctcaatattgccatgccctgcctaggaacaggcctactctccaaaatgacaaatgtttacttcttataagaagcaagggccaggtgcagtggctcacgcctgtaatcccaacattttgggaggccaaggcgggtgcatcacctgaggtcgagtttgagatcagcctgaccaacatgatgaaaccccttctctactaaaaatacaaaaaaattagccaggcaagctagtagatgcctgtagtcccagctactcaagaggctgaggcaggagaattgcttgaacttgggaggcggaagttgcagtgagccaagatcgtgccactgcactccagcctgggagacagagcaagacttggtctcaaaaaaaaaaaaaaaaaaaaaaaaaagcagcagcaagggttgccagcagctaagctatctttacagaaggaaatgcttgtttctctatttcctctgtaaaaatatgggattctaaagttctgaggtctcaaaggtgtgccctgagacaggagtatgacctaaagcaggaagataacaatttcatctcttcattgccccaacactttacacatgagacaaagcaggctgggcgctgtggctcaggcctgtaatcccagcactttgggaagccgaggcaggcagatcacctgaggttgggagttcgagaccagcctggccaacatggagaaaccccgtctctactaaaaaaatataaaattagatgggcatggtggcaggcacctgtaatcccagctacttgggaggctgaggtaggaaaatggcgggaggcagaggttgcagtgagccgagatagtgccaccgcattccagcctgagcgacaagagcgagactttgtctcaaaaaaaaaaaaaaaaaaaaaaaaaaagagacagtggaaatgctaatcagccaaatattccattttcattgtgatacatacaaaaaattgcatttttctggaaaaataatgctgtattatgtttccagactggcccagaaatacatgttaagtatttttttaaccaaaattatactggtaatattataggtttttatagtgttgtccaggaattaactaccgcttgcaacattgtttaaagataagacttcattttcccatggcaatttacaaatgcacttttggaacatacaccatttgtgagtttggaaagattgcctgttttaaaatttaaaaactggttaattttattaaataatcttaaagggatttaatcatcagataatttgtattttttaactaattctgccctcctaccatcaccatttttttatttccctgattatgtcatgaacttgttttttttaatgtctgtatttttactatcttggtttcactgggcacggtggctcacctgaggtcaggagtttgagactatcctagccaacatggagaatccccatctctactaaaaatacaaaaattagctgggtgtggtggagggcacctgtaatcccagctactcagaaggctgaggcagaagaatcgcttgaacccaggatgcggaagttgcagtgagccaagttcacaccattgcactctagcatgggcaacaaaggcgaaactccgtctcaaaaaaatatatatatattggtttcatctgtgaaatttctaatttctagataactatatcctttaaatctctaatttgaaaataaatcaaaatacctatttccatcttgaatacaagatttttggttttaactcaagcaatctcaaaatatgcagaatgattgagaatgtcacctatgatattcttcaatattatttattaaaaaccacaaatgccattatatgaacccacttgaagaagaaatttttaaattaggtaaaataatgtgaattatctaacaaatgtcatgacgatcaagttctcaaactacactaagtcataaaactcaagttaccaatttgaataaaaatattcaattactacctgtatttaaagatttatcacttatagaaataaaaaaaatagggcttattattatagccaccgatgtaacaacaatgtatacaaattctcacatttgtttccaaaattttaactaccataattctttcttagaaacatggtcttaacgtctcccccattacttaagatttctaggggaaggagggggaattttaattatttaaaaagaccaaatcaaattgatgtgaaatgaccagaataagcaaatcattagattaatagttaccataggtcggggacagaagtggggagtacagaaggagaagaaatgagaagtgactgctaaagggtacagggtaacttttcgaagtattataaatgctctaaagttagactgtggcaatggttgtacaactctgaatatagtaaagtcaaaaaatgtatgctttttttttttttagacaaagggtcttgctctgttgtccaggctggagtgcaatggcacaatctcagcttgctgcaacctccgcttcccaggtccaagcaattcttctgcctcagcctcctaagtagctgggactacaggcacatgccaccacacctggcaaatttttgtatttttagtagagacagggtttcactattttggctaggctgttcttgaactattgacctcaagccactgggtctggccaatatacactttaaatgaatgaattttgtaatttgtgaaatgtatttcaataaagctataaagaaaagcacatgcaggctgggcgtaatggctcatgcctgtaatcccagcaatttgggaggcgaggtgggtggatcacctgaggtcaggggtttgaggccagcctggccaacatgatgaaaccccatctctaccaaaaaaataaataaataaataaataaataaataaataaataaataaataaataaaataaattagccaggcatggtggtgtgcgcctgtagtcccagctactcgggaggctgataggagaattgcttgaacctgagaggcagtgggtgcagttagccaaaatcgcgccaactgcactacaacctgggcaacagaccaagactccatctcaaaaaaaaaaaaaacaaatcagtcaggcttggtggcaggcacctgcaatcccagctactcgggaggctgaggcaggagaatcacttcaacccaggaggcagaggttgcagtgagccgagatcgtgccaccacactccagcctgggcaagaaagggcaaaacttcatttcaaaaaaaaaaattttaagtataaaatgtctcggttcttcctataggatagtagtttagtattaaatcagttacaaaataaagaaaatgaaaacagaaaatcacatttttaaaaaacatcctcaaggctgttaaaatgacatttctaacgtcattcttttttcttaagaagggtcttgatgtgtacccagactggagtacagtggctcgatgacagctcactgcagcctcaactcctgggctcaagtgatcctccctcagtgccccccacacccccaccaatcatttggactacaggcacgtgacaacatgccgggctaatttttaaatttttttgtagagaaaaggtctcgctttgtttgcccaggctggtctcaaaccccttctctctggcgatccactcacctcagactaccaaagtgctggtattacgggtatgagccaccagccctggccttctatgtttttaataatgcactcatacttagcagcaagtaaaagctgaaataaataaataattctaaacaaaatttaagtttagaaacttagaagatattttaaccaaataaatataaatactattttatcaaggaaaacaaaactgtattgaataccaataatataaatggctataaaagtggtgataaacgtttaaaacttttagttcacaaacaatcctgatagaagaggaataacagtacatcaatttagtggccacagaatagcctgagatcatgacagtgttatgcgttcatcaccaccaatactagatgttttttacttttaaaaaagttaaaaatgctcacgcctgtaatcccagcactttgggaggccaaggagggcagatcacgaggtcaggagatcgagaccatcctggctaacatggtgaaaccccgtctctactaaaaatacaaaaaattagccaggcgtggtggcaggtgcctgtagtcccagctacttgggaggctgaggcaagagaatggtgtgaacctgggaggtggagcttgcagtgagccaagatcacgccactgcactccagcctgggcgacagagcaagattccgtctcaataaataaataaataaataaataaataaataaataaataaataaacgtatgttaaaatgatttatatatatttagggggtacaagtatagatttcttacacgcatatgttatgtagcggtgaagactaggcttttagtgtacctattatctgaacagtgaatagtgtacccacaggtagttgttcaaccctcaccacccccacccaacctcccaccttttgtaaagtctccaatgtctatcattccactctatgtccataggtacccattgtctagctccaacttgtaagtgaaaacgtggtatttgactaagttatttcacttaggataatcaacctccagttccattcacactgctgcaaaggacatgatttcattcttttgtgtggctaagtagaaatactagatttttttttaaaggggagagagttttcagcatttttactggcaaagtctgccattaagatcatgacccagtcctcaatttccttattcaacatcctttacattgggacaattttctgaggaataaatttctgctgaagatagaggaaaaaagatacattctatcaacagtctttcttttatgaaccaatgagctttatacatcatattctatcttggatgaccagaagctcaacagcttttttttctttttttttttttttgagacagagtctcactctgtcacccaggctggaatgcagtggcaagatcatggctcatggcagcctctacctcctggcctcaagtgatcctcccacctcagcctcccgagtagctggtactacaggtgtgcaccaccatgcccaggtaatttttttaacttttcgtagcgatgggatttcagcatgctgcccaggctggtcttgaactcctgggctcaagcaatctgccagcctcaacctgccgaaatgctgggattacaggtttgagccacccatgcccagccttggtcttaattccataaactctctttttttcttgttttctgatacattatgctctttactcctctcttaccacaaattcagcccatattttatcttgttctgtaaactgtaattttattggtatttctaaaatgtatttaaatgattttttttttaaaaaacatgaaatataaatgattttttaaaataacatttttcaaaagcaaaaaataatctcttacctgtttgacgtctcgaacaagatgaaacagcattggattagttggaccttgtttctttagggagaaaaagttacagcaaactattatttttcttctaaactaatttaaaccttacaggatttttatgaaccttcttatacaaattacattgttttggagttatttccttaagttctattcataaagtagaacaacaaagaattttcacatttactgccaaaaaacaaataatcttaagagtatcactaaaatgatacataagtttttgtttcacaaaagtcatcactgcaactttacaattgtatcttaaatttaaatttacatttctttcattgataatggcgctgtacaatacctttcttcttgttaaaatgtctgttcctctgtttctgtcactaataaagtcatattgagactttaaatattttgggtaacaagactttaacacaagcttgttcaacctgtaacccacgggctgcatgcagcccaagatggctttgaatatggcccaagacaaatttgtaaactttcttaaaacatagagtttttttttcaatttttttcaatttttttttttttaagctcatcagctatcgttagtgttagtgtattttatgtgtggcccaagacaatttttcttccaatgtggcccaggaaagccaaaagattggacatccctgatttaacatttatatatgccataattttgccattatcttacttctctttatatatactgttagagtgggccacctaccattatttctttggagaaaaagttattttctttgatattcttggctttcaaattctatataatatttaagatgactacaattgatattgcatatgaatcatattttactttactttgctctgccttctttttacaatatttatttagggctgggcgcggtggctcaagcctataatcccagcactttgggaggcagaagcgggtggatcacctgaggtcaggagttcgagaccagcctgaccaacacgcagaaaccccgtctctactaaaaaaacacaaaattagccgggtgtggtggcacatgcctttaattccaggtactcgggaggctgaggtagaagaatcgcttgaacccgggaggcggaggttgcggtaagccgagatcgcgtcattgcactccagtctcagcaacaagagtgaaactccatcccccaaaaaagtaaaaaatttaaaaaattccatcctggctaacacggtgaaaccccgtctctactaaaaatacaaaaaattagccgggcatggtggcgggcgcctgtagtcccagctactcgggaggctgaggcaggagaatgccgtgaacccctgggggcggagcctgcagtgagccaagatcgcgccactgcactccagcctgggcaacagcgagactccgtctcaaaaaaaaaaaaaaaaaaaaaaaaacctatttatttagtcgatcaactcaggggctaagttctctctgccaattctcccccacaggtgaactttttaaaataaaagtttcttctaagttaataagacgtatctcatattttgggggtattggggaatttcattgcatttttctctaacggtatgtaatcacatggaaaggcacttaaaatttcttaaattctattttatcctactctattaaatgtttatccattaaaaataaattgttaataaataataaatgtactttaacacagtaattctcaaagtgtgacctggggacacctgaggcccccatgattccttcaggagttccacaagatcaagacttttttcctaatcatattaaaattgtattatttcattcttattctctcagtgtttggtggagttttccagaggctttttgatgtgtgatattgtgagattgaattcagaagcaaatacgagaatccagctgcttttataaggctagactttaaagacatttgcaaacgtgttttcctcttctcaccaatttttttgttttctttaaaaataaaaacatagcaggctgggtgcggtggctcatgcttgtaatcccagcactttgggaggtcgaggcagtggatcaccttaggtcaggagttcaagaccaacctggccaacacggtgaaacctcatcactactaaaaatacagaaattagctgggcgtggtggtgggcatctataatcccagcaacttgggaggctgaggcaggagaatcgcttgaacctgggaggtggaggtcgcattgagccaagattgtgccactgctctccagcctggatgacaagagcaaaactgcgtctcaaaaaaacaaaacaaaacaaaaaaaaagtatcaggcagaagggtgctaatttaagaaaaaagaaataagaacaaatatttatgttaatatgggataagtttagaaattttaagtaaatataactgctactttaataaaaacaaatattttttaaaactctcatttttacattctaaaataccaacacacacaaacaaaacctctttagaaaagctctttgaagttctcaataattttaatgtaaaggaaccctgaaaatcaaaaagtttgagaactactgctttatcatgttgcaagcccttaaatgttttaaaacttcatcaataattgatgctgaaagtaactacagtattatcttaacacctttgagtcatacaatttaaaaaattacttgtcttgctaatgggatcaatttttatttttattattttacattgctttatagttcaggtataaaccttactacagcacaatgaataatccttttaatttttacatctgtccactagggacagtaaaatgccaacaaagttcaacgcaaatgtgctacacatactaaaagaaaataatggaagctgggcccagtggctcacgcctgtaatcccagaactttgggaggctgaggcaggcggatcatctgaagtcgggagttcaagaccagcctggccaacatggcgaaaccccatctccactaaaaatacaaaaattagctgggcatggtggcatgcacctgtaatcccagctactcaggaggctgaggcaggaaaattgcttgaacccggaaggcagaggttgcagtgagcccagatcgtgccactgcgctccagcttgggcaacagagtgagattctttctcaaaaaaagaaaaaaaagggagaaaatgagatataatacctacttcaaagaaatttacaatccaaagggaaagacataataattgtacttaactatgccaccaagcttcatggaaccagtggcatggcatttaagctaagtcctaagcaattaataaaatttcaataaatgggttattagttggaagcaaaacagaccagcactgtgaaaatagcaaatgcttttttttaaaaaagtttgcatttttggccgggtgcagtggctcacgcctgtaatcccagtgctttgggaggctgaggcgggcagatcacgaggtcaagagatcaagaccatcctggccaacatggtgaaaccccgactctactaaaaacacaaaaattagctgggtgcagtggcacacgcctgtagtcccagctacctgggaggctgaggcaggagaatcacttgaaccagggaggcggaggctgcagtgagcaaagatggcaccactgcactccagcctggtgacagagcgagattctgtcaaaaaaaaaaaaaagaaagaaaaaagtttgtatttttagtaaatagtaggtagacatttaccatcttattgctgccccgccccctccccgccccgccctggatttggggggcaataaaaaggccaagtgagaaaagtagatggggcaatatatgaagatctttgaaaatcaagttaaggatttgggtagtaaactcatattcataacacagaaaaccactaagaagggtagtatatcttcaatgctaatacaataaaaatttggaataaaatgtgaaagtctttgttacgagaatagtaagttttcaggagtcctttacaaaaaaaatgaaaacagtatgtaagctaaaaggggtataccatgaggtcaaacaatgaatgtaaaaaaagaaaaaaaaaaagagaaaaaagcaatgcataattcctccattagacaacggagtcaaaagaaacataatcaccctataattaagaagttgatcctctagttttgataaggggagggaaagggaaatacacaggaaagagaggtaggcttaatagccctatgtggttatggtgacagggaatgggttctaaaaacaaggaaagggtttcagactgtaatacaaccaatccatactaagactggctataattttttcatataactaaggaagacattaagggttttatcaataggaatggctatattcaggtaaagtaacatttcccaaaagataaaatgtagtcaataaagaattttaatgtagacttacagtgttgtaaagttcttccagtctcggaatggtaaggaatttatgcatgcttactccattttcaataagaagttttacaaatgcaactctatccattacaagagcatcaagcatagcttgttccaaggatccaacctaggagtatcaaatttaataaatacatatttcacatattctaattatacaaacacttttaaatgttaagtccttaggatttacatttaatttgttcccaacagttttagaacaaaattagaaagatgcaacacagtaaaaagctaataagactttaggtgtttagggaatagattaaaagacctctctagaacaacgtttcttaaagaatattccacaaacactacttctgtaggagaataagtgttacatgggggaaaaaacagaatccatcatcaattaaatcttgggaaagaataccttaaagcaatgctctcagtgtttagggaaggttttgtgggaaggattatttcaataattgagtgctgttactaacatttaatgggtagggtcaagggacatcagaaatcatgcaatatgctggagaattctactcagaaagaaactatcccgcatcccacacaactttttattatcctgttagatgtttatgactgaaaaaccagtaattctgccttacaaatgaacacaaagtatttcatcatagtttttgttctacagtgaattttccaaaaatacaaccatcagataagtcaggcaagattgtacttagtcttcagaactttaaaagaaatcattcatcattatggaaaagaaatcacttgacagcaatacaacttatgtcctttgtgcttaatataacacatctgtatcattcagcatttgtagctgtcctttatatattaaagcctattttataaacttcaacagacttgaaatcaaatattggtaaattagtagggacatgaaatataggtatttcactgagttttattaataaaggttgttttaatatagtctgtatattttttaatattttgtatatttctgtgtattttaagtattttagtaccacattattaaaaacatctctgtggcaaaaatcaatacaaaaccactggtttttttacccattatttttcaatcttattctatcttcagaggtttaacacacaactacacaacttctctagagcaacttgtattaccatttctttctccaatctatcttcgatttacatcacctagcaaggatatagtcttcatgatattttaagtatatactttctgtttttttgagacggggtctcattctgtcacccagtggcacaatcatagctcactgcagcctcaaactcaggggttcaagggatgttcccacctcagcctcccacgtagctaagaactacaggtgtgtacccctgacccctgtacctgccttttttctttttctttatttttaaaatagggacaggtctcaaactcctggcctcaagtgatcttcctaactcagcctcccacagtactggaattagaggcatgagccaccacacccagtcctattttaagtatatactgatgaaatgtatgccttttacatgatggaatttaaagatgaaaggtatgttttctgtgacatttttcaatactcagttctgtcacaacaaggaaaatatttttcacttgcttaaaaataaggcctgatctccaagaaaataatacttattagttttctctacattattaggctgtagtttatcatggcatcgtactattttacttaagattatttccttctttctcttatcacatacaaataatcctaatgttattacttactctaacagtaatattctaacattattctagtgcccacttggtctttctttgtcctacacttgcaaagggtgtttatctgttccccaggatatttaagttaccaacaacatacttgtattagtatgtataactgcagcatttacactgattcttattataactgcaggcatctgacttattatgtgttttatattgccactcttgaacatttatatactgaaatatttattttttattataaatcattttttctgtcttattacaattagggcattatacatatattcttaatttatgtaattacttatgaaatttcactttagtagaataaaaggggatataacaaaatattgtttttaaaacaagaacattctgtgtttataaccactgccctagaacaaaatcttaattttcatatctgagggggaaaaagggaccattttaaaaaaaagtgtctgttttgtaaggagcatttcctcacactcaatgcatattgaactcctggcaagcaagaagaaagaagaaaaacaactgtcctgcaaattctaagtttagcaagaagcacaaaatcaaataggtaacactatgcagaagaaattcatcagacaaaccacatatacacagaagataaatgcttcatccaagcctttacatctgagaacaaaatccagttaaattattcaagggaaaaataaggttggttatagtcatcaccacagatgattaacattaatttttttcctctgtagtcctgcaagaggagaagtgactaaataaactcttttttattgctatataggaaatacattcccatggttaaaaaaaaaaaaatcaaacactacaaaatggtataaaataaaactttccttcagcccccatctctccaagatgaatcccatgttaacagttttagaaaggtactattaactacacagtacatgtagatatgcatgaatgtttgtacattcataaggagaatttgccacaattaagatcatactgtgcatacttttctgcaatttgctgtttatatttactatgtggacaaaaaggatctagtttgtcctccgtaaaggctggtaatacttcaaggtacagatgaacagttaatctgcccagcctcttattaattcggacatgtaacaaaactttaagtgattactacctaccaagctgtcaatacagtagtaaacaaaactgaaaaatattcttgccctcagaaagtttactttctaggagaaagacaaacaataaataatagctacattatatggtttgtcagatggtgacaaaagttagaaaaaaatagcagggaagaatgctggtttagggggatgctattaaaatagggtagacagaggaagtccaaagaggagacatttggttagaggccagaaagataggaggaattaagcccacgtgggtatgtagggaaaaatgttaagatagagagacaggcaagtacaaagcctagagataggagcatgcttgatatgttcaaagaagagcaagaacgtcaacaaggttagataaaaaagagcaaagaggatagtagtagcatgtaaggctctgggttatgctctgaataaatggaatgtgattcatctcctgtccataaaaggagagcaagtatgagagtagtgaaaccaaaaagtatgctaccgaaataacacaaaagaaggatgacagactagaccaggatgataaaattaggtattttgaaactagatctgacaagatttacagatggaattggattggaatacatgagaaagagaaaagtaaaggataacactaaagagtctcatcttagaaactaggaagaagttgttcccatttagtaggatgaggaagactaaaaaaggaataggtctaaacatcagggggaatgctagaatggactctctggtatacagagcatgagttttaaagcttctttcagttctaagattcttagagatctatatactctacaaaaaaataaggttttatctagaggcatacattaaatcctaaactggatcggaatggtgtagaaatacttagctaaactatttttgaactattggcagaaaggtaaaatgtcaagtcaggtcacagttcccgcaaatacttttttattacttagtgtaatttaattgtattgtgtatgtagattatttacataccagccactgctgtccataaacaaatacatgatttttggcaatgtcaactctatcccatgccaatgtaaggataagctggtcaaatgcagatgcattagtacctaatcgaataaagaaaatagttgacaggttcaattaatttatctccattaaaaggtgaacactttttttttttttaagagatggggtcttggtctgttgctcaggctaaagtgcaaaggtgatcatggctcactgcagccttgaattcctgggttcaagtgtacctcccgccttagcctccaagtagccgagactacagatgagcaccaccacacccagctaattttttaacttttttgtagagacagtctcactctgctgaccaggctggtctcaaactcccggcctcaagtgatcctgccacttcggcctcccagtgtgctaggattacaagtgtgagccacagtgcccagcacgaacacttatgacatctccccaccattctttagttaacttacacagctggtgtcagccaccattcagaagtagcctgcctcagagataagattagccccagggttaagaactttacctttccagctataaacgacatattcccattcattgcaaacatttagaaatgcagaaaaatgagaagaaaacaaagatgaactgtttctatcacagagatagcgctattaggattctgaaaatagcctgccaggcacctttctgtgcacatacaagctcatgcatatactttccattttttattcaaaaatgggttcatactacaaaagtgttcagtagcttgctttatgtaccttgatatcgtaccttggttcttcttaaaattatacataaatctcccttatatatacttaggtaaaccacaatttatttaacaaatacttcaaatggtagatattcaggttattttgaattttttgctgagtatgttttcatgcacatgcttgattattcaaataggatgatattctagaagtcaaattgctaggtacaaggatatatactttaaggtttttgatatactccaaaatacttcagattgcttctaccatccaccatgggaggggtataaccataaccatttctccatgtgccatggagaggggagtttccttcttcttctcttttctgagaccgagtctctccctgttgtccaggctggagtgcagtggcgtggtcttggttcactgcaacctctgcctcctgggctcaactgatcctcccacctcagcctctcaagtagctgggaccactggtgtatggcaccacaccaggctaagttttgtattttttgtagagatagggttttgccaaattgcccagactgatctcaaactcctgggctcaagcaatctgcttgcctcagcctcccaaaatttattactgtaacattggccatccttccatattttctctaagcatttggattcctctactaattatctattacataagttctgacccatttttctaagaggtagtcatctttttcttattaatttttaacagctctttttgatccctctactttaacatttctattccttagtttcctcatctataaaatgagtaaagccataggaaatctgacttgtaggaataaaatgagataaataatgtaaaccacttgaacacagtggttaatacacagaaaagtacatggtaaataattcatgaatatggtactctctttttaacctttttttttttttttttttttggagacagtttcactctgtcacccaggctgtagtgcagtggtgtgatcctggctcactgcaacctctgccttccgggttcaagcaattcttgtgcctcagcctccagagtagccgggactacaggcatccaccaccacccccagctaatttttgtattgttagtagagacgaggtttcgccatgttggccaggctgatcttgaactcctgacctcaagtgatccacccgccttagcctcccaaattgctgggattacaggtgtgagccagcgcacgcagccttactttttatttttatgcactcccatttattaattttttttcctttttggtttctaggtttcctatcacttgtgatctcttgataccatgattccagatgatataaatatattttatcacagtattttaaaaatgcttgatgtattggcaatttattatggtctaatatgcaagaaaattcttgtaaataaaaggacagtatcctcttaatgtgctgggctcctggcacatcactctacactaactttcaggtagacagatgggataccgtcatagtttctaatttctgagaagatttttcgctataatgttgttatatctgttggatgtctttggggagacaataagaggatcagtgtgtgtgtgcttcaatcccttagtcctaaaagataccactagttttcaaattttcccttcataatgaagatgacatgttttaaaatcctatctttatattctatcaactaatgccttataacctttaaacacttatttttcagctgattaagaaagtgacacatttttatttggagacagggtcttgctgtcacccaggctggagtgtagcagtgtgataatggctcactgtaacctcaaaccctgggctcaagcaatcctcccgcctcagcctcctgaacagctgggactacagagtgcacaccaccatgcccagctaatttttctttgttgtgagatagggtcttgctctgttgcccaaactggaatacagcggcatgatcacagctcactgcagcctcaactttccaggatcaggtgattccacctcagcctcccaagtagctgggactacaggtaaatgccaccatgcccaggtaatttttaaactttttgtagagatgggtctatcttgtccaggctggtcttgaactcctggcctcaagtgatcctcctgctttggctcccaaagtgttgggattacaggtgtgagccaccatgcctggcccaggatgttagacgttcttaataggactattaaataggtttggtggcataaaccttgctaaaaacttttattttttaaattctacaagattaaattaaaagttaccttgccgccaaggaaaccaacattgtgtctttcacaaagaaaaatgactgaaaattcactttgcaagcatttagccatggtaaaaggttttatattttatatacatacacatatacacacatacacacacatatacatacataaaataaaaggtcttacaaataaaaaagttcttagaggcttaccttttagcagtgcagtaagtattgctacatctatatcttgatgttcatctgacccaatatggaaaacagtgatctatttaaagataaatttataacattatgcctttatatttttaaaacaaaggcatcataaaactcagtaatttcaaactatatggggggcaaaatatatatgtatgtatctaggaatctatgtattatgtatatataaacatacatacacataatatatttatgtatatagttagtaactttatttcaaccaaaaaaccaaaaaattttaaaaactttatcatttactaaataaaatggcaaatatactaaaaatatttggtttcatattacattcatattttgacctatcttatgtcccttactagagtaagaaatttaggggctgaggctatagattccttatcagggtaaataaatcctacaggtccttccacagaatgaacatttacatgttcacataatgtatatattcttgaaagataaatgtttgttttggtcaatatttttattgcaaatatctttaaatcacttgaaacatagcaccatttcagaaattgtaatttaataacatttttcataaagtgaaagatggccaggcccatggctcatgcttgtaatcccagcaatttgggaggccaaggtgggcggatcacgtgaggttaggagttcgagaccagcctggccaacacagtgaaacaccgcctctagtcaaaatacaaaaattagccaggcatggtggcgtatgcctgtagtcgggaggctgaggtgggagaatcgcttgcacccgggagacagaggttgcagtgagctgagattgcaccacggcactccagcttgagcaatggagcgagactctgtctccaaaaaaaaaaataaataaaaataaagaaaagaacgtgaaacattattatacaaaatttttggccaactttatttcatagtttacaaaaacttgcaatgaaaaagacagcaaatcaaatcatgttatgtatttataggcttgctaaaaattttatctctgaaaacttatgcccacatttacatgattgaaacaaagcagcactgatctttaatttaataggcttaagcacattaaaaatttttttccaaacattttattagagaaaccattaacaactctttatagttcttccttggtactgaacattatctgttgagacctagttacttttcctaaaacttttcctaaaacagaagcacaaatacagtctcaataccatataaaaaactacaggcctccttctatgatacctctcaacttgaacagaccaataaatgacatatttttatggttaataaagatttcaaagtttaaaatccaaataaaaacaaaagtatttcaccagtttagaatgtgttttgaatgaaagaaaaatggcctatcagctttttaaatttctgctgaaatctacttacaagctcctttcttttcatgcactccatcagtgtttgaaataaatgaagtgcttcattctggccaaagttaaatgtttttttgatagtggaaataatatcgggctctgctgcatcaggaagattcctggaataaaaggaaacataattcactgatttcatcttccattatttgtaggatcaatatgaagtacaggtagatccatgtaagacctttgaaaataatggattaatattacatacttcaccttgggtgggattatttcttcctacatgagactcccaacacaaatgttagaaggaaaataaatgaaacggagtgatttttctctttgaattactttgtgaattttatcaaaaagtatgtgtgtggcaatatcagtacttacataagatattgtataaaaataatttgaagatcttatgatgtataaactagtatttcaccacgatgttcttaaacataggaactcacatttttcttttttgaatacttaatacattttcatggctcaaaaatagtagaaaacataaaatgttaaaacattaaaattaatagtgaaagtctccttcccgctctctttcatctgcccagttctatcacaactatttttaggaatcatttacttatatataactttccaagatgtctttctgcatatacaaataattatcccctctccttttattctatataaaaagtggcacaatatatatgcttctctacaccttcctttttgcatgtacatattttggtaatcttctcaaaaccattcttactcagctataaaccatttctttgtataaatacaccataacttatctagtcttctcatgttctactttgttccaatcttttataaagaaccccgtaatgagtagctttaaacatatattatttcacagatatacatctgtaggaacaattcccagaaatgaaactactacgttaaaagataagtgcctctacgtttgacacatcttacaaaactgtgttccatgaagatggttttattttaatttgttccaataacatatgagtcaggctatttcctcaacccttaacaaagtattgtattaaacttaacattttcatgttcataaaacacagggaggaatccaacactgtattctaaaaaccacaagccactttaataaattcattaaaatgggccaggcatggtggctcatgcctgtaatcccagcactttgggaggctgaggcaggtggatcacttgaggtcaggagttcaagactagcctgcccaacacagtgaaaccccatctctactaaaaagatacaaaaattagccagacgtggtggctcatgcatgtaatcccagctaattgggaggctgaggcaggaaaatcgcttgaacctgggaggtggaggttgtagtaagccaagattgcaccactgcacgctatccaggctgggagacacagcaagactccgtatcaaaaataaataaataaataaataaataaaattaattaaaatgttgtcatacacttaccctccttcttctgtttgtttatgaatatacgctagcagatctgcagctctgcctgttccttcacacacaactactggaacaggggggctttcctgaaggtattcaagaactgtgaggataacatttggcccaccctcaaatataagtgccaccacagggacaccctggccaatccctaaaaagagcaaagttaaattaaaaaattatttcatcccaagcaagtttctctccaagaaaaaaaaattaggcaaaattcagtactctaattttagattttactgaaaaaaaattaaaaagtaaaaacataatttctaagactatgttgacttgactttaagcactccacctgataccagttcacgtaagtaaattaaataatgaatactttgtcactatcttaaaagctgttctctaaatgacaaaattagaaaatccaatatataatagacagcaaataatttatatattcactacttaaaagtaaaaatttgttttccatattttactgagctcttgacgtgaaatgtaaacagtaattttttagtttgctttacaatacattagttgaacttctaacattgatttttattcatttttaaaatatatatttctgattccaaatgagacattaaaatagaaattaatgacagtcttggccgggcgtggtggctcatgcctgtaatcccagcactttcggagaccaagatggacggatcacaaggtcaggagatcaagaccatcctggctaacacagtgaaaccctgtctctactgaaaatacaaaaaattaaccaggtgtggtggcaagcacctgtagtcccagctactcaggagggctgaggcaggagaatcacctgaacccaggaggcagaggttgcagtgagccaagatcatgccactgcactccagcctggtgacagagcgagactccctcacataaaaaaaaaaaaaaaaaaaaaaaaaaagactgtctcaaatgccacctgaaaggtttgtaaaaaagaaaaaagaaatggctcacgcctgtaatcccagcactttgagaggccaagtcgggcagatcacgaggtcaggagatcgagaccttcctggctaacatggtgaaaccccgtctctactaaaaatacaaaaaagtagccgggcatggtggcatgcgcctgcagtcccagctactcgggaggctgaggcaggagaattacttgaacccgggaggcgaaagttgcagtgagctgagatcgtgccactgcactccagcctgagcaacagagcaagactccatctcccaaaaaaaaaaaaaaaaaaaaaaaaaaagaggacggctgggtatggtggctcatgcctgtaattgcagtacttcaggaggccgaggccggcgatcacgaggtcaggagatcaaaagcagcctggccaacatagtgaaacctcctatctaccaaaaatacaaaaaattagctggggcgtggtggcgagtgcctgtaatcctagctactcgggaggctgagggatgagaatcgcttgaacccaggaggcagaggttgcagcgaggtgagatcgggccactgcacaacagccagggcgacagtgcgagactccatctcaaaaaaagaaaaaaaaaattaaaaattaaagaagaaattgatgacagaattacataactggaactgatcaataaaattccaagacctctagaagagcaacaacagataaaattagtgaagaatatgaatttttgcttttacaataacttgcggtgcacagagaaaatggaaaaaaaaaaggtatctgtaggactataaacaattcttaactttttttttttttttgcaatggagtcttgctctgtcaaccaggctgaaatgcagtgacgcgatcttggctcacctcactgcagcctccgcctcctgggctcaaacaattctcctgtctcagcctcccaagaagctgggactacaagcacacgccaccacgctcggctaatttttgtatttttaggagagacagggtttcaccatactggtcagtctggtctagaattcctgacctcaggtgatccacccacctcggcctcccaaagtgctgcgattataggcatgagccagcacgcccagcccattcttaacttttagcaaaagttctgactccaccataatctgtaaacactgttctgtagtttttttatttctatttcactttaccacagagctcaacttcctggggtccttaggttacaaattttcctttatttgaaataaaaatttagatgttgaaccagaaaattcagacatggttggaaagaaaaatcagtcccaggaatacaatttttaagacacatttagccaaacagtgatactcatttcataaattttaagctgatttatttctttcagtgatttttttcccttttagttttcaatcttgaatttcacagccatgtattagaataaatcacacattaagaatatttatgggtcaggcgcagtggctcacgcctgtaatcccagctctttgggaggccgagacgggcagatcatgaagtcaggaaattgagatcatcctggctaacatggtgaaaccctgtctctactaaaaatacaaattagctgggcatggtagcgggcacctgtagtcctagctactcaggaggctgaggcagaagaatggtgtgaacccaggaggcagggcttgcagtgagccgagatcatgccactgcactccagcctgggtgacagagcgagactccgcctcaaagaaaaaaaaaaaaaaagaatatttatgaattccttgggctgaaatggaattgcaataacaacagagcttccaatgaaccttttttggttttagccttgataactgagtacccaattttcacttcttttccttggtcttatcattttgtctaagatcaaccactgttggttgtttcatatgttatcttgctatgtaagaaagagcacttcaaagaacattctactttctttgaatttggctattagtacagcccaggacaatttcaacaataacaaatttgtgaattcacttactagcatgaattctttgctgattaatagttttttcaagttctcttctcagtctgacttccgccccatactttccaacagtgccatcatccaccaatatgaaatgggaatgcagattattcaaaacattcaatttgctcagggggttcaataaggtttgataaggagcaaccacctaaacaatagcaaacaaaagagttagtgagcaggattaaatacagtatgatgtaaaataaattttgaaataatccgtaaagacaagtaagaagtaaaattctattttacatacagaaataaataccaaatgacaaagaatgtttcaaaaagcgtaagcttttaagcagctgaggattaatcattaatgggttgaaacacatgattatatcttgacccatactgcagaattatatatttcatcatcacatgcaaagagagaagcaataaataactaaatagtgcaaataaactattatcagattattaagtgactaaactacaatatataaaagatattgtggccaggcacagtggctcatgcatgtgatcccgtcactttgggaggccgaggcgagtggattacctgaggtcaggagttcaagaccagcctggccaacatggtgaaaccccatctctactaaaactacaaaaattagatgggaggccgggcgcggtggctcacgcctgtaatcccagcactttgggaggccgaggcgggcggatcatgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaaattagatgggtgtagtggtgggtgcctgtaatcctagctattcaggaggctgaggcaggagaatcacttgaacctgggaggaggaggttgcagtgagaccagatcgtgctactgcactccagcctgggcgacaagagtgaaactccatttcaaaaaaaaaagacactgtaaaaaacaataaaatgtaatattgctatttttccagccatgagtagactcaaaaactgacattagaaatttaataacacttgaaagtgatcattataattcagtaattgtatgtatgtatgtatgtatgtatgtatgagatggagttttgctttgtcacctaggctggaatgcagtggctcaatttcagctcactgcaacctctgccttccagtttcaagcaattctcccgcctcagcctcccaagtagctaggaggcacaggccactacacccagttaatttttgtatttttagtagagacggggtttcaccatgttggccaggctggtcgtgaactcctgatctccagtgatcagcccgcctcagcctccaaagtgctgggattacaggtgtgagccactgcgcccagccagtaattctttttaacagtgttgataaatatctataaccaattcacatgtctttaacctattcaaacaaaacactagcatttaactcctattccctagtcttagtgagaataaaattaattctcatgtcatgtagtcattaaaaatttaattacaaagactagcttatatggaaaatgtgaaataattttacacataaaagactgaaagcaaaatgtgccaacactgtaacagcatttatatttatgaacttaattatttatagttatgaattatttatatttatgcatttccaaaaattcagaagtaaacctcaggaaaataccttttaaacttaatttgaaaagtataatataatcataaatattttaaactggcactattcttactataattttgtttacatataatttcaaacataagaaattttaaaaataattcttacatctctcccaacaagatcatttctgttttcaatcactccccatggagctattccgatagtgcaaatctttcgagatgatctggaagcatgttctttgagggcatctccaacatgttttgccacacctgttcataaaaaaagtttattcattttgttttttttattttcttaaagacagggtcacccaggaaagagagcagtggcgcaatgacagctcactgcagcctcaaactcctggactcaagcgatcctcccttgtgagcctccccagtaggtgggactacaggtgcgtgctaagacagccggctaattttttttttttttttttcagtagagacaggtgggtcttgaactcttgggctcatgcctcagcctcccaaagttctgggattacagtcattactgtgttcagaacaatcctgtgctaaatctgtaacactataatatgtgatatatttctccacaccttcaagatataaggcaacaaggtcataacaaacttaaaacaaggtcatagccaaacctacagaagaatacacaaggaccaaaaaggaacaaaaaccactaaaccccacaatatcaaatcactacaaatgccagaaaacacatataacactaaattttaccatgttatttggtctagtccgtttttgcatttctcctctaagtaactgtagttttttattattgctctacacatcatttagaaaaaattaatcggtggcacaggaccatacgcaaaacacacacacacacaataaacaatgacaaaagtctatttcagtcaaaaatgagagagaaaagtataaaaggcagttccaaagagcatataactcctcattatcacttcttttttttgagggagggagtcagggtctcactctattgcccaggctggagtgcagtggtgtgatcatggcttagctcactgcagccttgacctcccgggctcaagtgatcctcccacctcagcctcccaagtagctaggagggtaggcacataccaccatgccggggtaatttttttttctttttttttttttttttagaaagtgtcttaccatgttgcccaggctagttttgaactcctgggctcaagtgatcctcccacctcagcctcccaaagtgctgggattataggcatgaaccaccatgcctggcccattattacttcttatgggctgaattgtgtcccctaactcccaataccataaaatatgactgcagttggagacagggcctttatatatgtgataataccttaaaacattactgtacttggaggcagggcctttaaatatgtgacgattaatttaaaataaggcctctggagtggccctgaatctaactggtgctcttataaagaaatctgaatacaaaaggaaacaccaaggatacctatacacaggaggccatgagagggaggacacagtgtgaagatgaccatgtgcaagccaaagagagaggccccaagataaaccaaatctgctgacacttactcttagacttttaatctcggaaaccatgagaaaataaatttctgtttttaagccacccagtctgtgatatttggttacagcagccccggcaaactaatgcatcactcagtttgatctccataatgcatcacatctcatccctcacccaaattatgaaaatagcatcttcgtaggtctttcaactgctgccttgccattatactccattttgaaaacatcatccgagtgatctttgcagctgttgactctctacttaaaacctcctcttctcattcagagcagaagccaaaatgcttataacggtccccaaggcctcatgcgatgaactgcctactgcctctactagtcaccatgcttctctaccaccatacaccagaacttctgacttcatcacctagcactctctgcttattccactcaagctatattagactgttcttactattcttccaacacacgagccatctcctcccctttacatgctttgccttatgtttttcttgtaccttgcttcctcatttccatttctcctcaactgtcaccttatcagctctccttgaccatgtaacaaaatagcagcccttccatcatccctcactatccctcttcttgacttcatgtgtctgcataacacttatcagcatctaacacgttatacattactgagttatctgtttcttatctttatctcccccactagaagttccatgaaggtagatatttttactgtttatggaataaattcttagcagcctcaaaaacttctgacacaatgaggttcaaaaaatagctgctggccaggtgcagtggctcacacctgtaaccccagtactttgggaggcctaggcgggcggatcacctgaggtcagaagttcaagaccagcttgaccaacatagtgaaaccccatctctagtaaaaatacaaaacttagccacgtgtggtgacgggcacctgtaatcccagctacttgggaggctgacacatgagaatcacttgaacccgggaggtggaggttgcagtgagctgagatggcaccactgcactccagcctgggtgacagcaagactctgtctcaaaaaaaaaaaaaaaaaagttgctgataatgaattagatgtttgcaagctgacttaaatgttttattttagacaatgaaagtaatctgccctctttatattcaacctgtatatgtgatagggaagatatagaataaaagacagtagtatgttacaaattaatttttgaaagctacttcttactgctgctgaggcaatggattgccattcttgtatcaatttaccactagaaggaaagtgatggaaataatgctttgctctacagtagggtcaaaaacctttttctaaaaggctaaacagtataagctttatagggtataccatctctgtcacaactattcacctctgctgttacagcacaaaaatagccatagacaatatataaactgatatggttaagctttgcatccccactcaaatctgatcttgaattgtaatccctataatccccaggttttacgggagagaccaggtggaagtaactgaatcatgggggcggtttccccaatgctgttctggtgatagtgactgagttctcccaagatctgatggctttataaggggctcttccctcttcgcgtggcacttctccttcctgccactttgtgtaagaaggtgccttgcttccccttcaccttccaccatgattataaatttcctgaggctccctagtcatgctgaactgtgggtcaattaaacctctttcctttataaattaccaagtctcgggcagttctttatagcagtatgaaaacagactaatacagtaaataagtgaatgttccagtaaatctttattcaaggtttgggctggatttggcacacaggctatagtttgccaaatcctgctctaaagtgttgcgttttttttttaaagacaaaataataaccaaacaggttcgattatcatttttacctacaaactgtagattatttatcaagagttaagtatatctatattcagtgttgatctgtatttcaaatatctaattgctattataaaaaaatttaagggccgggcgtggtggctaatgcctgtaatcccagcattttgggaggataattttgcggatcacgaggtcagcagttcgagaccagcctgaccaatatggtgaaacctcgtctctactaaaaatacaaaaattaaccgggcatggtggcgcaggcctgtaatcccagctactctggaggctgaggcaggagaattgcttgagcccgggaggcagaggttgcagtgagccgagattgtgccattgcactccagcctggcaacagagtgagagtccgtctcaaaaaaaaaaattaaaacacactaaataaaattggtataatcatcacattacctgtgtttactcctccagttaaaatccaggctccagttgtaactgcagctttaataagaccttttccaagcaactgcttgattcgtgggtgaagctcaaatttctgcatgcccccatgtacagagataacaagtttgggtaactccatttgccattctttaagcagaagttgcagaatgacttcaggtttggtgtcatatgatagcctcacatactagaaaaagattttaaaaggagaaaataattgaacatgttcacaggtttcataatgtgacattatatgactttggaaaattttatatgaatcagattatgtaaaaagagatttcataggctattttcaatatatttatactccaaggaataagcaatagtaaatgattttaaagttgaaaaaatcattctgtgagatctacagaaatagcgaaactaacttttaaacatttagacacaaatgttactctttctgtttaaactcaattaccattgacccaatttacccaagtacctgcagtatttattgccttctttaactatgactacacagtgagttagaaacattaagactggctgaagaggatcggaaaaggaaaaaaaaggaattaggggggaaaaatatggaggcttctaaggctcttgctatgaagagaggcaaatactgaattatttgtatgaaagtttggcaatgatctagtccatttataaatgaattgtgactatggagtaaaatttaaaaagatatatttaatatagatgattattttcttcactgtaaataactggatttgatcagactgagaaataatcagaaaatcgtaatcaacatttcatggtgttcggatggattctccagtttaatttttgaaaacatctttctatagaaaaatagaaaaaaaagctatcgtgtgtgaaataacttcttctggtttgaaagattttaaaaattaacttcctgtttaagtgatatcataagacttacttgctatactcacattaattcattctcttggcctaaagcacatatatgaagtagctcataagaaacttcaagtattcagacattgagacatttaaaaatcatctctaagaaaccttatttgcaaaatgatgtatttcccattcctttacaaagatcaaacactactgaaaatctcagtactgacaaacaaatgaagccaaaaggccaggcacagtggctcacgcctgtaatcccagcactgtgggaggccaaggcaagtggatcacctgaggtcaagcgttcgaggccagcctgaccaacatggtgaaaccccgtctctactaaatacaaaaaaattagctaggcgtgagtgcttgtaatcccagctacttgggaggctgaggcaagagaattgcttgaacccaggaggcagaggttccagggagctgagactgtgccattgcactccaggctgggcaacaagagcgaaactgcgtctcaaaaaaaaaaaaaaaaaaaaaaaaagaaatgaagcccaaaaaaccccagaattccataaaactgagtagaagactggagtcccttaagaatactttggtttttggttttgttttgttttttttagacacggtcaggctctgttgcccaggctggagtgcagtggcgccaccacggctcactgcagcctctgcctcccaggctcaagccatcctcccacctcagcctcccaagcagctgggactacagacacagggcaccctgcgtagctaattttttaaatattttttgtagacacaaggtttcaccatgttgcccaggctggtcttgaactcttgggctcaagtgatctgcccacctcagcctcccaaagtgctgggattacagacacacggcacccagcatggttaatttttttgtatttttggtagacacaaggtttcaccatgttgcccaggctggtcttgaactcccgggctcaagtgatctgcctgcctcggcctcccaaagtgctgggattataggcatgagctaccacaccagaccaagaatgctttgtaaataggatttgttcttttttttttgacaaagtcccgctctgtcgcccaggctggaatgcctcccgggttcaagagattctcctgcctcagcctcctaagcagagtagctgggattataggtgcgcaccaccaggcccagctactttttgtatttttagtagagacagggttttgccatgttggtcaggctggtcttgaactcctgacctcaggtgatccatctgccttggcttcccaaagttctgggattacaggcataagccaccgtgcccagccggatttgttctataataagtctttctgtatcagttttgtttaactcattattatatttgggcacataaagtagtattagagaagcagtctaaagttaatgtttttaatactatattagagataaatgagaaattccacttcctacaatgatgggctaggttgatttggacatactctgcccctgggaactagaaaaactagaaaaaagaacaataacacctgcttgaatacattagcaggtggccgggcatggtggctcacacctgtaatcccagcactttgggaggcggaggcggaggcaggtggatcacttgaggtcaagagttccagaccagcctggccaacatggtgaaaccctgtctgtaatcccagctactcgggaggctgaagcaggagaatcgcttgaacccaggaggcagaggttgcagtgagctgagatcgcgccactgcactccagcctgggcaacagagcgagtctcaaaaaaaaaaaaaaaagacattagcagggtacaaaggcagtgagaatttgtaggatcgggatccaggagaaaagaaaaacttggagagatgatgagctcactgttgggcaaggttttcctcatcagaacacggaggcaggcagaacaatgtagaggttaaaatggtttttgctgttgttatttgtttttcaggcaaggtctggctctgttgcccaggctagactttggtgacatggtccaaggctcactgcagcctcaacttctcaggctcaactgatcctcctgcttcaggctcccaagtagctgggactacaggcgtgtatcagcatgcccagctaatatttttgaattttagtacagacaaggtctcactatgttgcccaggctggtctcaaactcctgaactcaagtgatcctcctgcctaggcctccaaaagtgctgagattacaggcatgagctaccatgccaaggttaaaatgttcaaatctaaataaataataactgttttaggggtttaaaacagaaaattaaaattcatgctgacaagagcacataagtcttaagagaaataagtgcagtttcaaatattccaaaggttcctgcattgttgaaaaagtggtaaaggattaatttacagtacagtcatgtgccacacattttgattaatgatgaactgcatacataaggtggttccctaatattataataccatacttctgtacctttttcttgtttatatatatttagacacatatttcccattgtgttacactgttacacctgcctaccatatttagtacaataacatgccatagaggtttacagcctaaaagcaataggctataccatatagcctaggcatatagtaggctataccatctaggtctgaatacactctacggtgttagcatgatgaaattgcctaacacatctctgagaacatatccccattcttaagtgatgcatgactgcatataacaagttaaaaatgcattttatcacattatcacatttattatagtattctttttctttttttgagacagtcttgctctgtcacccaggctggagtgcagtggcgcgatctcggttcactgcaaccttcacctcccaagtttaggtgattatcctgcttcagcctcccaagtagctgggactacaggctcgtgccaccacgcccgactaatttttgtatttttagtagagacagggtttcactatgttggccaggctgatctcaaactcctgatctcaggtgatccacccaccttggattcccaaagtgctgggattacaggcgtgagccaccgtgcctgacctataatattctttttctaaagaacagaaaaacaggccgggcacagtggctcaggcctgtaatcccagcactttaggaggccgaggcgggcagatcatgaggtcaggagatggagaccatcctggctaacacaatgaaaccctgtctctactaaaaatacaaaaaattagctgggcatggtggcacacacttgtagtcccagctactctggaggctgaggcaggagaactgcttgaacccaggaggccggaggttgcagtgagccgagattgcgccaccgcactccagcctgggcaacagagacaccatctcaaaaaaaaaagaatagaaaaagaacatatagtaggccttctgtatctgtgggatccacgtttatggtttcaaccaacggtgaatcaaatatattcaagaaaaaacattgagcctatactaaacatgtgtagactttatttacctgtcattattccttaacagtgcaatttaacaactatttacattgtattgggcattttattaatatttttattttaagtagagacagagtctcactattttgcccaggctggtctccaactcctagcctcaagccatccttccaccctctcaaaagtgttgggatgataggcgtgagccactgtgcctggcctatattagatattataaggaatctagagatgatttaaactatacaagagggtgtgcatagattacatccaaatactattgataatctgtagactttggtatctgagggaagtcctgaaaccaagccccctgaaggatgactgtataaataatatgctaataaaggagtaagaaaataataaaaaatatttaatccaaaataatacaagaaaaaaaacagaacaaagaaaaaagtgagacaaatagataactaataacataatggtaaatttaaacttaaatacacagcagacaacatttttaaaaacaattaaaagacatctcttaaacataaaaggttaaaaccgaaaaggaagaaagatggcttaactacactgattgcagaaaaagcaaaccatgtcaagaaaaatgacaagaaacaaaacacattttataatgatgaaaggttcaatccaccagaaagatacaattctatatttgtatgcacctttgtactttaaaatatacaaataaattactgagaccaactttttgtcaatattgctacacaaattgtgatgtttattatttaaataacaacataaatgaagaaaaatccaatatgtgacataccttagctctgtaggaatgagaacccccttgaaaatttatgactccataagcatccgttgggctctgttctgtatgcttttccacagaccattcttctattgcctgattaaaatggtcacccaatttcacatctgagtatttcatggcaagacttgcagtaaaacaagcatgttgcttgaccaagcgaccacaaaaacacctaaaagaaaaaggtgagattaaaacacccttcaaaaaattagagttaatgaaaaaatggaattaaaagtgaatgaaccgacaaatataagctttaaaatttttatattttatataagtataaaaataagctttttgattttaggatatctatatattaataccttcatcatagcactgaaatagtataattagtctaagatgaattcatcatctaaatttaacatgaggcatctacaaaacatggcataggcatataacagaaatagtatttacaccggctgtggctcacgcgggtaatcccaacactgtgggaggccatggctggaggaccttgaggtcaaaagttcaagaccatcctaagaaacacagcaagaccctgacttgacaaaaaattttaaaaaattaggcaagtgtggtggcatacacctgtagtcccagctacacaggagactaaggtgggaggcttggttgagcccgtcagggctgcagttagccttggtcacaccactgtgctccatcctggacgacagaacaagcaagaccccaactcaaaaaaaaaaaaaagaaagaaagaaagaaaaaatactatccaataataaagagaagtgaatgaaccactaataatactacagaatggataaatctcaaaatcatcatactgagtgaaagaacctagacaccaatgattatatatttgtatgattccacgtatacaaaattcaagaaaccgtgaactaatctatatagtgacaaaagggtgatcaatggtgtctgaggctggggtacaaagacagatggctttctacccagaagcacatactggactataacaccataagtaggaacctagtggagctgggcagtctcattgatttgatataatcttaaaaatcagatgagagtttgaggaagccaaggcagctagagtttgtgaggtagaaaacaaaaagaggagggagctacaacgagaaagttccaagtatctgcagaagggtctccttaagcatgtggaagaataactacttggccaggtacagtggctcacacctgtaatcccagcactttgggaggccgagacgggcagattacctgaggtcaggagttcgataccatcctggccaacatggtgaaccgtctctactaaaaatacaaaaaattagctgggcatggtggcgcgtgcctgtaatcccagctactcaggaggctgaggcaggagaatcacttgaacctgggaggcgcagaccacagtgagcagagattgggccactgcactccagcctgggtgaaagagtgagactttgtctcaaaaaaaaaaaaaaaaaaaaaaaaaaaaagaataactacttaaggcaaagttaaaagctactggacagcaatagccgaaacaatttctgaagctcataaagggcagggaacactttatgttcccaccagccagagtagagatctcataacacacaaggcttatgacagggtcctcaaaaaaagtatcattaaattagaaggactaaattagacctagacagaccaggcacggtggctcatgcctataatcccagcaccttgggaagccaaggtggatggatcacctgaggtcaggagctctagaccagcctgaccaatatggtgaaactctgtctctcctaaaaatataaaaattaactaggcatggtggcgtacgcttgtagtcccagcttctcaggaggctgaggcaggagaatcgcttgaacctgggaggcagaggttgtggtgagccgagatcgtgccactgcactccaggatgggcaacacagcaagactgggtctcaaaaaaaacaaaaaaaaacaaaaaaatcagacctagacagcccatgccctgacaaagtttaagagcaagacctgaaaggatcaaactgatccaaagtaatctaattgcatgctatagcaagtctaaaactcgctagtggaatacaacaaatgccagtaaccaaaaacataaaattcactattgtcagcatgcatgaaaaattcccagacattggccgggcgtggtagctcacacatgtaatcctagtatttttgaaaatggagaccggcagtttgcttgagcccaggagtttagaccagcccgggcaacatggtgaaccccatctctacaaaacatacaaacgttagtcgggcgtggtgatgcacgcctgtagtccaagctacttgggaagctgagatgggaggactgcttgagcccaggaggcagaggttgcagtcaactgatatggtgccactgcactccagcctgggtgacacagagagaccctgtctcaaaaaagtaaataaataaaaatttcaaagaatactgaggcatgcaaagaagcagaaaactatcaataaaataaaatcactaaatgaagaccagaaaagaacgagatgatggaattatcagaaaatgacacaaaaacaagtattataaatgagctccaactattaagaccatgcttgacgccgggtgtggtggctcacgcctgtaatcccagcactttgggaagccgaggcgggtggatcacgaggtcaggagatcgagaccatcctggctaacacagtgaaaccccgtctgtaataaaaataaaaaaaatttaaagaaagaccatgcttgttgggcacggtggctcatgcctataatcccagcactttgggaggccgaggcaggtggattgcttaagcccaggaattcaatattagcctggcaacatagtaagactctgtctctaaacgaaaaaattaaagaaaaaattaaagaaaagaagactgtgggaaaagaatatgagcatgatgaagaccaacatggtgaaaccccatctctactaaaaatataaaaaataagctgggcgtcgtggcagtcgcctgtaatcccagctactcgggaggctgaggcagaattacttgaacccaggaggtgggggttgcagtgagctgagatcgcgccactgcacatccagcctggcgacggagcaagattccttctcaaaataaataaatacaataaataaataaaataataattttctaaataaaggttttaaaaatttcatttaaaaaataacctaaacttctaccttaaaaactaaaaataacagcaaattaaactcaaagtaagcagaagaaaagatatgataaagaaaacagaatgggccgggtgcggtggctcatgcctgtaatcccagcacttcagggggccgaggcgggtggaccacttgaggtcaggagttcgagaccagcctggccaacatggtgaaatcctgtctctactaaaaatacaaaacttcaccgggtgtggtggtgggcgcctgtaatgccagcttctgaggaggctgaggcatgaaaattgcttgaacctgggaggcggagattgcagtgagccaagatcatgccactgcactgcagcctggctgagtgagactccatctcaaaaaaaaaaaaaaaaaaaaaaaaaaagaacacaatgaaacagaaaagagaaaaatcgtgggggaaagcaagaaaacaaaaagcttgtcattgaaaagataaataaaattgataaactgaagtcagaataatgagaaaaactgaacaggaaaataaatcaacactccagcctggacaatacagcaagactctgtctcaaaaaaaaaaaaaaaaatcattaatacacctttccacaaagaaaattcaaagccagatgccttcactggtgaatttcatcaaacatttaggaggaaatataaattctacatacgttcttccaaaaaaatcgtttaagtgggtacatttcccaattcatttcatgaggtgagactcattctgctttggaaaaaaacaaaaacaaaataaaaccagcccgtaattccagctacttaggaggctgaggtgggaagactgcttgaggacaggagttctagatcagcttgggtaacaaaaggaactccatctcaaaaaaagaaaaaaaggcaaagcattagcattacaagaaaagactaggccgggcacactggctcgtgcctgtaatcccagcactttgagaggccaaagtggaaggatcacttgagctcaggagtcaagaccagcctgacaacatggcaaaactccttctctacaaaaattagccaggcatggtggcatgcacctgtggtcacagttacttgggaagctaaagggaaaagatcacctgagcccgggaggtcaagtctgcagtgactgtgacactgcactccagtctgggccacagagtgagaccctgtttccccactccccccaaaaagaaaaaagaaacggacgtggtggctcacacctgcaatcccagctcttaaggaggcataagtgggagcatagcttgagccgaggacttcaaaacttgccttggcaatatagtgagaccccgttctccacaaaaaggaaaacaagcattggacaaaactgaatgtctgttcattataagcactgtcagcaaactaggaaaggaggaaacttcctcaacagataacataatacttattaaatcttatcaagagtaccactacatgctaagtcttgtgattcattctagctaatcatggaatctaggtgtggtctcggagattcctgacataaatgtgaacaaaatatatgagataactgtttcaggcattaaacaagaagaaacacgaagctgtgatccttgaaatgagggaaacacatgaggtaaacccccatgactgcaccagcttgggggcaatttctcaatcatagagatgacacctaggcagaaaacagtagacactgggccaagcaaggaagtagagaacagaattctaggctgttgaaacagttggaatttgtagcagagttaccagagaaaagggagctataaagacaagaaggaaaaaaatctcacatggggattcaccatgggtctttggccatggtctaaggtgtatctgtgagagattctgtgatgcctagcagtaatcacttgctgtgtgtgggtctgtgaacggggtcctaaaggtctggaagacatagcagttttagttcagcgtgaaaagacatcactgaaccccctgaacactcaattgagaacacaaaaaagctataccttaagaggaaggtccacatcctaggactaagttcaaaatagaagtagaactgccctaacaaagaagaaaatcaaacctgaatggacaaaagaatctatcaaaaattaatttaatcacctgtcagaaagaaactgaacactccttacaggaaaattatttactccagaacaacaatatatgataaaaaattattggccgggtgcagtgactcacaccatcccagcactttgggaggccaaggcgggcggatcacctgaggtcaggagttccagaccagtctggccaacatagtgaaaccccatctctactaaaaatataaaaaattagctgggcgtggtggtgtgcgcctgtaatcccagctactcgggaggctaaggcaggagaattgcttgaacccgggaggcagagggtgcagtgagctgagattgcagcactgcactccagcctgggcaacagaacaagacaccatctcaaaaaaataaaaaaatactagacatataaaaaagatgaaggaaaaaaagcagtcaccagaaacagaccctaaatgatgcaaatgttggaatcagtagacaaagactctaatgcaggtattataaatatgctgaagggcatacaggaatagacagtcataatgagagtgcacatggtgcatctcagcagtaaaatggaaactataacaaagaatcaaatagcaatcctagcactgaaaaatgtaatgtatgaaatgaaaattcactggatgggctgggcgcagtggctcacgcctgtaatcccagcactttgggattacaggcgggcagatcacaaggtcaggagatcaagaccatcctggctaataaggtgaaaccccatctctactaaaaaaaaccacaaaaaactacccgggtgtggcagcaggcacctgtagtcccagctactcgggaggctgaggcaggagaatggcatgaacccaggatgcagagcttgcagtgagctgagactgcgccactgcactccagcgtgggcgacagagtgacactccgtctcaaaaaaaaaaaaaaaaagaaaagaaaattcactggatggacaaaacagcaaaatggagaatgtagaaataagagtgaacctgaagacatcaatagaaattattcaatacatcagataaagaaaaaaaagttaattaaaaaaaaaaaacttcctggccaaatgcagtggctcacgcctgtaatcccagcactttgggtggccaaggcgggcgaatcacgaggtcaggagttcaagaccaccctgaccatcaaggtaaaatcccatctctactaataatacaaaatgagccaggcatggtggcatgcgtctgtaatcccagctactcagatggctgaggcaggagaattgcttgaacctgggaggcagaggttgcagtaagccaagatcgcaccactgcactccagcctggacaacagaccaagactccatctcaaaggaaaaaaaaaacaaaaaaacaaaaaaccttctcaatcaggtaaaaaatttgaacgtgcaaatatttacgcaagcagaataagtacaaagagaatcactctcaggcatattatagacatgctgctgaaaaccaaaggaatagaaaaaaaaaatatttaaagtagctagagaagaaaaagacccattccacacaggaagacaactactgtattacagctgccttctcattagaaacaaaagctacaagataaaataatgacacctttaaagtgctgcaatgggctgggcgcaacagctcacgcctggaattccagcactttgggaggccaaggcaggcagatcacaaggtcaggagaccagcccagccaccatggtgaaaccccatctatactaaaagtacgaaaattagccaggcatggtggtgtgtgcctgtaatcccagcttctggggaggctgaggcaggagaatcacttgaacctgggaggcaaaggttgctgtgagctgagatcgcaccactgtatgccatctagcctgggcaacagggcaagactccatctcaaaaaaagaaaaaaacaaaaaaaaaaaacccctgctgcaataaaataacacaacccagaattctatatccagtgaaaacattcttcaaacatgaaaataaaagaaatatattttcagatagaccaaactgagaaaattcatgttcagttcagtgtagctgcactatatgaaatgctaaataaaagaaactctttggcatcgtcaaacaagagacaccagatggaacctcaccatctataagaagaaatgaaaaggactggagatggttaagtacaggggcaaatatgaaagactgtcaggtctttttgtttgtttttttttctggagacagggtcttgctctgttgcccaggcaggagtgcagtggtgtgatcagggcttattgcagcctcaacttcccaggcccaaacgatcctcccggctccaatgatgttcctgcttcagcctcttaagtagctgggactacaggtacatgataccatgccaagatttttgtgtgtggttttcttttttttttttttttggtagacacagggtctcactatgctacccgggctggtctcaaactcctaggctcaaaccatcctcctgcctcaacctccccaagtgctgggattacaggcgcgaaccatcacatccagcctgtcaggttttttgtttttgtttttacagacttccttgaaaaactcttcaatatatctaaaataaacccattctatgtacttttattcctagcctaccacccagagaccttctcttcttcctcttatacttcctcatcagaccctaaagcatattacaatttactcagttgcctaagaaggaaatgtagttaccatgctcaaatcttcccttttcttcacattcaccaaatcctattgcatttatctcattaagcccttcaaatatgcctacttctcttcattgtcaaaaacatcttacttcaggttctcatctttttgccagagtcactctaaaactttagcaactggtctattttcttccaatccaatctaaaaatgcaaactgctcttacaaaaaataaaatcagccgggcctggtggctcacacctgtaatcctagcactttgggaggccgaggcgggtggatcacctgaggtcaggaattcaagaccagcctggccaacatggtgaaaccccatttctactaagaatacaaaaattagccgggcatggtggcgcatgcctgtaatcccagctactcgggaggctgaggcaggagaattgcttgaacccatgagacagaggttgcagtgagccgagattgtgccactgcactccagcctgggtaacagagcaagactccgtctcaaaataataataatactaatatagcatgttattaattgcctgtacaatatccttttaacatgaaatcaaaagcatgtgcaacaaaaagccttgtagagtaactgaaactctcatttttccaggcccaaatctctcaaatctccatcttacattctgcagtttcctgacagaaccatgatgtctttcactatcaggccttcccatacactgctctcgctgcctaaaattcctgtccttcaacttctgctcaacagacacaactttacaactcttcttaggtagcttcacctgagtttcaaacagccttgactgacccttcaccttccaagtctaggtaaagtacccatcaaatataatagcatgtgagtttcatgccactgtgttctaactcatatttctaatagattagttttatttattttccgaaatttgtgcggtatagttatgttaaacttacctgacgagttgctgacaaatttgacatcctggaaggcatctattgaacacaaaaaggtaaataaattatttcaggtgaaaaactttctgattttaaagtatataaaatacataaaatacaaaacaaaaaaaattatatacctagtttaatttttcagtagatattatagttcacgtataccttgatttataattcaaataactattttttaactgacagtctcaatttttttttttttttttgagacagagtctcgctctgttgcccaggctggagtccaatggcgcaatctcagctcactgcaagctccgcctcccgggttcacaccactctcctgcctcagcctcccaagtagctgggactacaggctcctgccaccatgcccggctaatttttttgcatttttactagagatgggatttcactgtgttagccaggatggtctcgatctcctgaccttgtgatccacctgcctcggcctcccaaagtgctaggattacaggtgtgagccaccgcgcctggcagacagtccacacctataattgcaacactctgggaggcacaggtgaattgcttgagtccaggagtttaagatcagcctgggcaacaaagcgaaactccgtctctacaaaaaaaaaaattagctaggggtagtggtgcaggcctatagtcctagctactagggaggctgaggtgggaggattccttgagcatgggaggtcgaggctaaagtgagccatgatcatgccccactgcactccagcctgggcgaaagagcgagaaactgtctcaaaaaaaaaaaaaaagacattatcttggcaagaatacagagagagtctggtatctgtgggtgagagtatatatttatataatccctatggaaggccacttggcaatacccatcaaaataaaaaacgttgactctcacacactaattccagttctaaaagcataggctaaaacacatctgtagtatacgtataaaatgaaaattgtacaaggtcgttgactgcagaatttttttcctaacagccaaaagaaagtgaaaatagctaaaatgttcaataagagattactaaaacaaattacaattcagacataattaaataggctgcaacaattaagaacaaactagtggccaggcgcagtggctcacgcctgtaatgccagcactttgggaggctgaggcgggaggatcacgaggtcaggagatcaagaccatcctggctaacgcagtgaaaccccgtctctactaaaaatacaaaaaattagccagatgtggtggcacacgcctgtaattccagctactcgggaggctgaggaaagagaatggcctgaacccaggaggcagagcttgcagtgagactacgccactgcacaccagcctggatgacagagcgagactccgtctcaaaaaaaaaaaaaaagaaagaacaaactagtgatcgccaagataagttacagtcacagtgggctacactatatattttaaagggggaagggggataatcatctgcttggacatacaaagactatatctaactttctggaagacattccaaggaatggataacatcagattttttattagcaaggtaaacttatagctaaagcacagtactggaaaggagactttcacttacagcatttggtaccttttaagttatgaaccaagtgtcaattacctattcatataaaattaagagttcaactactgtagaaagaagtgacgagctaactgtaaattatgtctctcatgaatggttaaaggtggggatacttagtaacagctttggatttctttaataccttgagtgcttttattatttctattgcaaagtggaattaataaaactatagaaaataaactccttaatgataaaatctattttttcttttttttttgagatggagtctcactctgtcactgaggctggagtgcagtggcaccttgtcagctcactgcaacctccgtctcctggattcaagcaactctcctgcctcagcctcccaagtagctgggattacaagtgcccaccaccacgcccagctagtttttatatttttagtagagacgcggtttcaccatgttggccaggctggtctcgaactcctgacctcaggtgatccacctacagcctcccaaagtgctgggattacaggcgtgagccaccacacccgaccaacaaaatctatttttttaataaagcaaaacatcaatttctccggaagaaaaatggtattttattttagaactggcacactgaactaaggaggcttaaatactaatcccatctttatgaatagccatgtgacttgggaaatgtcatttatcctcttgttgagaaatgtgatacgatgttgtaataaaacatatctttaacaagtagtaagaaatcagaataaatcatagactctaatgattggaagagatgttaaggttatctattttaatgatccaaaaagaactaatcaaaaacatttacagaatgtattaaaaaattgagggatatttaaaaaacataaaatattttctcaataataaataaatccaaatttaaaatatatactattataattactgtcaactaaaaataaataaatgtataccaggcacggtgactcactttgggaggctgaggcgggcagattatctgaggtcaggagctcgagaccagcctgaccaacatggtgaaacccctgtctctactaaaaataaaaaaaattaagtgggcgtggtagcgcatgcctatagtcccagctactcaggtagctgaggcatgagaatcgcttgaacccggaaggcagactttgctcacctcagtctcccaaagtgctggaattacaggcatgagccaccatgcccagcctaaaaatatatacatactattttctacttatcacgttttcttgatggtgatggaaaatgttactccagtcattactcagtaaaggagacaatctcattcactactgggtgatcatttatattcctttaatacttttcaaaagattctggcattacataacctaaggggggaaaatcttaaatataaaaaaggttttatccacaaagatcttcattgtggcctaattaaattttaaatggctaaaaatcgaaaacaactaaattgaccaatagtagaacaggtatataaattgtggtatacacaataacagaatattaactaccattccttttttttttttttgagacagagtttcactcttgttacccaggctggagtgcagcagtgtggatctcagctcactacaacctctgccttccagtgtcaagcaattctcctgccttagcctcccaagtagctgggatgacaggtgcccactaccacgtctggctaatttttgtatttttagtagagacagtgtttcaccatgttggccaggctggtctcgaactcctgacctcgtgatccgcccacctcagcctcccaaagtgctgggattacaggtgtcagccaccgcaccaggcctattaactaccattcttataaaatatctgtagtatgaaaagcaggtacattttgcatatagactgaatgtagcactactttaaaacaaaagcaatacactgagaaaaagttaaaaataaagccaccaaatgttattaataatgacagtcttaatgtattgaaactctacgtattgcttcaactttgtttctcaaaagttttttaaatgtatcatatacattacactttcaatggaaatgtgtttgttgtgagagatccgttcaaagttaagaattttttaaaatgttaaaataaagagaaatttttggaaatgctattcaacaaatatttactacatatccactataaacaagaatagtgacatattctataatataaagagatatcagttagtaaaaactgtctatttagctatgtttttctaagagttatatatctaacagaaatgaaagttgcagagaaggtaaatgggtagagaacacagtgtgacaggagacggaaaaggaaggaagattcaaaaatcttgcaaatacttttgtcaattaattttcattttttctaagtgcccatgaagaaaagtgctctataggttaggaaataactatatcttagatttccttaagtttttttctatctttaggcctcagaaaaaagaaaaatttgctgggtgcggtggctcacacctgtaatcccagcactctgagaggccaaggcaggcagatgacctcaggtcaggggttcaagaccagcctggccaacatagtaaaaccctgtttctactaaaaatacaaaaactagggctgggcgcggtggctcacgcctgtaatcccagcagtttgggaggccaaggcaggtggatcacaaggtcaggagattgaaccatcctggctaacatggtgaaaccccatctctactaaaaatacaaaaatttagccggctgtggtggcacatgcctgtagtcccagctactcgggaggctgaggcaagagaatggcctgaaccctggagggagcttgtactccagcctggacgacagagcaagactctgttccaaaaaaaaaaaaaaggtaaaaagaataattttggcaaaaatgtttaagtaaatatttcatgagctcaactttttcttcagttactaagttaatgtcctttaatttttttctattatcaaagccatcttagagaccaaagacacagacacctatagtctctgataatagattttccagtaaataatgatctgtatctatatattggcaaacaaaaagaatgactattattaggttcatattgctttcttcgacatgaaccatagtgttggatacccagtagatgcccaatagatacacaaatttaagttcccaatatcagtgaatccattaaaaaataagagagtcttaactgccttacctttgtaaaacactacactatgatctgagggagtttagagatggaggaacacttcaaggaagagattgtatgctgtaaatggcattaagaactccaaaatactgatttcagtgctgtttcctcctcccaatccctcccaaattaaatgattaacagtaattataaaaagtaacagtaagtacaaataatttatttagtggtttttgtttccaataaagaaataacaatataatttacactaaaatttctagaagaccccagaagtaacaaaggtgtgcttacctgtgagggtccttggaacttggtataatatatacacattccctcttggtcaaagtgctttctatccaggatttctgggactaaaacaaaatgttttaaagaattgtttataagttaacccactaaataagaaggaaacaatttcatgataaacacataaacagttcttttttttttttgagacagagttttgctcttgttgcccagactggagagcaatggtgtgatcttggctcaccacaacctccgcctcccgggttcaagtgattctcctgcctcagcctcccgggtagctggcagtacaggcatgtgccactacgaccagataattttgtatttttttagtagagatggcgtttctccatgttggtcaggctggtaacgcccgacctcaggtgatctgcctgcctcggcctcccaaagtggtgggattacaggcgtgagccaccgtgcccggcccataaacacttctatactacataattttttatttacttttcactacataccataatctgaggatggcaccccaaaacgtcagaataattccatttaaatcccaagtgacctaggttattaaatcaacagtactgtgtagatactattgcttcaaatagtcaaacaggagggaagcctagtttgagattcccactacgaaccaaaaaccttaagaggggctggtattattctgggatatgagccatttaaaagacaactagctcggcacagtagctcacacctgtaatctcaacattttgggagccaaggtgagaggatccttttagacagaattcaaggctaccctggaaaacatggtgaaacgccatctctaccaaaagctaaaaaattagccaggtatggtgatgtgctcctgtagtcccagctacttggaagtctgaggcaggaggatcgcctaagccgaggaggctgaggatgcagtcagccatgatcaggccactgcactccagcctgagtgaaagagtgagagactctgtctcaaaaaacaaagcaaaaaaaacctgaaaaaaagacaattagaattgacagatttggccgcgtgcggtggctcacacgtataatcccaacactttgggaggctgaggtgggcggatcacaaagtcagaagaccaagaccatcctggccaacatggtaaaaccccgtctctactaaaaatacaaaaattagctgggtgtggtggcgtgtgcctgtaatcccagctactccggaggctgaggcaggagaatcgcttgaaccagggagtgaaccagggagtcggaggttgcagtgagccgagatcgcgccactgcactccagcctggcgacagagcaagactccgtctcaaaaaaaaaaaaaaaaaaaagtgatagattgataaaaaataaaacccagctacattccatttctaatataaatacctaaagcataagggcatggaatggttaatgatacaggaataaaaagacataaagcaaattctaattagaagaaaaatagtgtcagaaaaatgggtacaacacatcaatagggatagagaaggttattacaaacgttaaatctgccagattgctattataatcttaaatatgattaaccaaataaaagtttcaaaatacataaagggaaaaaattagtagcattagacaaatctaggctcacagaagattaacacatttccctcaatactgaaaagtcaatcaaacaaaacctaacagcagaagccaggcatggtggctcacgcctgtaaccccagcactctgggaggcaggaagatggcttgagtctgtgagttcaagaccagctgggtaacacagtgagactccatctctacaaaaaaattaaacagtcagccgggtgtggtggtgcacacctatagtcagtcccagctactcagggggctgaggtgagaggatcacttgagcctgggaggtcaaggctgcagtaagccaagatcacaccactgcaatccagcctcgttgacagagcaagaccctgtcttaaaaataaataaataatcagcagaaatatttaaaagattttaacaacatgttaacaagcttcatttaataaatatacgcatgtttctgtatattagaaacagaagatccattcattcttctcaagcacacatgaggcatttataaaaattaatcatgggtcaggcccagtggctcgtacctgcaatccgagtactttaggaggcctcatggatcacctgaggccaggagttcgagaccagcctaaccaacatggtgaaacccgtctctactaaaagtacaaaataagtcgtgtgtggtggcacacatctgtaatcccaactactcaggaggctgaggcagaactgcttgaacccgggaggcagagattgcagtgagccaagatcatgccactgcactccagcctgggtgaaaagagtaaaactctgtctaaaaaaaaaaaaaaaaattgatcatgtgcttgaccataaaataagattcaacaaatttcagacactgggtatctggcagatcatactcactgatcacaatgcaattaacataatgtaaataaaaattttaaaccaccaacattcaacactttatataacttgaggatccaataaaaattcataattaaaaattttaaattcttagaagtgaataatagtgaaaattctatgcacttgaaaacctgtacaatgtagtctaaatggtgcatgtataggaaaatgtataggcttaagtgattacatttaaaaatgaaggctgggccaggcacagtggatcacgcctgtaatcccagcactttgggaggccgaggtgggcagatcacttgaggtcaggagctcaagaccagcctgaccaacatggtgaaaaccgtctctactaaaatacaaaaattagcagagtgttgtggtgggcacctgtaatcccagctactcgagagactgaggcaggagaactgcttgaacgtggaaggcagagcttgcagtgagcccagatcgtgctactgcactccagcctgggcaacagagcgagactctctctcaaaaaataataatttaaaaaaaaggctgaaaattaatgagctaactctcggactttaaaaacatattgaaagaataaagtcaaaggaaagaaataaaattaaagaaaaaaatcagtaaaacagattttaataaaacagcaagataagcaaaagttaaaagttggttcttaggttaacaaaattggtaaacctttatcaagactgaacaagaagccaggcagatcacttgagtccaggagtttgagaccagcctgggcaacatggcaaaaccccatctctacgaaaaatacaaaaaattagccaagcatgtgatggcacgtgcctgtagacccagctacttaggaggctgaagccagaggatcatctgaacccagggagctcgaggctgcagcgagctgtgatcatgccaccgtactccagcctgggtgacagaatgagagaagggagaagaaggtagaagggagaaagaagaggaggaagaggaagaagaggaagaagaaaacgaagaggaagaggaaaaagaaaaagaggccgggtgcagtggcttatacctgtaatcccagcactttgggaggctgaggcgggcagatcacctgacgttgggagttcgagaccagcctgaccaacatggagaaacctgtctctactaaaaatacaaaattagccaggcatggtggtgcatgcctataatcgcagctacttggaaggctgaggcaggagaattgcttgaacctgggaagcagaagttatggtgagccgagatcgtgccattgcactccagcctgggcaacaagagcaaaaactgtctccaaaaaaaaagaagaggcggtggaggtggcagcacaagtaatagtaagactgaaaagatacaaggtaattgaaagataaagaagaaaataacaggctgttctgcctctggagtagccattcttctgtttctttactttcctaataaacttgcttttactttactgtatggattcgcctcaaattctgtcttgcacaagatccaggaacctgttcctggggtctggatcaggacccctttctggtaacatctttctggcaaaccataaagggatgatactgaggagacccccaacccaaaggaaatagactgcagcattgattggccgactctgggggtgtctaatggcagttatggggaaatacacagctctctgcatgtctggatcagagaaacatgctcttggccccctagaagctgtgcctgattactaggccctagaaactgaacgctttcctcgccctgttcctccaagggctctaccttgaagccagtaatccaattaagaaattggcaaatgaaagaccttacaactgatggatctcccgcctatgtatttatatgtgttgtgtgtgtatgatatgaaagagctttgattaactggtttaaaaataagagctgctggccgggcacagtggttcacgcctgtaatcccagcactttgggaggccaaggtgggcggatcacttgaggccaggagttttgagaccagcctggccgacatgtaaaaccccacctctactaaaaatacaaaaaattagctgggaatggtgccttgcacctgtaatcccagctgctagggaagctgaggcaggagaatcgcttgaacccaggaggtggaggtaacagtgagccaagactgtgccactgcactccagcctgggcaacagaaggagactccatccccctccaaaaaaacatatttaaataagaaataataaaataaaattggatcaatttgtctataaggttttattaagaactgggtttcacatatcaataatgcactagtccaacagtgaaatttggcttattgacataaaaatcatacaggaagcattgccaaatatgaaatggtgtttggctttctttgggttgcatttgtataaatatgttattggtatgtgttccaaaattatgaaaagctcctataattctgatatgattcaatgtaccttatcagcagtaattatgattattatgttaaattattgtgtgccacaaaggtaaccaaaattctttgtcaatcgtgtctttgactatggctgtcctaagactttttgtcatcaacatacaactgttgtcatgttttgatcctcttcgaaaggtggtttataatcagctataggactttcacaggtgctcttaaatgcaggtttctgataactttggagactctaacattagaataaaggaaaaaacattcaggactgtcatggagggctggaatgttcacgtgtatcaaacaggagttaacttcatggactgaattaatgtaagactcatcttttttacttttttgcttaaaacgtcgctgatcctttattttgttttgcagtcaaggatttgagctattgacagctattaacaattgagtaaagtatactcctgtggacaaaatttggagcatatttgtttctctctaccccatttctcaatttggagactatttatgagtactcttaacttatggcaatagatttgtttttgttttttgttttttgagacaaagagttttgctctgttgcccaggctggagggcagtggcatgatctcagcttactgctaactctgcctccggggtccaagtaattctcctgcctcagcctcccaagtagctgggattacagatgcccgccaccacaccaagctactttttgtatctttagtagaaacaggttttcactatgttggccaggctggtctcaaactcctgacatcaagtgattcacctgccccagcctcccaaagtgctgggattacaggcatgagccaccatgcctggcctacaatagatatttgtataagtgcagtaagaatcggttttctcttgtgacaggacacaattggagaaactggttattttaccaaggctttgactggaatgatgtgctctccttaaaggaatcaaacttgacttgtagagccaattaaaagctgcttgggaaaactggcctcatatcttgtctacgcagtccctgtacagggttcctgacctgtgataagttaagaatgtcactttttgacaggcccaggagccccaagttatcttgggacctcaagaagagagaaatttacccaatacataaaggtatttgagggtacaaacccacagctgaggtcaggcgcagtggctcatggctgagcgtggtggctcacgcctgtaatcacagcacattgggaggctgaggtaggtggatcacctgaggtctggagttcgagaccagcctggccaagacctcatctctactaaaaatacaaaaaattagccaggcgtggtggtgtgtgcctgtaattccaactacacaggaagctgaagcagcagaaccacttgaactcaggagatggaggctgcagtgagccgaggtcatgccagtgcactccagcctgggcaacagagtgagactctgtctcaaaaagaaaaggaaaaaaaaaatccatgctgggctcggttttaaaagtcttatcggagattccttatggaacagagttccatcaaagccaatttcgaaagcctatataattattcttgctgcactttatacaaataatctggccaagtataacaaagcaaatcggtcatactataacttgtctttagtaaaaatgggacactggagtgagaaaaaattgtgtttcaagaactatggtatacctgtcagtagattctagtctcatcagttgtttgagtttttttcctgcaatttaggctgaccttgctttctcctgtgaaccaatcagtgatctctgactgaagtccaggaaaaaaaaaagggatggctaatgtaaaaatctggatcaatattctaattctgggcacataatacaatcagcgatcccttatcagcatggttccaacagttgccagttcatggaaagccttctaatttagtttacttgggacagttttacttattttgctttactgttatggaatacattgctgttgtactctttgtataggaatgcaggataagcttactgaatgttttattaaacacttattaatctttcagatatcatgttttgtcagaactctgagttatggatggccctcagcaaactgatgtgttgtgaatgagtgcctctctatcacggacacaagagaccttaatagttaggcaggaatatcatcaccccattcagcaagaagaggttacaaaaggtgtatcttcatccctctacaacccttaggatgaaggattctcttataaaagaaggggggaaacgtcagaggtgtttaaaccagagtgactccatcttgaataggggctgagtaaaataaggctgagacctgctgggctgcattcccagtaggttaggtattctaagtcacaggatgagatgggagtccaacataagatataggccataaagactgtgctgataaaacaggttgcactaaaaaagctagccaaaacccaccaaaaccaagatggcaacagagtagacctcttcctcactgctcattatatgctaattataatgtatcaccatactaaaagacactctaaccagcaccatgacagtttacagatgccatggcaacattcagaagttaccctatatagtttaaaaagaggaggaaccctcagttctgggaactgcccaccactttcccagaaaattcattaataatccactccttgcttagcatataatcaggaaataaccataaaagtgggcaaccagcagccctcaggactgctcaacctatggggtaaccattcttttgtttatttactttcctaataaacttgccttcactttactgtaaaaaaaagaaaaagaaaaaaaaaaaaaaagcaagaaaataataagaggatactatcaacaactctgtgccaaaacgtgtcaaaacatattaagtaggccaggtgcagtagctcttgcctgtaatcttagcagtctgggaggccaatgggggcagattgctggagctcaggaatttgagaccagataaaagggggctactatacattgcggaatggctaaatcgagctaattatcatatacattgcctcacatactatttttttgtggtgagaccacttaaaatatactcttagtatttttcaaaaatacattgttatttagcgtagtcaccatgttgtacagaagatttcttgaaattattcttcctaactgaaattttgcatcctttgaccaacatttccccagcaatccccacccaagtccctgataaccaccattctactctccatccagaaattgaacttttatcagttcaattttttagattctacacagaagtgagaccatgtagtatcttgtctttctgttcctggcttatttcacttaacataatgtcctccaggcccatccaggtcacaaaaaacagaatttccttctttaagattgaatgatattcctttgtgcatactgtcatgtgccacataacaacactgaggtcaatgatggaccgcatatttaacagtggtcccataagattataatggacctgaaaaattcctattgcaggctgggtgcaatggctcacacctgtaatcccagcaccttgccgtgggaggaggagatgagaggactgcttgaggccaggagttcaagaccaacctgggcagcataatgagatcctgtcgctacaaaagttttttttaattagccaagcatgttggtgcctgcctatagtcccagctacctgggaagctaaggtgggaggatcatttgagcccaggagtttgaggttaaagtaagctatgatcacgccactacactccagcctgggtgagagaacttgtctcgaaaaaaaaaaattcctatggcctactaacatcgcagccatcataagttcatagcaccaggactacttgggtatttgttttgatattggtgtaaacaaacctgcactgccagttacatagaagtatggcatatacaactatgtacagtacataatactttgtaataataaatgactatgttactgatttatgtatttactagactacgctttttatggttagagtgtactcctacctatttttgtttggttggtttttgtttttgttttttgagacggagtctcactgtcgcccaggctggagtgcagtggcatgatcttggctcactgcaagctcatctcccgggttcacgccattctcctgcctcagcctcctgagcagctgggactacaggcaaccaccaccacacccagctaattttttgtatttttagtagagacattttcaccatgttagccaggatgttctggatctcctgacctcgtgacgtgatccgcccaccttggcctcccaaagtgctaggattacaggcgtgagccacctcgcccggccactcctacctatttttttttttaactgtaaaacagcctcaggcaggtccttcaggaagtattccagaaggcactgttatcatagaaaatgacaactccattcatgttattgtccctcaaaaccttccatgaggcaagatgagaggtggaagacaattctactgatgatcctgaccccgtgtaggcctaggctaacgtgtatatttgtgccttaggtttgaacaaaaagtttaaaaagtaaaataattttaaaatgttgaaatagaaaaaagtagccaggtgcggtggctcacgcctgtaaccccagcactttgggaggctgaggcaggcggatcatctgaggtcacgagttcgagaccagcctgatcaatgtggtgaaaccccatcactactaaaaatataaaaattagccaagtgtggtggcggatgcctctcatcccagctactcaggaggctgaggcaggagaatcgcttgaaccagggaagcagaggttgcagtgagccactgcactccagccagggtgacagagtgagactctgtctcaaaaaaaaaaaaaaaaaaaaaaaaaaagcttatagaataagtatataaagaaaatgtttttatgcagctgtacaatgtgttttatacgaagtgttattacaagagtcaaaaagttttaaaatgtttacaaatctgttaaattaaaaagttacagtaagctagcgttaatttattattgaataaaaaaatactttttataaatttagtgtaggctaggtgtacagtgtttatcaagtctacataagtgtaatgccctaggccttcacattcactcaccactcactcactgactcgcccagaacaacttccaggtccacaagctccattcacagtaaatgccttatacacctatactattttttatttttattgttttttacttatttccataggttattggaaacaggtagtgtttagttacataagttagttctttagtggtgacttgtgagattttggtgcacccattgcccgaccggtacacactgcaccctatttgtagtcttttatccctgacccccttcccaccctttctccctgagtccccaaagtccattgtgtcattcttatgcctttgcgtcctcatagctcagctcccacttatgagtgggaacatatgatgtttggttttccattcctgagttacttcacttagaattaagagtctccaatctcatccaggtcactgtgaatgccattaattcattcctttttatggctgagaagtattccctcgtatatatatatatataccacagtttctttatccactcgttgacttgatgggcatttgagttggttccacatttttgcaattatgaattacgctgctataaacatgcgtacgcaagtatctttttcttataatgacttattttcctctggtagatacccagtagtgggactgctgtatcaaatggtatcctaaggaatctccacattgtttcccatagtggttgtactagtttacattcctaccagcagtgtagaagtgttccctgtttaccacatccacataaatgtctattatttgttgttttatgtattatggccattcttgctggaataaggtggtattattgcattctggttttctgttttgtttcttgagatggagttttactctgtcgcccaggctggagggcaatggcatgatctcggctcactgcaacctccacctcccaggttcaagcgattctcctgtctcagcctctggagtagctgagataacaggtacctgccaccacgcccagctaatttttgtatttttagtagagatggggtttcaccatgttgaccaggctggtctcaaacccctgacctcaagtgatccatctgcctcggcctcccaaagtgctaggattacaggcgtgagccaccatgcccagaagcccagctaatttttgtatttttagtagagatgaggtttcaccatgttggtcaggcttttcttgaactcctgatctcaggtgatccacccgcctcagcctcccaaagtgctgggattacaggggtgagccgtggcacccagccagtgcctggtttctaataaatttctgatgtcacaatgtatatgtttttgtactatgtatcccttaacaaattattgttgctattattatttttaatggtttttgtcttttaaccttcatactaaaaatacaaatgatttgcataccaccattatggtattagagtattctaaattaactctatttacatttaccagtaagtttcatacttttcatattctttttgttactaattagcaaccttgtctttcagcttgaagaaattctgttagcatttcttgtaacacaggtctagtctctgagcttttgtctgggaaaatcttcaaatctccttcatttctaaaggagagctgtgccaggtacagtattcttggataatgggtttgtttttgtttttttgttcttcaacacttcgaatatatcatcccctctactacatcccatagttttgggttttttccaagagctggaaaccagagttgtttctcattggcaaatccacccaaaactttagcaaacaatttgctaaaagtcacttaaattgtgtcactcccatactcacagatttttactaaattttatgcctacagggacacataatgacattagcatgtttcaagaaaatctcctggctgggcacggtggctcatgcctgttatcccaacactttgggaagccgaggcaggtggatcacctgaggtcaggagtttgagaccagcctggccaacatggtgaaacccagtctctactaaaaatataaaaattagctgggcatggtggcgggcacctgtaacctcagctactcagaaggctgaggcaggagaatcgactgaacccaggacacagaggttgcagtgagccaagatcacgccattgcactccaacccaggcgacaagagcaaaattccatttcaaaaaaaaaaaaagaaaatctcctacagccttccctacctcattcaccaattttgtttatttcaaaaacttactacctctcattctgtttatgtaacagccaaatgtacatacattcttcccacacgtagcattctcatcatttacggccttcacttgttacacaggaatcggcttcacaaatccaatattcacataccccagctgaaagttgtaaatatcacctaatgataaaaaaaagtttttatagtttttgaaattctaagtttcttctctgccatcagttacccaatcaaatgtgccctggttataaatacatataaaaatcctagttttatacactttgctttttaattttgctaggttgcactaccagattttaccaagaggtggcaaactacaaacacaaatctgaaaattcctaaatttgtatgttccaagtaatgtaaaaagtaactatatccacagaatgctagtagagcagggaatcttaaagatcagttggtgatcttcagtggttaaatagtacagattctggaatcagactggtctgagttaggatcccagctctgctgtttactatgtgtgcaaccttgtgcaagtttcagagcctctttttgcttccttacctgtaaaataggataacaacagtacttactcacaatgttactctggtgattaaacaaaatgatccatgtaagttgttttagcacaatgcatggcacatagtcaaatttcaactatgatggtgatcacttcaaaactccttaaattataaattcttacaccagtctaccagcaataagggacatgtattacaaataaacctaagcacaccttactctctaaacaaatcactaccagcacatccttcctgcctagatgctgctagcaaaaattgggggaaaaaattaaagattcctaaaaaattctgctgttaaggtaacatgtggaaatcaaatttttttttaacaaatacattctatgattatatatattaaaattagaaaattctagctatggagaagtaggtcctattaggctaaccatccctcagataaccaccataaattctggacaaaagataaaaaagaggctagacacagtggctcacacctgtaatcctagcactttgggaggccaagatgggaggactgcttgaggccaggagtttgagaccagcctggtcaacacagcgagacctcatctctatcgtttaaattttttttttaataaaaagataaaaaagacttgaggacactgaagagcaaccaaaagcaagcagaaaccagacggagtctatacttagaataaaggaatggtattgagtgagtttcccaatttttaaggctttttgcctgaaaacagtccccatcctatgcctagtgaacagcaaaatatcaatagaaatcccacagtcttactgacttatagaaccagaatacccagttcaaggtgaaaacagcagctggaaagtgatgggaaagtttccgcaagagttgagaaaaggaatcctaaatacttaatattaattctacacaaatctctcactgacccatgaagatcgtacacatggggcagcctccaggcagcccagctaaataaaataactgagcagatattcctgctgcccattgtaggagagacagtttggagtttgagtacaatgaagttaatcaacaactgtcttagtcggcttgggatgccacaaccaataccacacagacttggtgggataacaactgaaacaaattttctcacagttctggagactgaaagttcaggatcaagattccaggagggccagtgtctgatgaaggctctcagacagctgcctcctcactgtgtcttcacacagtgaagagggagtgaataagctctctggtatctcttcttctaaggacataaatcctatcagacccagggccccaccctcatgacctcatctacccctgattacctccatctcccaaagttctcatctccaaataccatcacactggaggttagggcttcaagatatgaattctcggggagcgagggagatcacattcagtacataacaacaacaacaacacacacacacacagagcacaggattaaaagagaacccagaggctgggcgtggtggctcacacctataatcccagcactttgggaggccaaggcaggcggatcgcaaggtcagaagtttgagaccagcctgaccaacatggtgaaaccccatccctactaaaaacacaaaaattagccgggtgtggtgtcacgcgcctgtaatcccggctactcaggaggctgaggcagaagaattgcttgaatctgggggacagagcttgcagtgagctgagatcacgccactgcactccagcctgggcaacagaacaagaccccgtatcaaaaaaaaaaaaaaaaaaaaaacaaaaggtaacccagagcctctactaagtaacaatcccaatgtccaatatacactccaaaatgactagatatggtaatggacaggaaaatgtgacccatattcaaaagaacggtaatcaaattaaaagaaattgcctactaataaagttcatgtgctcaagaaaagaaagttaaatgacactaaagacctagaaattggctgggcgcagtggctcatgcctataatcccagcactttgggaggccgaggcgggcggatcacgaggtcaggagattgagaccagtctgaccgatatggtgaaaccacgtctctactaaaaaaatacaaaaaatcagccgggcgtggtggtgggcgcctgtagtcccagctactcgggaggctgaggcaggaggatggcgtgaacccaagaggcagagcttgcagtgagccaagatgcaccattgcactccagcctgggcaacagagtgagactctctctcaaaaaaaaaaaacaaaaacaaaaacaaaaacaaaaacaaaaaccaacacctagaaattcagagttatgtgataaatttgtacatgggtcaacatgcctgccaagggtgaccaacatgcctgccaagggtgacacagacaatgacaaataagactagcctaaagcaaaatgttgaaataagctggcactctctgacttcccctatcagagttcaatacatttgactttctgacactcttacagaccctactctctagttccattctttaaaaaaaaaaaatatatatatatatatatatatatacacacacacacacatatacataattttattatgtcacagagttccactcttactctaaactggctgccaactactcaactaattaataattagatattactgacattttagatacgaaccctatgagagttttaaagatattattgaaaagcatctataattctgtaacaattggtagaaaagttctatatatttaaaaacttaaggccaggtgcagtggcttatgcctgtaaccccaacactttgggaggccaaggcaagaggaccacttaagcccaggagttcaagatcaacctgggcaacagagtgagaaacccatctttgcaaaaacaaaaaaaaaaatttttttgagacgaagtctcgctctgtcacccaggctggagtgcaatggcgtgatctcagctcactgcaacctccacctcctgggttcaagagattcacctgcctcagcctcccgagtagctgggactacaggtgcgtgccaccacgcccggctaatttttgtatttttagtagagatggggtttcaccatgttggccaggatggtctcgatctcttgacctggtgatccacccgcctcagccttccaaagtgctgggattacaggcattaaccaccgcacccagtcaaaaaaattttttaattagccaggttggtggtatgggcctgtcattttaggtacttgggaggctgaagtggcaggatcacttgagcctaggaggttgggaatacagtaagccatgatgatgtcactgcactctgacatgggcaacagagcaaaacactatccaaaaaaaacaaaacagaaaacttggacgcttggacgttcacactgcgagtaagccatatcaacccattatctatcagtgagcagggtgttgatacttttgttgatacattcatgataggtttctacaggttttatttcatttatatatatatatattatatatatgtgtatatatataatatatatatatatatatatatatatatttttttttttttttgagacagagtcttgttttgtcacccaggctggggtgcagtggcgcaatctggagtcactgcaacctccatctcctggattcaaccaattctcatgccccagtctcacaaggagctgggattacaggcgcacaccatcacgtccagctgatttttatatttttagtagaggtggggttatctacgttggccaggctggtctcaaactcctagcttcaagcaatcctcccgcctcagcctcccaaagcactgggattacaggcaagagccaccatgcccagtcttttcctgctgcttttaacaaagagttacacccatccagaaatctatttaatgacttttctaatctactaaggattgccccagagtatgtgtctctgcacttgtcaaaataaaatgcatgaccgggcggtggctcacgcttgtaatcccagcactttggggggccaaggtgggtggatcacttgaggtcaggagttcgagaccagcctggtcaacatggtgaaaccctgtctctgctaaaaatacaaatattagctgggcatggtggcgggtgcctgtaatcctagctactcgggaggctgacagaggagaatcacttgaacccgggaggcagaggctgcagggagctgagattgtgccactgcactccagcctgggtgacagagcaagactccatctcaaaaaatataaaaataaaaataaaataaaatgcatacagactaatgcgtgtaatcccagtactttaggaggccaaggcaggtagatcacttgagaccaggagttcaaggccagcctgagcaacatgccaaaactctgtctccagtaaaaacacaaatttttaaaaaataaaaataaaaacacaaaaagtagcccaatgtggtggcgcaacctgtaacctcagctacttgggaagctgcagcaggagaatggcttgaacccgggaggcggagtctgcaatgagccaagatcgcaccactgaactctagcctaattgacagagagagacacttgtctcaaaaaaaaaaaaacaaaaaccagacaactgagttgtaaattatctgtcctaaggttaatacacagaaatttgatagtaaaggaaattctattaggtttcattatcatttgaagaaaatcaagtacagcaaactttttaagttataacttttttaaaaaaaaccttaacttttttaacttgacataacacctgtcatctgaggtcttacaaatatacatgtccctgaatatcaaaagccttctccaagtttctgtagtttggcaggtcaacacctactctaccacttattagccttgtgaccgttggcaagtgatttttgattctctgctctttatatataaataatggagaaaacagtattgacatcacagaattttcctgcgggattaatatatgtaaagtgtcgggcgaggtggctcatgcctgtaatcccagcactttgggaggccaaggcgggcagatcacgaggtcaggagttcgagaccagcctgaccaacatggtgaaactccgtctctaccaaaaatacaaaaattagccgggcatggtagcacatgcctgtaatcccagctactcaggaggctgaggcaggagaatcacttgaacccgggaggcagaggttgcagtgagccaagatcacgccactgcacttcagcctggatgaccgagcaagacttcgtctcaaaaataaataaatacacacacacacacacacacacacacacaaagcattcagagcaatggccacagctaaatgccgacacattagctaatgcaaaaatgtgcctaaagcctattacacacttctcttagtccagagtatcttccgggtactgggtatgataaattagactaggaagactatcatttcatatagtaaaggctaatgtatagccctatctttctagtctaattatgtttctccagtgtcctcctaacagtaatagtctgcttctcaggtaactttcctcctgttatctccagcatactaccaaactgccagcagaaagcagaaaactaagcctgttaaatttcactttgcacacatttttcaatcagtgaactctgtctcagggttgctatattattgatgacttagctcaaaagctttttgctcactttccacaaggagctttgtttccaaaggttaaggtttccagaagtctggcagctggatagttaaggtgttatgttattgacatgtttatatgatagtaagaggggtaaacagtgtttcacagactttaatcctaatattgctccttaggtcaagtagggaaaagattatcatttgccttttacagattgagaagataacagtgatgctcataaaagactgtgcggtggctcacgcctgtaatcccagcactttgggaggctgaggtggatcacttgaggtcaggagttcaagaccagcctggccaacatggggaaaccctgtctctactaaaagtacaaaaattagtcaggcatggtggcaggcacctgtaatcccagctactcgagaggctgaggcaggagaatcactttaaactggaaggcacagtttgcagtgagccgacatcgcgccaccgcaagcctgggcaaaagagcaaaactcagtctcaaaaaaaaaaaaaaaaaaggactgtgacctggcaaaaatatgtcaagagtcaagtcttgacttatcaacttcaaaaaactgcttacctccacacaccaaaattcctttaacagggttctaaaacccctacgtggacagaaaactaaatacacagtcccagaaaaacaggttaaaaaaatccagagcatgaggtcaagagatcgagaccagcctggccaacatggtgaaaccccatctctactaaaaatataaaaattagatgggcgttgtggtgtgtgcctgtaatcccagctactagaggctgaggcaggagaatcacttgaatccaggaggcggaggttgcagtgagccaagatcgcaccattgcactccagcctgggcgacaagagggaaactccatctcaaaaaaaaaaaaaaaattccagagcaatttcctaaatccaaaattaactgtaccaaaaagtcaacaaaatctctaaaagaactaacaatttaaattagaactaatcatatttgtataaagtacaagaggtccaattctccaagtcaaacactgtattcacattcaactaatctaataattgcaaagcatcatctaaaagtgacacccatcttaagttctttttactgattcacataaatgactcagttaaaatccccatagtcaagtaatgcttatgtcctaaactaacctcaaccactgaattttgcttcccggtaccaaactttttttttttttttgagacagggtctggttctgttacccaggctggagtgcagtggcatgatctcagctcactgcaacctcaagccatcctcccacctcagcctcccaagtagctgggaccacaggtgcgcatcaccatgcccagctaatgtttttttattttttttggtagagactgggtttcgccatctttcccaggctagtcttgtactcctgggctcaagggatccacccgcctcagtctctcaaagtgctaggattacaagcatgagccactgcaccctgacccaggtaccaaacttaaagcatttgacatttaacaggcagtcacttaaaaaaaaaaaactgcaatttacttatatgttgaaagatttcccaaaaagaaaggagaaaaggaaacccagaatgaaataatagatcaatgacaaaaactaaatgactactacaaaaactactacatgaataacatatggggaacttcacaactgagagatcaggcatcagacaacacgaatccactggtcaatcttaacatttaaaaaaaaaaaaagaagccagggtcagtggctcacgcctgtaatcccaacactttgggaggccgaggcgggtggatcacctggggtcaggagtttgagaccagcctggccaacatggcaaaccctgtctctactaaaaatacaaaaattagccgggtgtggtggtggacgcctgtaatcccagcttcgggaggctggggcagcagaatcgcttgaaccaggaggcagaggctgcagcaagccaggcactccagcctgggtgacaagagcaagactctgttccaaaaaaaacaaaataaaacaacaacaacaaaaaaaacaagtgcaagactccttctcaaaaaacaaagacagtatgtgcctcttaatgtaatgcaacagaaagtacatagtactatctatgagtattgtcaaagtatgaaactagaatctgatcaagtcttttttttttgagaaagactctcacccaggctggagtgaatggcgcaatcttggctcactgcaacctccgcctccaagttcaacggagtctcctgcctcagcctcacgagtagctgggattacaggtgcccatcacgacgccctgctaatttttagtagagacggggtttcaccatgttggccaggctagttttgaactcctgacctcaagtgatccgggatcagcctgtcgccgcctcccaaagtatggggattactgcgccccacctgattaagtcgttttttttttttctgagacagagtctcactctgtcacccaggctgtagtgcagtggcaggatctccgcttactgcaacctccacctcccaggttcaagcgattctcctgccttagcctcctgagtagctaggattaccacgcccgattactgatcaagtctttagattaactactaactagttcacaggaaataaagagtagaagctgggcaaagtggggcatgcctgtaatcccaacactttgggaggtgagacagccagatcactggacatcaggagttcaagaccaccctggccaatatgacgaaaccccatctccactaaaaatacaaaaattagccgggtgtggtggctcgcacctggagtcccagctactcgggaggctgaggcaggagaatcacttgaacccaggaggcggaggctgcagtcagccgagatcgctacactgcactcagcctgggcaacagagcgagactcggtctcaaacaaaaagaaaaaagaaaaaaaaatacagaggagaaagaaacatgttacatgacactacagggatgcattcaacaaaatccaaactgatggaaattctacaaggcaaatgatgggtttctttcaacaaataaatggtaaaagacacccccacaccccaagagagaaggtactagagactgaaagagttaccgaccaaatgctatgtgcagaattctttgtaacctgattctaacaaatcaactgactaaaacatgagacaatcagggaaatatgctgaatatttaatgatactaagcaattattaatttttaggcatgataataatattgtggttatgttaaaaagtccttgtctttttagacataaacacaataaagtatccataaatgacatttgtctgggatttgctttaaaattatcccattgaggaatgatagaagaaataaaattcacatggttgaagctgttgaaactggccaatgggtatatggtagttcattctacaatgtatctttgcaagtttgaaatctcccatgttggcctggcgcggtggctcacgcctgtaatcccaggactttggggggctgaggcgggcggatcacctgaggtcaggaattaagagacgagcctgccaaacatggtgaaaccccgtctctactaaaaatgcaaaaattagccgggcatggtggctacagtcccagctactcgggagcctgaggcaggagaatcgcctgaatcccggaggcggatgttgcagtgagcggagatcgcgccacttcactccagcctgggcgacagagtgagaccctgtctcaaaacaaacaaacaaaaaagaataaggtggaaaatagtgaaagacacattatttattcaaagtattactacatttgtgttataagtaaaactcttattttagttttgtatggcacttgaattagcgtccagtgaaaagcaaacttgccagactccagcagagggagagttgtttgcataaagcctatcaaattcaagtactgaccaaaaatacctactttgctcttcatgtccctgatgtaaatgactttcttaagaaatcttcaaaattggttcctgatatccaaaaataaaaagctctatcggaagctgcaatgcaccgcctccctctctccattccgcacctttcggtttaaaacacgatcaactgttctctggggcaagggatgcggtagttcgacttaaatcctgactgacagtacattgtcttggtccccacagaagcctccccccacccaccaaaatccttaattcttgctaaagaaaaaagatctaccatcaatattgtcaaatccctcccttttggttccaaaaaggaaatgtacctgtagagtatccgctgcacagcaaacaaggcactgctccaaacccgtgtcctctaccccctttttgcacccttctagccctccctcccttttttccatgtaaaacttgagcagagcatttggttcccttatctgccagcaactggcgccaggaggaccgtgctcccaggagatgcggagcttgtaggctgagccctgcgtcgggcgcgctgaggccgctcagctgagcccagccaggtagtcccgggctcgcgcctctgccgcctggagaggccctcgctgggagccgagtctcggctcaggggattcccgcgaagaggtgtcgcctctaacttgctacctgctcccgcccctcaccccagaacgaactgcacacccgtcccgagaggacaaatccggaagcctcaaggcaattcgagggtccttcgccgcatggaacgcggctccccacacacttgcctgccaagtctctcctttaccgcccgcaaccccagaaccattccccgcccgggcctgcgtgggtccagtaccattctcctcacggggcggactccggaagggcagcaactccacctcctcctcctccgcggcctgtagccatctatcgggaagcgtctccggaggcggcagcagaggccgccggacaaggaacgcccagggaaaccttctcagaactaactcagctccggcgctagcagcagaagccgagtctttcataattgtgcgaccaactcctccgggtgactggccacagggacgcgcccgcgcccgcctccgccggcgacggggctggggacggaccacgtgagcggcgc

SEQ ID NO: 1381 - DNA, 465778 bp, Homo sapiens
gctggtgcgcaggctcttagcgcgcacgcccagaaagaggcttctccaacccggcccggcccttccttcccctttcccgcagtcgttgcctcctcctcccctgcctcctcctccccttcctcctcctggccgcttagtctcacacccgccgggccgttgttcccgagacgttgttgagtcccctgtgtcctcttctgggtgaggcgtccggccacttaagggaagggaagggaagggtcggccttgactgcatccccaaggctgcctattaggtgtctggaacccgtgctgcttcctctccgatcagtgcccacttatctgtattcagtactctttctctcctccccttacccttgtaggacattttcctggcatttgaggagcctttaattcacgtctggctaccgaaggcatttttaggctagtgttgcttgtagatttaaacgcttccagcacttgtgataatgtttgaggcacagctgagtttagatgagataatgctgtttggttacagttatcctgagtagaaaggcctagggatatcttttcatttttagccgtttcctttttatttaaagattgacaaggggccgggcgcggtggctcacgcctgtaatcccagcactttgggaggccaaggcgggtggatcacgaggtcaggagatcgagaccatccaggctaacacggtgaaacccccgtctctactaaaaatacaaaaaattagccgggcgtggtggcgggcgcctgcagtcccagcttctcgggaggctgaggcaggagaatagcgtgaacccaggaggcggagcttgcagtgagctgagatcgtgccactgcactccagcctgggggacagagcgtctcagaaaaaaaaaaaaaaaattgacaaggtgcaaaatggtgaatttccctcatcatgggctgttttccactaaagcacttctgtgtcttaacacaaatttcttccccgaagagtcagtcatgacatgaccaaagtctgaaaagcagttaatccttaggttaaattttaaagtatgagaccaggaggggtgaggtgcttattcttttgacttgtaaatcagaatgaaagaagggaaagtcttttattttgtggctgttatttaaatggtagagttttgctttgtatagtttttgcttgcttttcctcttttttttctatgatccaccacgtgtatgtcctgatttttttcctttttaacttgcttgctggattttccagccagatgactgccgcttggtcttctgggagtctcctgttaatggggccctcatgcttggctcttgacctgatggccactggcctggctcttggaggacctcctagtgggaggcccagagcactgttattaaggatgattgggggaacagatcagagggggtcagctgggcctggagatcaattttgagggggagggaggttgggagcctgcctggctggatttggaagtcaaaacatgtgtgctgggagaagggcataaccccagagggtggagagccatgtctttctggataaaattaataagtttactgggaggaggctgggccttccaggctgtgttagtttttgttgtgggccttggcttttcctggaatttggttccctttccctaacctttcacttattagtttaaatagttccctttacctaacctttcacttattgatttaaatagtttaaatcacagtcaattaccagctggtttttaaaataatttgaggtaatgaatcttgcccttaatctcctagccagagtggaaccccctacctccacccccagggggatttgaaatgattattttaccagaacgtgctacagagatcacttaccttctcacccgcccacctttttataatggagggacatagaatcaacccaggtggtgtcagagatcatccaaatcagttcttcatgtattcatttgttcactcatcttgtccacatactttgggcccagaactgtggtagtctctgggaaagtgcagatgagtaagacttggtctctgctttcaagctttcatccagtttgcttcaatccactttgatgagggagattatgtgatagtgagatgagtacattgaaaaggtatgccgaagactcccaggagttgagagaagggcaaatggctcaacatggggaagccatttggggaggacttcccagaagggaatactggagccgagttccaaagcctaagtatgagtgggctggagaaagagcgagggattatatgaaccgggaacagcatgtgcagaactacacaagcatggcacatggttgattaggatggctgtgcaggaaaggataagttggaaaaaatcacctgacaggaggctggggagggtgaaggccaggtcaggaagggtctggtgaatcatcttaggggagtttgaaatatatctccagggcaaacagtgatacatactctcaggtttatgttatagaaaattaattctggctgcagtttggagaatgaattggattggcgaagcccggagagaggtaattgtagtaatataggtgagagacgtgttagggtaatagttatgggagtggagagagattaggaaaatagaatggttaggaatgttataaaggttcagtgccacaaaagaaatagcacttgaatatcaaattttcttttttcttctcagcaaggccatttacttctatagaagggtgcgccctcacagatggagcaatggtgagcgcacacctggacaagggtgggggggcgggtcttatgcctgacgcacgtggcccctgttgctgtgtcgttcccctattggctagggttagactgcacaggctaaactaattccaattggctaatttaaagagagtgacgatgtgagtggtttggcgggaaaaatggttatggcagagcaggaaatcggaatgagtcagggtggagaatgagcaggtaatcggaatgagtcagtgagtctgggtggagcaggtgatcgaaaaagcttgctttatgaggacgttaaatttaaaagtagaaaagaattgaacatactgacatattgattctttgaagagaaatttagagctcatatctaatggaaattaattactgactgaatgtagggataagaaggaatgtagtcatcagtaggtgttcttgagtgggctattttgtagcagctttagtgaggaataactgacatccagtaaactacgtattgagagtgtctaattggagaagttttgttatatgcatatatctatgaaaaccatcatgaccatcaaaagaacatacctaataaccccaaagattgcttgtgccctttttaattcctctttgtataccccctaaggtaaagtatgtattcaatctttcgtccattttaaaaaatgagccttttattttctttttattgagctttgagaattctttattcttatcataagttctttatcacgtgtaacttgcagatattttcttattttgatgcttgtctcaacagtgtcttttgaaagcagagttcttaattttgatgaagtctaatttataatttggttaaataaatgttaccaatctgaattataatggatcatgctttttgtgttttatctaagatatctttgcttaacctaaggtctcaaatattcttcctatttttaaaagaagttttgtcatttttggttttatattaaatctgtgatcattttaaggtaatttttgtataggacatgaaatatggaatcaagttttttttttgcatatggctatccagttccagcactgtttgctgaaaagcctatcttcattgaattgcctttgcacctttgttcaaaaatcaatttaccatgtatacattggcccaattttgtgttttattttgttcagttgatctcttgtctattttaatgcgaacaccacatagtcttataaatacagctttgtaataagtactgaaatcaggtagtataagtcctttaattttgttctttttaaaatttgttttgattattctaggttctatttccatatgaattttataatcactttgtccatttcaaaataaggcctatttagattttaactggaattgtattgaatgtatacattaatttggggggagaattgacatttgaaataccaagtcttctgacccgtggacacagtatatctgttcatttatttaagtcttccttatttctctaggcaatgttttgtagctctcaatatgtaggtcttacacatctttgttggattatctgtaggtatttcctattttttgatgatattgtaaatgatattaaaattttatgtattttaaaaatttattttccagttgttttcttgttactggtatattgattgtgtatcctgaaatcttgctcatgtgcttattatttctaagagcatttttgtagatgccatcagattttctatttaggtgatcctgtcatctgtaaataaagatagttttacttcctttccgatgagattgccttttatttttcttgctgtattccactagccagaaccattgctttgcatagaactgatgagagctgacatcttgccttcttcctgatctgagggagatgcattcattttttcattattaagtatgatgcatgatgctagttgtatatcttttgtagatatgctttattaggtttaggaagtttcattgtattcctactttactgagaatttttttaaaggaataatggaagttgtaattttgttgtttttcctataactgttgtgatcattcttttttttttttttttttttttttgagatggagtttcgctcttgttgcccaggctggagtgaagtggcgtgatctcggctcactgcaacctccacctcccaggttcaagcgattctcctgcctcagcttcccgagcagctgggattacaggcacgcaccaccacacccagctgattttgtatttttctttctttcttttttttttttttaagtagagatggggtttctccatgttggtcaggctggtcttgatctcctgaccttaggtgatctgccctccttggcctcccaaagtgttgggattacaggcgtgagccactgcgcccagctgatcatttatatttttaaaaaagattcttaatgtggtgaattacatttattggtttttttttccaatgttaaatcttgtgttcctgagataaaccctattggtcagggcatattatcctttttttatattgctgaattttattagctgaagtttgaagaatttttgtatccatccttatgatggatattgatctatagttttcttgtatcagctaaatacctgacctctcggtaaatctggcctcgtagaatgaattaggaagtatttcttccattttgattttttctggaagagattatgtagaattggtatttttgtttcttaaatgttattgcagcactattcacaatagcaaagacatggaatcagtctaaatgccggtcaatggtagattggataaagaaaatgtggtacatatgcaccatggaatactatgcagccataaaaaagaacatgatcatgtcctttacagcagcatggatggagcaagctggagaacattatcctgagccagctaacacagaaacagaaaaccaaaaatactgcatgttctcacttataagtgagagctaaacaatgagaacaaatggacacaaagaggggaacaacagacactgagatctacttgagggttagatctacttgagggggtaggaggaaagaggattagaaaaaaaaataatttattaatataaaaaatgcaaacctaaagtatttaaataaaattgaactttattcagtttgttgaaagtttaattgaatcttattaaataagttttaaaaaataaagccattcacaattccaaaaaaaaccccaaaaaaccctgtttagtaggattcactagtgaagccatcagggcctggagttgttgttttgggggcaggaggttaaatacaaagtcgtttgattacatagatataggattgttcaggttatctatttcctttttcccccagctttattgaggtatgactgatgagtaaaaattgtacatgctcaaggtgtgcaacgcaatttgatatacattgtgaaatgattaccacaatcaagctaattatatccatcacctcatgtactctttcttggtgtggtgagaacacttaagatttactctcttagcacattttaagtatacagtaaattatcaactgtaatcactatgttgtacattagatctccagaatttttctaataactgaaagtttgtattctttggccaacatttccccatttcctcaatccctggtaaccaccattctcctctctgctttaatgagttggacttttttagattcttcatataaggaatatcatgcagtgtttgtctttctgtttttggcttatttcaataggatgttgtactcttaagttcatccgtattgtggcaaatggcaggaatctttaagactgaataatattccattgtgtatatatgtatgacattttcattatccattcacccatctgtggacattaaggttgttttcatatcttagttattgtgagtaatgctgcaatgaacatgggagtacagctattacaccaagtagtgatttcatttcttttggatatatatccagaagtaagattactatatcatatggtagttctatttttattattttgaggaacttctgtactgtttgccataatgctgtaccaatttacattcctaccaacagtgtacaatggttcccttttctccatattctcatcaatacttattctttgacttttgataatagctatcctaataggtatgaagtgatttctcattgtgcttttgatttacactttgctgatgattagtcatgggtgagcacgttttcatatacctattaggcatttgtatgtcatctttgggaaaatgtctattcgagttctttgcccattaaaaaaaattaagttacttgagttgtatacatttttaaaaatatattttggattttaagcccttattgggatatatgatttgtaaatattttctcttttagaggttgctttttcattttctcgattgtttcctttgctgtgcagaaactttgatgtagcctcacttgtttatttttgcttttattgctcatgcttttgatgtcatatccaaaaaatcatagccaagaccaatgtcgaggagttttttgtcgttttcttctaggagttttaatgttgcaggtcttatgtttacaactgtaatccattttgagttgatttttgtgtatagtataagggttcaatttcattctttcgcatgtgactatccagtttttccaacaccatttattcaagagacttccttttccccattgtgtttttgttgcttttgtcaaagggtagttgattgtatatgagtagtttatttctgggttttctattggttccattagtgtatatgtctctttttattccagcaccatattgttatgattattatagctttgtaatataatttgaaattgggaagtgtgatgtctccagctttgttctttcccaagattgctttagctatttggagttttttgtggttccatatgaattttaggattgtttttctctattttttttttaaatgccattggtattttgatagaaattactttgaatctgcagatcactttgagtagtatggttattttagcaatattatttctaccagtctgtgaacatggatatgtttccatttatttgtgtcttcttcagtttctttcatcataggtttatagttttcaatatacaaatctttcacctccttggtaaattttttcctaagtactttttcctttttgatgcccttctaagtgagattgttaatttctttttggggtagttcattgttagtgaatagaaatgcggctgctttttgttatgttgattttttattctacagctttattgatttaatttattagttctaacagttttttggagtctttgggtggttttctatatataatatcatgtcatctgtaaacagacaatgttatcccttcctttccaatctggatgcctttcatttagttttcttttgtaattgctctagctaggacttccaatactgtgctgaatagtagtggtaagagtgggcattctctcttgttcctgatcttaaaggaaaagctttcggctttttgatgttgagtatcatattggctttgggcttgtcatatatagtctgtataatgttgaggtggattccttctatatctaatttgtgatagtttttattgtgaaagtatgttgaattttgtcaaatgcttttgcagaatctattgagatgatagtatttttatcctttgttctgtgaatgtagtgtatcacatttattgatttgcatatgttgaaccatccttgcattacaaggatagttacttacttgatcatggtgaatgatcttcttaatgtgctgttgaatttggtttgctagtattttattggggatttttgcatctgtgttcattgtggatattggcctgtaattatcttttctcataatgtccttgtctagctttagtttaagggtaatggtaatgctggcctcataaaatgagtgtggaagtattccttcctctttaattttttataagagttcaagaagaattttattaattgtttaaatgcttggtagaatttatactctacccaattccctctgagttatgaggctttctactctggctgttatgaatagaactattcctggccttatgtgaagcccactgatttgttctctctaatcctttttggtgcttctgcctcagattgttttcacatatagatgcattagtacggatgattagtactctcctgaatacttggggagtacctttgcaattctctggcattcttcttctgtgcagctctctcctctcttgcccaagattctagcctttttgttctccacagactttcagctctgtctcctcaactcagggagactgctgggcttggcctgtgttcatcctttttgtgccacaatctgcagacatatcccagggattaaacttgagccattgaaggacttatctcattttttcccatctctgtgtgattactctgttgcctgatgtccaatgtcatgagaatctttgttttctatttttttccccattgttttaagcagggaggtaaatatggttcctgtcactacatcttggctggaattggaagcattcaactagaatttttgaggaaaatataaataagggactatctaaagatgtgaggaggggatttttgaggtactcagataccaataataaaggggaacttttaccacttcaaggtgctaagagcatggtgaaggaagtatatcagagggaaaaacataagctataactaaattaggataattttcaataaaagaactattgagtaagtgagggcagcctgaatgcctgggtctagtaacagtaagactgttacatccttagacccaaaggggtgagggaaggactggttaccagaacccaaaaggagaaatcgtgtggagaagcctgcctggagaggatctgttattttagcccaagagaagcagctggcccaggccaactctacaggaaaagaggcctgaccttactcttctccttcctttgaggcttcagctagagctctccattgctcaaacccaactagaagacagaggattagagagtcttggagatccagattattgtccccaggacagatagcagggagggaaggtagagaatggatatgtagttggggaagaatatacagtgacatatgtatagagtgcacttaggaaggataggaaaatcaaataaaaattgttcaggctaaatatattaccagtcccttaaccatctagatttggggctgagctacactgaaatccattgcagattatgctgagagctgaatagcttggattctgctaaacaggctatgggagagagattaagaaaggactcggttgctgactggatattgcaagatgaaaattgagaagaagacaaagtctataaaatgaagaatgaggccaagcacggtggctcatgtctgtaatctcagaactttgggaggccgaggtgggaggatagcttgagcccaggaattcgagaccagcctggccaacatggcaaaacaccatctctataaaaaatctaaaattattgtgtcatgatggtgcatgcctgtagtcccagctactcgtgaggctgttatgggagaatggcttgagcccaggaggtcgaggccacaatgagctataattgcatcactacactccagcctgggtgatagagtgagaccctgtctcaaaaaaaaaaaaaaaaaaaaaaaaatcgagtgatttagacagatcaaactcaatctagttaaccaaatattgggattgtagaattatgtggcagctttgacatttgaataaggctattgttaggatctttaaaaaattgtcatgtgacatagtagaaagaacataggattgaaatccttctctgttattcactgactctatgaccctgacaggtgacctaactgctcagaaccttggtttcccatctaaaagttgcagaaaagattagcaaggccatctggtaagtcactggcaccacatcttgcacagagtaaatgttcataagaaatttattgatgtaagatgagggttggctcaaaatataagtaagtctaaaaagcatttggattcatgtgaagctacatattgataaaacacagataacactaattctagtgaacccttaagggaagaatagtgtatttgacaaggattacctcaaaattcccctcaaagacagtttgtgaagaagccccagctccctttcccttctcccttaaaaagcagattattttttatgttagttagaacaaactatagatagtttgttcctatcaagaacaacttatccttgtcagagattggatgctgggctggatgggccagtgatgtgtcccagcatgtgttgcatccagggggtctccaggaagggagagggaaaaggaagacttcctgtgtgcttaccgtgtgcagctagcccagcttacctcatctccatgcagtgtcatgtagaaacatgggtgactgaagatcattctagttaagtatggtcagtgcctcttaatgctgctgcttctctttttattttagaaaaccatgtcatggaggaaaattacaggaacttaaaatgtatagcatggagaaaagaagacccaacaggaggtcatgagagtcatcttaaaacatttgaaagggtagcccatgtataagggtaaaaaaggctgtttggatgatcctttgggataaaaattaggactagagggtaggagctatactaagcacagttcaactcaatacagagaaggtcttccttcctattactgtaatagctgctcattgagaacattcagacagcacagagagggacaggtaaatggcctccaaacctccactatatttctttttgctggatgtcattgcagtaagcaggttttgtgtgtgtttcctgaaatcttttatgataggtctttatacaatacagtggttctcaaactctagcatccatcggaatcacctggaggcctttttaaagcacagactgctgaaccccaccccagtgtttctgagtcactggagctggaagggggcctgactttgaatttctaccaagttccctggtgatactaatgctgctgctcttctagagaccacgaatggccctgttaaaatttgagaaaataaaagtttgagaaccactgtattgcatgaagaaaatagagcttttgctctattctttattaaaaaataatacaaatggcatcatactgtatcatccaagaacttgcttttttagttaataatatataattagcagctttctttttttctcattcaacagctactgatgtatcaattttagaagtcccctattaataatcatttaatttgcttctagagtgtttgtggatatgttcttgcctttacaaaaaaaggttgtggtggattttttttgtatctttttgatgagtcagtgcataaattcttagaagataaattcttagaagttaaactgttgggtaaaagacttgattttaaaaatggatagatagtactaaattattctatcaaagatagaatcacttttctatgaaaagtgtatgaaacagcctgtttcccacacttttgccaagtgggtattatcaaaattttccagttcctgtttgttaggtgtaaaattatatcttagtgttgttttgatttatattcctacactatttgtcagttgaaagattcctatgtatttatttttctatgaactataagtttgtattctttgcattacaggtagagggaacagtatgaacaaaagcaccaagccttcctttgaatagtttctagtagttttgtagcattgaagtacgaaggttgaggttagggagagaggcagggagctaaggttagaaagtcaggcaggggcctgagcttagaggtccttttgggtcaaataaagatattgggctttattttgggcagaagaagcattggtgctgtttaagcttgtactttggttcgtggtacttttgacagagccatgtttgtggaatggtcaagtctaatgtttaatcttcaaataattcattctttagtcctttcaccttcggccttaaagctaccagaccagggccaagcgtggtggctcttgcctgtaatcccagcactttgggaggccaaggtgggcagatcacttaaggccaggaattcgagaccattctgagcaacatggcaaaaccctgtctctactaaaaatacaaaaacaaattagctgggtgtggtggtgtgtgcctctaatcccagctacttgggagtctgaggcaagagaattgcttgaaacccaagaggcagaggctgcggtgagtggagattgcactactgcactccagcatgggtgacagagtgaggaaaaaaaaaaaaaaaagctaccagaccaggcttcataaactggtaaacataagaatgggccaaagacttcaacccatctgtgacttggcattgtctctgaggggggaaattttgcatgatcgcatggagaatggattttgttgctttatctgatattgtcctcagctcctcctgaatttgccgagatcttacagcagtcagtaaggttggtgagttctttcgttgttttaatttgagtgactttctgggaaaaactgtggatttcggccaatatgctgatgataatagcattgctttgaaggtcttgttctgtagaaaatcatttcatagttaattatgtcagcaaatcaacagcaacctcttgaagaagaaagcagtgaggggagaaactgtgtatatgtttaaattattcagaactcaaagagaggtcaggaattcacatttcaaaaggaggagtctatgtaagaacaaatcattaaatttgcatatcttttccccattatgggcctagttttgtaattggcatattagggattaaaatgaaataaccctgcatttagaattaggaaatgactccccctgtcccccgactatctccctttctgtctccagggtcctggcacaggagtaagaaactatcacatttaaatgtctgcatttagagaactcagggtgtccgttgggtttgtagaagatggactgactctgttgattcacttgtcgggtggaccctttctccatcgtccttctctcctcagtgtgtgttcctatttaaatggagccccctgcttgggagggagactgctccaaagaggagcatggtgcttcagccacaagccacatagaaggcttgctcataatgctgctagaactctgcagaggaagaaagttttttagggtctttttattttaagagatatttgactattttatatattaataatcctctcctccttcacaacccagtaattccccttattactacattacaatacattgtgctcatacaaggaaggtagggagcagagcattttcagttaatatctaatgtttcccacagtaggatttatcgtgacatcaggtagtctgtattaactggatcatggagaaggcatttctaatgatcatctgaaaaggcttcacaggattaacagatttgaaacttcattctctgtgtgcccaggacacaggcagcttggttagtgtggaaagccaagtcatttcagggatggtagaaagagttcagctctggctgataacaaacctgaaattttttttttttttaaagattcttttttttcaatattttactgtaagttccaggatacatgtgtagaacctgcaggtttgttacataggtatacgtgtgccatggtgatttactgcacctattgactggtcctctaagttccctcccctcgtccccccaccccacaacaggccctagtgtgtgttgttcccttccctgtgtccatgtgatctcattgttcagctcccacttatgagtgagaacatgcggtgtttggttttctgttcctgtgttagtttgctgaggttgttggcttccagcttcattcatatccctgtgaaggacatgatctcattcctttttatggctgtgtagtattctatggtatatatgtaccacattttctttatccagtctatcattgataagtatttgggttggttctatgactttgctattgtaaacagtgctgcaataaacatatgtgtgcatgtgtctttacagtagagtgatttatattcctttgggtatatacccagtaatgggattgctgggtcaagtggtatttctggttctagatccttgaggaatcgccatactgccttctactcttccacaatggttgaactaatttgcattcccactaacagtgtaaaagcattcctgtttctacatagccttgccagcatctattgtttcttgactttttaataatcgccattctgactggcatgagatagtatctcgttttggttttgatttgcatttctctaatgatcagtgatgttgagctttttaaaatatatttgttggctgcgtaaatggtcttcttttgagaagtgtctgcttatatcctttgcccactttttgatggggttgtttctttttgtcttgcaaatttgtttaagttccttgtaaattctggatattagttctttgtcagatgggtagattgcaaaaattttctcccgttctgtaagttgcctgttcactctgctgatagtttcttttgctctgcagaaactctttagtttaattagttcccatctgtcaattttggcatttttttgcaattgcttctggcaaacctgaactttaatatggctttgtccctctaagggctttgtgactatcaacaggatattgactctttcaacatttcagtttcctcatgtagatgggagaaacaacatatactttggtaggtgttataaatgtggattctcctctccttttctctgtaaagggaatggcttggtaggtcaacagaagaaggcattataaacaagtaaatgtgctttattggaacacaagggttgaacagaacccttgggagggtgtaagcagggttttatggaagatggtatgggagatctgaagtttaatttctttaaggggatgtttgttggtggagtttggggatgtcatttgatgagtcagattttttcatccatgatatctttaggacctgttctgtgcatttggcttcagccaagtttgggttttatgtttcccttgtgactgctgttggacattacctgtgtggctcttggaaggttatggtttttggccaccattcaagatggttcaccatccaaaactggctcagtttggattcttgtggctgccacattgtgaggcacacatggggatttggtaggttctgtcttttctgccttttggaatccaactttaaatttaaaaggatagccaacttttctactgtctttctgatttaataccatgtccctcttccaatcatctgttagtctttacaaatgggctcagtaaagagcataaggatccccaaaaccctgaaaaatactgagtttctgacctagttggtcagaactgttggaacagtaatgagagcagtaaactggtacctccattaactgctgacttgttgctgtgtcctcacatggtagaaggggcaagagtcttccttgggcctcttttatgaggatactaatcccgttcatgaggactcctttttcatgacctcatcatctcccaaaggtcccactttttaataccatcaccttaggggttaggtttcaacacatacatttttggaggacacaagcattcagaccataacattagactgtcagtttgttaaaattagagataatgtatttttcagccccttattcctagcatcctggcatagtgaaagcacttaatatttgtttgtttactggaaatcaagctgttagatatggcgagaatgcctaggtatagataacacatattaaaagatgtgggtgtcagcaattgcaaaaatgtgaaaacaacctaaatgcccatcaatcaataagtgggtaaagaaactgtgatatatgtatcacacacacacacacgcacgcacacacacacacacatgatggaatactactcagccataaaaaggaatgaattaatggcattctcagcaacctggatgggactggagactattattctaagtgaagtaactcaggaatggaaaaccaaacattgtatgttctcactcataagtgggagctaagctatgaggatgcaaaggcataagaatgacacaatggacattggggactcagtgggaaagagcgggaagggagtgagggatataagactgcaaacaaagttcattgtatactgcttgggtgatgggtatatccagatctcacatatcaccactcaagaacttactcatgtaaccgaacaccacctgttccccaaaaacctacggaaattttttttttctttttttttttgagacagaatctcgctttgttgtgttgcccaggctagagtgcggtagcgcaatctcgctcactgcaagctctgcctcccaggttcacgccattctcctgtctcagcctcccgagtagctgggactatcggtgcctgccaccacactcggctaattttttgtatttttagtagagacggggtttcaccgtgttagccaggatggtctcgatctcctgaccttgtgatccgcccgtcttggcctcccaaagtgctgggattacaggcgtgagccaccgcacctggcctaataaaaaaatttttttaaaagatgtgggtttcaagaggtgattcagtgttggaggtgaaggttgatttgaggcccacactttgagtaagaaggctgtagagtgtctttggtgatgctatactgttacacccaaattttccttctgtgcctcccagtgccattgattctttctggttataaaggaattgcccttttaaagggctctctgtgctcattatttcctttaatcttcacaacaatcccttggagtagttgtatagaattcatgagtctcatacctgtgaagagagacatcagtgaagagacttaccccaagtgagtcagtggtagacacagatgggacaagcatctggtttcctattctgaatagaatatggtgaccctgatattgatttattttttagtgttgtggagaagaattgtcttcatttctcccaaatgcagtgactatttgttagtccattcttcagctccttattgagtacctactgcataccaaatttatttgtgtgtgtatgcactggggatacagaggtggataagatagacgcagcttatgtcttcagttgtcaagacacagtcctgcattgcttagcaggatgacttctgcactccgtcttggagcttcttttgagaacttctgggctcagagactatgtgtgtgatgttgttttctcatgttctatggtgtctgggatcttcagagcctgttagccagctggctccaggaacctatgtgtcatgggttccacaggtgaacttcttggtactggggctcttgaggtctctccagttggtgacaggaaacattccaggtgtgagtggctgaccctcagagtagagaaagggttttgttggtttgtgttttgtttctttggatttacctctgggtttctgagaactgacattttcataatctgttccttctctgcattatgttaatagacttttctggggcaggaagaatttagtggatgtcatttgttagccaaggtatatgtctgcttttttttttccttctcccctcctcccatcaatcaaaggatttcttagtttcttatctgtgaatcactcaggcttccacttaactgccagttcagtttcctccttgcccatcctcccttctcttttctcctctccttcccccacttctttcccccatttcccttttttccctctccccaccacacttccctttcctttccccctcttttccttttcctcagattcttttgaatttttcttgatctgcaacaagccaggtcctttgttaggcattagtgttagacatcagtgatgcataaaagattgttctgctcttccaggagctagataagggcctggttccacttctcagtattcagggaatggattccctgcttactcccttccttcctttggatgccacaaaatgagcacttgactgaaaatatgcttatacgcgtttttacagactacgccaagccacaggtatgtctagatgaaaaatgtgttgtgccattgctacagactctaaaagtttggggaaccatggaagtgtttgggtttcttttgagccagtcttggcaaccttaaaacttttagaactgtctccccttggagggaaaggcgaaaaagaactgaagaggaggccttaagaaattttcatgtttagaggtaaagttttggttagcaagctggtcttttcttcctatttattgttggtagagcccatagagaaacaactattattgccaaatcagctctttccttctcatttcaaatttttccaccatcttagagcatgtaaaaattgttgaaagtggtattcagtcatttctattaagactgaggtgggcaagcttaactcattgttcatcttttttcttcccaatcttagcaaatccctgattgcagtataactaactaaataaattgcacaggacttgtgtacatcaactcccagcaaagtccaaagatcaaagttgaaagaggatactgaattccttcccagatttctgggacactgcttctgtgcactgtcaccaaataaatcctggaggagtggcgccttaagaaatagggtaagctcatccgcttctgggagattgtcatcataggcagcaatcttaatgctctgagatgcttcagagggaaagaaggggaaaagtataaaagaacaatccccacattatcggtttttagctcagtatttgtagcttgtacccccttcttaggattgctaaaacccgtttgcaaaggacagccctctatttccaggtccccttttccttttttcacactgcatttgagcagtttgcacatttgttgaagaatcagccacaaagtctgtggtttcctgtggcacatttctaacaatatttatacaggctattatttaatgaactgtataaatatttatacagaacagtcttttgatcataaataggggctaaaagtcagtccagtccatgctgaggacttggacaggaggctgtttctgtgctttgaaatgtcttgtagactgagaagttaggtatgtcccaggacttgtacgcagcacagcttgaatttctgttatttttctttctcttggccgtccacagtccgtgccctcatttctttccgcctgaccaccctccccatatccctaacagctgttttctttttagagtatttatctttgcctaagaagaatgaaatgaaaccccagttccgactctcaccattcataatgcggtctttggagtcacactgacttagcctcaaaccccagcccctgtgcttctgtaccatgcaactttaaacagcttcctgtctgagaacctcactttccttagctgggaaatggggctcatactgcctacctcacagggttgctataaggattaaatgaaatcatggagtcacatggtgatctgcagctcagagctcaatagatatttcttgctgcatttgttgttcttattgaagaagtaatcaaagggtttggctttcagttttagctggatgttgtggaaggagccctaaacttgccgcaagagactgtggttcaaatcctgatgccatttgctgtttgtggcactttgggcaaattactccacccttctgaggtataataaagtggtgataggtttaccaaactgattgggtttctgtgaatgagattaacattgtgtgggaataagtgacacgatgatgatccttatccttgtttactttacaaactagaaaaaggaataatgctttccactttacagttactttactttttgaggccaaggggtactggttgcataagattaggagtctaggacgcagcagatcatattcatgacccaggaacaaagggcatagagggggaagagcaggggacctatgatgcagaaagtcctttgctggagctcacaggtcgaatttcagggaagctgcccaagggcttgaacatccctgctttcaggttccaggtatggaaataatcacagagatcagttaaaactataataatgggaaaagtggtgaacctgaaatatgcaagtaggatctatttcatagaaaaacatgaactgggtgatgtgtgtgaatgacgctgggatggtttgactctttgctgcatggtgccctggtaataagttatagaaatccatattttgctagaagcaggccacctggtgttgtggaagggtcagtctctgaagatgaacagcctgggttctgagtcagccaaccttaggcacagcaggcagaggcccccagcagagtccttgacaaatgggcatttagtaaatagaggaatagcaggaggcagtggagcatcctgagaaaggttagggctgatggaaccggagggaatggattactgtcaattgtattactgcctagtaatatggcatactggagcaagttactttacctatctaggacttattttcctcatcagtaaaatgggagtgatcatagttattgtcttcaagaattgtggtcaggcattgtaatcaagctgcttagcagaatatcagatatgtggtaaacatggtacctttttttatttccccagtgatgaattttaaagacatccattcactgagttacaaggacttactgagctcctgctgtatgccaggcactgggcttacagctgtgacacaggcggcagctggaattaactgtaatcataccgctccattctccatgtgaagggtgggctcctgccagaaaccagaactggagcaagcccagggctaactgtagagtggaaatctgcctctttgggttttactggaaaggaatcagaatgtgggtagggtggtaagatgatgtattttatcatattactctcttcatcagagagggagtcaaaagtgaggaacccaagcctgagcacgtgggccagccccatggggaatctgtcttgtcatcggggctggctggagtagagacaagtctggatgctggctggccaggtctgtgtaagccagggtattgaatagatttttcatttcctatttatttctttgtttcttcctaagcgtttatagtagtcttgcaaaagtcttgccaagggcaaagagttgttagcatgctaggatcagtgttaaggagcagcaccccgggggcctttgcagtagagacagtgggaagcccagagaggggattccaagtaaagtaagcagctgtgagaggttggtagagggaaggtagagtggctagcttcaatcttcttcctgtttgcagctaataaaattgaggaaactcagcgaaggcattgcccctattttgtcaatcagtgtatcctcagcaggcttcctggtgttactgtcttctgcatttcttctgagtctcagatgtcactgattgcaagatgcaccattatttattattaccatgaagtaagaaaggaaatgataccaattaattgtaacataccattgattgtaaggttctcactggttttagagaagctaaatatggaaaaatgagtgccgtagaatgaataaaatgtggttgtaaaatgaataaaacaggcatggacctgttcatccttgtttctgttaattcattgattcagttgttcattcagtaaacatttactgaaaacctattatgtgccagacactgtgcaaggagcttgggatacagaaatcaataagttcatttttttcagattcagttaggaagacagacatggaaagaaaaataaaattgtgattccagagtggtaagttttaaaagaaagcagggagaagataccatgttggcatcctttgtatgtatgcaaggggagaaagggaaggaagccttttccaaggagaattgatggctgacctgggtcttaaaatataattcagtggtcaccaggcagacaaggaaaggagagaattaggaagggatgagcaaaggattggggcagcctttagcagctgggggcaattgagagcttatgaggagtttgaggatgtctgtagcctggagtgagaatgagcaggactgtattaggcggggctggatggcaggcagagggagcctgtggagggtgtgagatcccgtgctgaggccctggggtatatcacagctcaaagctggtggttttcagttgtcctgagagagggcctagcagagggactgctggggggaagggctggagggtggggcaagggcgatctttgcttcagagcagctctgtttttatctgttttgttttcttcaaataatggcttgaagaaaaggtatcactgttgaatgaatgaaggaatgaatgatttgaaaactggtgctaatggtcatatggaggtccccaaggggaatgtaagcaagggagagaagttgaggttacacaccagtggaggtctgatgaagctcctatgaacggagcaaatgttacttctgcagcttctccattttatttttcacctgctcatgagccacagagccaaaagggggacaattctgttgggaaatcattgtgattaagacagaagcaattacttttaatgaagtttttattgttttatttgttttttactggagtaaatatctaggaagcagtaactgaacatctgctggttgattttctttcagaatctccatgtttgacttggctagggaaacattttctttctgaagttgaaggatgcagaaggttgcccaggttgaaattagactctgggtggtaaaactgccttgagctcacctggagagttgtagggcatccacctgctcagttgtgttgggggcttgttcttattctttcaaagccaatctggaaaataaaagcctctatgagattccatgtcatgtgggctaatctgaccaaagggacttagagcagccatgaaggccaaggaattcctgaatgttctctggtcagatttccttgtaactcacaaggggtctgtaaggaaaacagattgtctaactaattgctgatcttgtctcctcggggttccttcccaattcccagtcacttcatgacaaagctgcaatatatttgcctcttctccaaacctatacagaaagcttttaagaaacaaaggaaagagcatgaaacttgggattgcacaaatatgggactttaggtccaggctgcccctgaatgaagctgattaaattccttaacttctcatagacttgcttcttaatcagtgtagtgtgtatcattataataatgtacatttactgtttgaatttatgagtagacctagctagcattaagcaaaaagttacttatctcttggaatctcaccttgaccacctgtaaaacagagatgtaaatagcctcaccttctagagtcatagtgaggagtaaaggggacataagcacttttcacagtgcttgcgtgtaagaggtacttagtaggtaattgttgaatgaatgactgactaggaggacaaggttccttttcagtaccttggcttctgttcttgttgattgaaattcactgagaagaaactcatctccattgcctccagattctaagttctcctaccaccctgtacttgcccttacagcactcatcacaactttgcctaaataattatgtatttaaatcctgactctctctcaagagtggaaatgccatgtctgaggccatatctgtgctgttcacccaccatgtagctcaatgtttattagtatactgttatcactaaaaatgtttgttggatgaataaataacaaatggctaccggttaggtagcggtacctcttttatttctacttttgagatgttttgtgactgtctttgcagatccacttggtcttcatatggtttttacacttgcttactataggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaaggtatgggcaaaactggtgttctctccttgttcatattcctacctgctgagtgtcgtgtgtcaatctggtgccgtaaacaatgttggggtaactttagatgcagaggtaagcaagacataggccttgcccttcaggagctcacagtctactggcagagactgataaacagctaatatatggtaagagctgggatcaaagtaactatagctggagctggggaaagagctaaccggagggggctcagggaagacaggacagcttgaggtgtgaccacatgtggaagaattcactgatcaccttattaacatttaccacgcctttaatgtgtgccaaaggctgtgtaaaatgtgttaacttgcactgtgtagttgcatcttcacatgaccctataaaggtaatactgtcactacccctattttattgagggagaaatgtaggcacagaaaagttaggtaacttactcaagttcacacagtaagtagcagaggcaggactagaacaaagcagtctgactccagaggtgcgctcttttttttttttttttttaattaaaaaaagttcaatgggtttttggggaacaggtggtgtttggttacgtaagttctttagtggtgatttctgagattttggtgcactcatcacccaagcagtgtacactgtacccaatgtgtagtcttttattcctcaccaccccccagcgctttcctccgagttcccaaagtccaattgtatcattcctatacctttgcctccgaggtgcactcttaaccattggactctgctgccttccaagtggacaaatgaggatgagaggaactgcattttgggcagagggaatagcatatgcaaaggcatggtggcacgaaaacatggtgtgttctgataaagcaaaggagtcagattagagtgtctcccatatatgccaggcatatgttcaccctgagtggccttggattggatgcagcctgctggcttgggaaggaaagcaatgcttcacaattcttgtttgtttttaaagtttcacttgactgtttgattttatgtcttggtgatcagtaatgacagaggtccttttgtctttttttccatggggaaaaataaagtcctggattccttcttttccctgttcctagtttagttccttaaatattcatgaggtgcttggtaatttgcagatggacaattcaccattctgtccctattgatcagtctgtttaaactttaatgaattctgggctgctgttagtgcccccggagaagaaggcagagagaggagggagtgggtaggcagtaccagagcattatacaggaataaaagagggatgcatcttctcttttgcccatttaattttcctctcctctcccctcctttcagcccccaatctggtaagaatcttctactctttgcacttgggccttctttcttcttttaacatacagccttgcttgccgttaaggaaattatcaagaagaaaatataatcccctgatgaaaagctactttaaaaaaggtctactctaagtacagctggtttaatggtagatttttaatcatctcccagtggtggccaacttatcatctgtttgagccctgttagctgcataagtaccatggacatctgtcgatagcaatgctattgcactatagcaaacctaaatgaagcccttgggtcttaggcgattctcctcagatggagtatggatatgtgggcatgtgccagaagccacaggataagcatgttacatctatatggaacatcattgctggtgtgaggcttagggagggaagcatttttatgttagagagataataacaccataggaatgagagaggtaggtgacctgttatagagcacagattctgcagccagactgcctagattgacatcccacttacaacgtttattaggttgtgatcttggacaagttacctaatgtttcttgcttcagtttccttatctgtaaaatggaaatgacattagtacctacttccataggattgttgtgaggattaaatgaattaatgcacataggatgtcataacattgcctagaaatgtgtatgggttgtttcctatggtggtgctgatggtgacagaaaatgagcagattatagaagatagtgaatttctaagacaaaatactgaaaagtcaaagtctacggcgggggaggcgcttcttgggaatattcattcactctcctggttagggttcttactgtgtaacactttgagaaacactggtctagggcaaagggtggcatcagatatgtcctggtctgtcttttcttcctcatggactccaggaagttgagagcttcagagcagttgttctaattccttttccctaagtcattcacattgcctgagatgactttcctcttagttaaagcaacagtaaggataatgtggtgtcaatgatgatgacaaagacagctaacagttcttgggcacactggtccaggtactatactgaagagcttttacccatcacttcattttatccttataataactacttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaataactactttttaaggtagttttgattgttctctctgttttgaagatagaaaaacaatgagctttgaagaggttcagtaagcagcctaaggtctcctgaataagaagaaggggacgctgtccctgccactgctactgctctcatgctctgtcccttgtctctctccagccatatctccctccacatgaccctacctggaactgataagaagtagcctgaaatttttagattttctacacatggggcatcatgaggttacccaggattacgagtgcctttacctggttgcctgctcatctgggaagtgtgtgccccctcagcaggggttatatctagtttatctgtatttctctagaattctttgcttgtagtgtgttcaattaatgtttgttgagtacataaatgaatgatatatctctgttgtttacattgtctggaatactcttctcttaacttcctcacctgcccaactcccaccttataaagtaagcttaggcggggcgtgttggctcacgcctgtaatcccagcactttgggaggccaaggcgggcggatcacgaggtcaggagattgagaccatcctggttaacatggtgaaaccctgtctctactaaaaatacaaaaaaaaaattaaccaggtgtggtggcgggcgcctgtagtcccagctacttgggaggctgaggcaggagaatggcgtgaacctgggaggcggagcttgcagtgagccgagattgcgccattgcactccagcctgggagacagagtgggactccgtgtccaacaacagcaacaacaacaacaacaacaaaaacagtaagcttaaacattcctgtctcctgagtgtcttccttggtgacttctgacagtctatgcccttttttaccaacctcagcagaaagagagggtgagaagcccctctctactgtccagagcccaccatcttcacccagatcactttctactccttatctttgcattttacttgttggcttgtttacccccttttaaactatgagctgagctcttagagagattcatctttatgtctccagtatctaacacattgcctggcacaaattaggtgctcaattaatggctgttgaatgaatgttacttagagctaaaaacaaagagacaaaatccaatctagcattccttatcttgtttcagtgtcactgtggggcaggaaggacaactattcttcctatttgaaatatgaggaaattgaggctctggaactaacaagtattggagacaagaccagaaccctggtgagatggctccaaatcttcctctctgtcttcctccctacattccctaaatttggcaggttttattgggctggtaagccgcacacctaagaggttttatggaaactcacaagtcatagaggttatatgcagtccacgattttaaaggttcctttatggagccacaaatcttaatcattccaaaaaggtgagaacatttcaaattagtgcatgattcatactaaacttctcttaggaagaaggagaagataagctggaggaatcatttagccaacaggtgtttgttgagtatcattctttcatttagtctgcaaacatttattgagcacttaactatgtgctatgctctttgctaagcattggagcatatagaggagacgtatacaagaagtctgctgcttttaaagatgaaacagcttaattgtatgagaaaaataaacaacacatatgaagccagtaaagtaccattttgttctgtcttggtgctatctatatgagtagtggttgtggggagggggacagaagaaagagtagccacatgtcgggttgagcaataatgttaaccttatattcatagaaccattatagtttacagtgcatcttcattttcatttgattgctattgcagggtgaagtagggaagaagttgttattcccatttacatttgaaaaactgagggccagagagttaagtgattttcctaaggtcacccaggtggtatgtgataaggcagaactcagatgggtcaaacctatgcattctctctatctctagcaccatatacctttatattttgcatggaatattattccaagaacctaactgatgtcttgatattcatttttcttttctctattcttgcatttgaagtgttttttttttcctctagtgctaactgatcatgtcactcttttgctacagcccttcaacatctatcactctactacaggcataatgataaattcagttccagaacaccataatgaggtgaatattgcaacaaagctcacatgaatttttgagtttctcagtgcatatgaaagttatgtttacattatattgcagtctattaaatgtgtaatagcattagtctaaaaaaagtatataacttaatttttaaaaattgccaaaaaatgtgttaatgatcatcgaagcctgcagtgagttgtagtctttttcctggtggagggttttaccttgatgttgatagctgcttactaattagggtggtggttgctgaaggttaggtggctgtggtaatttttttaagtaaggcaattttttaagtaaggtttgctgcactgattgactctttctttcacaaaagatttctctgtagcatgcaatgttgtttgatagcatcttatccatggcaggacttctttcaaaactggagttagttctttcagaccttagccttatcagttaagtttatgtactattctaaattgtttgttgtcatttcaacattgttcatatcatctttatcagaagtagattccatctcaagaaatcatttcctttgttcatccataagaagcagcccctcatcggttcatattctatcatgagattacagcaattcaatttcatcttcagggtccacttctaattctagttcgtttggtatttccactacctctgcagtaacttcctccacttaagtcttgagccactcaaagtcattcatgagggttggaattaacctcttccaaattcctgttaatgttgatattttgacctcccatgaatcatgaatgttcttaatggcatctagagtggtaaatcctttccagaatgttttcaatttactttatctagatcaattagaggaatcactatctatggcagctatatccttacaaaatgtaattcttaaataataatacttgaaagctgaaatttctctttgatccatgggctgcagaatggatgttgtgttagcaggtatgagaacaacattcatctccttgtacatcttcatcagaactctttggtgactcggtgcattgtcaatgaggagtaacactttgaaaggaatctcttttctttgagcagtaagtctcaacagcagggttaaaatattcagtaaaccatgctgtaaatagatgtgctgtcatccaggctttgttgttccatttctagagcacaggcagagtagatttagcataattcttaagggccctaggatttttggaatagtaaatgagcattggcttcaacttaagtcaccagctgcatttgcccctaacaagagagccagcttgtcctttgaagctttgaggccaggcattggctttttgtctctagctgtgaaagtcctagatggtatcttcttccaatataaggctgttttgcctaccttaaaaatatgttgtttagtgtagacaccttcattgattgtcttacccaaatcatctgtataacttgctggagtttctacatcagcacttgctgcttcaccttgtgtttttatattatggaaatggcttgtttacttaaacctcctgaaccaacttctggtagcttcaaacttttcattctgtagcttcctcacctgtctcagcctttacagaattgaagagttaggactgtgctctggattaagctttgacttaaagaatgttgtggctggtttgatcttctatctagaccactcaaattttctccatatcagcaataagactgtttcactttcttattcaggtgttcactggagtagcgcttttagttttccttacgaactttcttttgcattcacagcttgactatttggtgcaagaggcctatctttttgccagtcttggctttccctatgcctacttgactaagcttaatcatttctagctttacatttaaagtgagagactatgactccttctttcacttgaacatttggagaccattgtagggttattaattggcctaatttcaaagttgtgtctcgggggtagggatccctaaggagagggagagagatgaggaatagctagtctgtggagcagtgagaacacacaccacatttatctattaagtttgcccgtcttatatgggtgcagtttgtggtgccccaaaacaaatgcaatagtaacatcaaatattatcatagcagatataatattaatgaaagtttgaaatattattaagaattaccagaatgtgacacagacatgaggtgacatgagctattggaaaaatgacactgatagacttgctctttgcagagctgctacacaccttcaatttgtaaaaaacacaatctgcaagatgcggtaaagcaaagcacaatgataccagatatgcctgaggcatacctcaaactgcggttttagttccagaccactgccacaaagcaaatatctcaataaagcaagtcacatgaattttttgattccccagcatacataaatgttttgtttgtgctgtaccgtagtctattaagtgtgcaatagcactgtatctaaaaaaaaggtaccttaattaaaaaatactttattgctaaaaatgctaatgaagtgagcacatgctgttggaaaaatggcagcaatggacttgcttactgcagggttgccacagacgttcaatttgtaaaaaatgtaatatctgcaaagtgcaataaagtgaagcacgataaaatgaggtatgcctgtatttgggtagaactcaatccttaacatggccttcagggccctacatggcctgtctcgacttgcattcctggctcatctcatgatgcttctcctggctctctgcattccagccacaccttccttctgtcatgtcctcaaacatgcaatgctccctttagcgtaagaattgttacccagattctttcttctggctgcatatccttcctaccttccaccagcatatctaactcctgttcatccttagacctaagctatccaatccaatagttgctgaacccacaatgccatttaaatttatagtaattacaattaaatataattaaacattcacttcctcttttgctccagccaaatttcaagtgctcaatagccacatggtggctattatactgaacagcacagatatagcacattttcattattgtagaaagttccattggatagtgctgccccaaaccttaattcaaaagttagttcttcaaggaaggagcattttctctaccaataccacctccaactaagtcttatttcacttattaaatgttttcacagtgccttgtacgtctctttcatagaactccatgtggttcgtgaatcattcattttttgttatcaaataataaaatcattctataaatcaagaataaaataccataaaatgaaacaaaataataagatatttcactttttggattaatgtatgtcttccctactagattttatgtttcaggagggcaggagctatgttttgcttacccagagcctgggttatattagacccaggaagtgtaaaaaaaatgaagggtcaaaagaaattgagagcactttgggaggcccaggtgggcagatcatgaggtcaggagtttgagacccgcctggtcaacatggcaaaaccttgtttttactaaaaatacaaaaattagctgggcgtggtggtgtgcgcctgtaatcccaactactgaggaggctgaggcaggagaatcacttgaacccgggaggcggaggttgcaataagccgagatcgcagcactgccctccagcctgggcgacaaagcaagactccatctcaaaaaaaaaaaaaagaaaagaaaagaaatggagacctccctacttctacccactggagaaaacttgagaaaggatgtagggcaaaaagtgactcttgaactcttaagagaagacaattggaactggaggaatagaatggtcagaagcgctgagatgggaacatcaaggatcgaatcctagctgtaataggtggtttctaataggaagaaggaaagggaggctagaattgacgatacaggggtaggtgagacagctggctcagaccaatggggagctcctctagaatcatcctgagtttgagattgaccagtcttgcaacagattcagaatggctggcagagaagaaactaaatttaaggatgtcaggaggcagacatcctgatgagtttcagaggctgagatttttttttttttaaactataaactttgggaagactgggaccacgtctctcttgaccaggatatgttctctgtgtctggcacatataggtgcttaatatttttaataataaatggctagattagactattggcagaggaataaataggagggctgagactgagaggctttaggaaggcaggcgtaactggacttggcaacaatggagaggaaggaggtagaggctatttgagtttcagttcttggcagaatgttggggtcactgatataaatgagagtatttggcctttatttcatcatcttatcatcaaatggcaataccatacctaagctgggatgctacgtaggtaaaggattaggactgggtttatttacttcactggtcactagagtagcttttacaaaattgactgccttcaagggccttccaggtaatgcacgccccaacacaagctgtatttgtcttcttgctgttccccctcccaggacctctgcgctcgctgttcccctgcctggaacactcttcccccagatttccatgaggtccactcctcatgtctttcaggtgtatcctcaaatttcacttgcatcttgcataggaaccacctcctccttgcattcctaatccccctgagtaatcacttgctagtatactatatctacactatgtaatttatttgatttattgggtattgtctatccctactaaaatgtaatctccaaaagagcaaggattaaaaaaaaaagtttttctctccattgtttttccaatacctagaagagaaaattctgcacagcctgaccctagaaggggcttgattattttcgctaaggacttatggctaagtgagtgattgaactgtgtaaccaacaggtagtgatggagcctgagggaactggtgattgcataactcctcgcacgcccccaaagctgacaaaggcattcaaatcaagatttaaaagaatacagtacctgccactcagaactctactgcaagctggattatgtctatgaagccccaggctttgacccttgctctaaatagagctaaggataaaaccaggtatgcatctgaccctccagttctcagtttggagggtttctaagaaacaccatctccccacccaatatggcagatcttgctgatttaaaacacatgcagaattgaaccatttcccacaataagaagaaagtgatacacaatcccttccccaaatatttgtttgctgccccatagctacgagttgacagttgttagacatggaacaggttaccaaatgaggttgcagaaatctctttctctggaaattctttagaagagcaatgtgctttctctctagctagggaaattctcttgattccaagctgttacaatgagattactgggctgctttcttcttccattaataagaatataaaaaagaattcttaggtcaccaggtcaagccccagaggccttctgggtagtgtgactctgacagtcatctttctgggatggtttagatggtgtggggtgaggggttgggaatggcgatgttcctcagctgtggatgagcatgatcataaggcatttccttgtaaggctggggaaatagtagtggctacctagctagatcaggtttaaatgcatgccacagttactcttccagtttcttgtgagaggtctctgtttgaaagatagagacgctgagtctttgtgactgaaggccatgattgtaatattgagcactctgtaggtctgttgaggggattcataacatacattgaagaaaatattttccttgctcctactaggttactcccgccatgattcttagaaagatttgagtctatccaattttttctattcctactctttttgcttgtcatttttatatgtgcttacgtgacacagagagcaagcatgctgtgctttgtacataaaaacattccatgaacacaataaggcattgagtgcatttcctatcctattttctataaaggtttactggtttcaaagtaatttcagactccactgatcccattcaaagcctttgattcttacttgggaggtatctctcactcaggaaactgaggctcagaaagttgatggagttagtgcaggattacctgacctagaagtggtggagttggcaccagaaggaagttctttggacaccacatcctgtgtttgtttctactcccaaactgccttgtggtatggagtttgagtcatctatattttctcacccaagtcctcttttgactaactgcagacctgtgtgagatgggcttacccaagtcagacatgcactttctgggcacagaagccaattgggccacatagcaagtagaagttagggctgggtgattgattgattggtatcccacatggaaagatttgaagcaactaatttgctctaatataaactgctacttactgtgcactgatgccagatgttgagctcatcacaccttattttgctgaattctcatatcattgggagatgcaggtttaggtaatagttttgtactgccaaggaagctgcttatctgacttcacaaagttatataactcggaaatagtagaaccagatttcagactcaggtcttctgcccccaaagtcgctgatttaactactatccagtgatttccaagccaagttgtaaggacattccaggcagaaatagccatacctgtaaatgctatagaaacatgaaccagcaaagcaagagaggagttgcaatggctagaattgtgtaacttgccttcagccacgtagccatggtggcagagctaggatttgaattcaagtctttgtgactcattgtcatgaggccatactgcctgtcaggaaatgggtttggtcctcacactgtaagtctagatagatcagtgtggtgaaggcatctgggtattcacttggtactgtgggtcaaggtactaccagcagtcacagatgggtcagcagcaagtgttctctagatcacatgtcctttccacaggatgagtctcttgggcaacaggaaattatctgatgacagaggtgagcagtatggtataatggaaagaaaatagacactgagtttgaattctggctctgcaatctactggctgtgtgacaagtgcaagttccttaacctctctgtgcctgctgttcaccctttccctcgccaatcatccacttcttttattttgttttattttttttgagatggagtctcattctgtcgcccaggctggagtacagttgcatggtcttgggtcactgcaacctttgcctcctgggttgaagcagttctcctgcctcagcctccctagtatttgggactacaggcacatggcaccacacctggctagtttttgtattttttagtagagatggggtttcatcgtgttggccaggctggtctcaaactcctgacctcaagtgatcttcccgtcttggcctcccaaagtgttgggattacaggcgtgagccattgcacccggcccccacttgtttttcatgaaaaactaatattaaatgtttcttttggagggctttgtaaggattaaataatatgtatgtcaaacatatggcacatagtagatgttcaatatatggcaatgctttattaatatgacttgaaaaaaattactgcttttcttttttggacatttctcataattatgtgaagctcttgtttgaggaacatgttaaatagtaagaaatggaattctaaattataaatctggtatttccaaacaggaaaaaaataattatatattttaaggtgaatttcactaaatgaggatggacatttttgagttgacttttatgggatttaaaaggttgtagtcatgttttaagttaatagaaactggtcgctcatgctttttctataaaggaaaccatagaaacaaaaataaaaaatagaattaatcgataaatctattattctacaactttaaaaattatacaaacaagtgtaaaatctatatcctcctcctgcagttccaccctcaggagcaaccactattaacaatttgttgcatattcttttttttaaaaccttactaatatatcatggatgtctttccattttatctttcatagctcaactcgttttaaaagtatttaacagcttgatgtatgatttatatatcataaaatccagccattgtaaatgtataatgctgttattttgtaaatttatacagtggtgcaatcatcacctactccagttttagaacacttattactccaaaagtttccttacacctgtttgcagtcaaccccaagccccagtcagaggcgctttctgtctttataggtgttctttttagaaattttatataaatagaatcacatagcgtgctttcttttatatctggctcttttcacttagcataatgtttttaaggatcatccatgttgttacatatatcagtagttcctttttcttgctgagtagtattctgttatatggatatacaatactttatttaacagttggttaaactatgatggatatttggttggttttcagcttgggaatatcaataatgctgctatgaatattcacatacaattctttgtgttgatgtatgtttttattttattttatttggtttgttaatattttgtattgaagttgccgggttgtgtggtaagatgtggctgtattttacatttccatcagcaatgtataagggcatcactttctccacaattctctaacacttggtattgtcagtctttgtgataatattctagtaagtgtgcagtagtatcttattgtgattttaatttgcatttccttagtgactaatgatttgagcactttttcatgtgtacattggccatttgtatattttctttgcagaagtgtccacatcttttgccaatgttatcattgggttgtttttcctcttattatttgagttttaaaatatattttatatgcaagtatattatcagatgtgttgtttgcaaatattttcttccagtctgtagcttgtcttttcgttttctaattgtttcttttgaagaaaaagatttttaaattttgatgaagtcaaaattttttcttttgtgggtcttgcttgctttttataaaatcttcatctaatgcaaggttgcaacaatgttctcctgttttcttctacacattttatatttttagtcttacatttagggatgtgatatgttttgagttaagttttgtgtatggtgtgaggtaagagtctaagttcttttttgcatatagtcatatagttctagcatcactgtcaaatagtctgtcctttcccccattaaattatataggcacatttaccaaagccaattgccataaatgggtttacttcttatatctctgttctattgatttataaatttatccttataccaataccacataaacttaggaatgctagttttatagtaagttttgaagtcagatagcatatattttccaagttctttctattcaattttgtcagtttctacaaataagtagataaataaataaataaaacctgctagttttttttttttttcactttaagttttgggatacatgtgcagaaagtgcaggtttgttacataggtatacatgtgccatggtggtttgttgcacccatcaacccatcatctaggttttaagccccacatgcattaggtatttgtccaatgctctccctccccttgccccgcaccccctgacaggccccagtgtgtgatgttgccctccctgtgtccatgtgttctcattgttcaactcccacttatgagtgagaacatgcggtgttagaaaacctgctaggattttaatggagttgtggagaatctgtaggttaatttgaagagattaccatctgaacaatgttgaattttccattttacgagtgtgacatatttctccaatttttagctcttcatagcaatgtttggtagttgtcagagtataggtcttgaacttcttgtgatatgttaattcctgaatgtatttgtcaggtttctccagagggacaaggccagtaggaaatatatatgtatatgtacatgtatgtatatgtatatattcatatatatatatttatatgtatatagtcatatatatatatatatatatgaaagaaagtttgttagggagaattggatcacatgattaaaaatgtgaagttccacaataggtcatccgtaagctagggaatgccagtagtgtggctcagttcaagtccaaaagccttgaaaccagggaagccgacaatgcagtcctgaataagtctgagggtgaaggcctgagagccccaggcaggctgctagtgcaagacctagagtccaaaggaagatgaacctggagtctgatgtctaagggcaggaggagaaaaggtgcctcactgcaaaagggagagagggaggaaggtaagcaatctgagtatcccccttgttccacctgctttgttctaatcacacccattactgattagatggtgcccactcacatcaagggtggctcttcctctcccagtccactgactccacatgtcaatctcctctggaaacaccctcacagacacacccagaaacagtgcttcactaaccagctaggcatccctcaatccagtccagttgatatctaatattgagcatcacactgagtatttcactttttgatgctattgtgaatgggattattttcttaattttattttttatcttttagttgctattaagtagaaatccagttgatatttatatgttagtcttgcatcctctcatcttactaaaattgcttattagttctagtaatttttttagcttgtagattctttaggattttctgcatatgagatcatgtcatctgcaaagaaagacactttaacttcttttctaatctgtatgcttttaatttacttttctcactttattgcaatggctagaagctcaagtataaggttgaatagaagtggtaaaagtgaacatccttgcttcatttctgatgggggaaagcattcatgttaccattaagtatgatgttagctgtaggtttttgtagatgctccttatcaggttgtagaagttctcttctatgtctggtttattgaatgttatatttggagggtaggggttcttttttctgcatctgttgagatgatcatttggtgtttgtactttgttctgttaatgtgcgtattccattaattaatttatggatattaaaccactcttgcattcctgggatgactccacatagtcatggtatataaaggaaagttttacatgctggaagatttcgtttgttaatattttgttaaggatttttactatgttcatgataaatattagtctgtagtgtccttttcttatgtatttgcttgactttggtatcagggtaatactggctatgtaatatttgttggaaagtgttcccttcttcactgtattttagacaagtttgtgtagcattggtaccatctcttccttaaatgtttgataaaatttcccagtgaagcatttggacctgtagtttttttattttttgtgggaatgttttaagcacaaatttgatttttcaaaaaaaaagtgcttctcaatttttcacatggctttggccaatttccataaccccaaaatggtggtttttgatagttttgtccagtttattagttttattttgctaagaggattttttgacttcacaccgccacacccagcagttgcctctctacctctttttaaaaaaaatctgtatagtatttcattttacaaacatgccataatttatttaataaaaatagttttttcacttttaaaatatagtctgagcagtgctgaagctaaccttcttctatatataactttacttacttttgctaataagatacgtgcatttttaattttaataaatgtcaaattattctccaaagtttgttgtcattaattatattgttagaataatctccaagaaggtccacttctgcatatattgccactaccatatacaggttaagcaaccctactctgaaactaaaatgcaccataattcaaaactttttgagtggcattgtgacgccacacatggatgtctaagatagtaacatttttgttttctgatgattcagtgtacataaactttgtttcatgcacaaaatcattaaaaatattgtataaaattaccttcaggctatgtgtgtaaggtatatatgaaacatatatgaattttgtgtttagacttgggtttcatcctcaagatatctcattatgttatatacaaatattccaaaatctgaaaaattctgaaatctgaaatgcttttgatcacaagcatttcaggtaagtaataacagcctgtagtattaatcttttatatttttgccaatatgaaaagcaaacagtttgatatctttttgtttgtacttatctaattggaggtgggaatcttctcatatgctctttgaccatttctttttattttatgaggtgactttttattcctttgcttaatttccaattatttttaattattattattatttttttttgagatggagtttcgctcttgttgcccaggctggagtacaatggcgtgatctcggctcactgtaacctccgtctcccaggttcaagcaattctcctgcctcagcctcctgagtagctgggattacaggcacacaccaccatgcctggctaattttcgtatttttagtagagacagggtttcactgtgttggccaggctggtcttgaactcctgaccttgtgatctacccacttcggcctcccaaagtgctgggattacaggtgtgagctgccatgcctggccttaatttccagttagtttggttctttttttcttatttataggatcttttgggattatagtgatactaaatttttatctgttttatgttgtaaagatttttttctattctgtcattccttccttctagttgtaactgttttcaatctttaaagaccctggtgttgtaatttatgtttttatttgtttttaaaacagaaagttgtacaagggattgatttaaaccaaattcgaggacttgggtttgatgccacgtgttctctggttgttttggataagcagtttcacccattaccagtcaaccaggaaggtaagaccatgtctcttccttttcccagtggtgggatacttggctgattaatccaatgggcccaggtggaacaggagggcaggcgtctcttgctgctgatagtaaaatttagaggtagagtgaagtgacacagatcatgttgcagaagtcaagagcttggagagcagttggtatgagtggggtggtgttgacgctggattagggggactaggctttctaaaactcaggagccacagtgcagagcttggtaaaggaaggatatgagattgttagctaggagtgattaaccttgaaacacacaggtggttttgatgttttctgagaagagagtgtcagtgcttgcagtttctttgtatacgatattcctattccgtgcttatctgagtggatgagccaagtcctttgaaaggaaatggaacatggtagacagggccatgtgacagatagaaggtagaagcagatggcctctctattttcagtagccagaccaaaagacattcacattaaatggtgttgtcctaatagacacttgtgagtacagaaatgagctgtttgaaatgtaaagtgctacttgggtccaccatcagagatttttcacagcagataaggttgtcccttttggggaattttagccaataacgtttgtactggggttacaaacccgaaagtctattaatatattaatgtaataattaatacattagtcagatgggtaatgtaaatgagtaataggccaggtttgagaaaaaccactgcacctgtgtgaagataaatttcaactgatatttaaccttgtaatgagcagatgacattagggagcagtggaggctgcattgcactggaaattgcatgctccatctgaagggaagggccagctctaggcattgtcagtcagctgttgccaagatagccattgcaaacatatttggggctagattctgttagagaacccttgattctgcacactgttgcagcagcatctttcttaactgttggctatgaggtagtagggtacattgatacacagtggaattagagttaggcggggactctgattgtagctctgctgttgctgagctgtgacaccttgggcaagccacttaactctgtgtttctcagttttcttctctgaaagaatttgaatgaatcagtagctttgctgtgagaatttagtgagagactgatacttaaaatgctcagaaaagtttcttccatcagatgatgaattttttaagttaagagaatattccggtcactactgtggacctaatgtatgaaatagtgattattataattataaggactataaatgatcatctatttgcatcccttttcactataagtgatcactataaataatcataatcactatgtgctgaaaatggatgcaaatagatgaatgattagagcacagtggtaatgatgaccattttctgcacagacacacacacttttttccctcttcttgcgacatttattaacacctcctgtgttccaagccctgtcttagcaaatgctggggcttcaaagataaatcaggacggttctttttcttggtggctgttcattggctcagttggcactgttctggcccaggacagggcagccttgttctgagccatttcagaaagcagagaccaaacctgggtagagcaaacctcagctctgcagcagcaagcattcactaattacaagatgtggccagccacagacctggccgttttgggaggctgtcagtatatcttttatgggctttatttaagtaaaggtcaggtgattgtttgggatgccatagatcagatgtctcttactgttgatagtgagatttagaggcagagtgtggaggctagaaatcaccgtcccagaagttaaaagcctggagagcaattggcacgagtggggtggtgttgggggcagagttagagggaacttggttccataaagcacaagagccatgttagagagcctgattttgggtggaactttagatactaagagtcctgtttcaaggattttgtatcatctgatctgctaaaatacatgtttacttatttatttttattctggctgtgcattagtatcaactggagatctttttaaaaattgccaattcatgagccctaccctcaggatttgtattcacttgacttgaggtggagctagggtgtcaactttttaaaaaagttttctcagtaagtctagtatgtagagaatcactggggacagattaacggagaattaaaatattaggaacagaacacttgaagtggaagaagacagttccttgttaaatttgcttaaatatgtaccctctttggatgctatttttctttcattgtaggtagaatggcttcctgttaacaaatcctctattaaaaaggtaactaggttatcactctaattataagtgttgaaataactttattccacctaaaaggttaaagtgtacccattcatcaaatgcatccagctgcaggtgccctcatcagtttcttgcctttcaacagattgtattaaggttagatcttttatctgaaatgaattatcctgtgcaagaaaatgaaattagaattataaaggtggtttgaaggttctttagagactcctacctgcatggcagcgaccaactcttgattggctaatgggagtaattgtgaggagcagagagtggggtcaggaagattccagataaccctaatcatgcagataacctaaaaccaaacccataagaccagcaaaagtattgccgtctttagatgttaaccaaaaaattataaacgaataaattaagtacaatagtttaagaaaattcagcattagtctatgataaaatagtctcatttgcctttccttgtttgactcttcttccttaaagatcagaacaacccctgggctggacagcagcacagttgctgaatgcttcctacccctgccactgaccaaactcagagccttaccctgattgtgtcatctcagccataggagctcttgggagggagaggaacaaagggtgataattggggctgggagagggagttatgacctagtctcctctgtgcaacagatacctaatgtttagatttttttgctgattcataatattttttcccctcaagtatgcctgcaacacattctgtgaacataaacatgtattttagcaaggtattaattaagtgaatatatggatgaataatctacccttaggtaaagtgaggtagctcaaatgtaactttacctccaattctcttaaacgacaacatttttgtgggtctgtgttctgtttcccatgctgccttattgtatagaacctctttctcactctttcctcacctgcctagccattggctagtcatttgaagaattaaataaacactttcctgccttttgaaagctttctgtgcagctccaggctcagctaactagagcctgctctttgctcctcctccacattcccatgtctggtactcttgttctggcagtcaacacacagtatagactctttctcctgcagacatatgttgcttaagggcagaactgtggcacattcttcttgatatcctagcatccaacactgtgcttggcatgtagtagatgctcaataaaagattaaatgaactttcagttttccataagagctgaaaaaaattaacttctcagtttttatctaaaacgaaaattattaattctaatacagtaatgattctgtacaattttcattgtattgttctgactgcattttgagagcatctttatgtagaggcagtagtagctgattggtctgtctttactataggcagaagtttagcaacaggtatttttaccttaaagtagctgtagatttgttctgtacagtacttaagaaacaatactgatattgtccccttcaacactcacccacccacacatacacccacatcctgattcattgatggttgtggaataggagctggacatcagtatttttaaaagttatcaaggcgacgctaatgtgcaactaggtttgagaactagagctttgagcacttctgttagatagaggaacaattctgtttacaaaaaattctttgacattcctgtggaaggtcccatgtactctgtattattttcaaagtattagtataatggtttgtggagcttttgtgggaggtgatatctttccagttaggcaactgagcccctgccttgttatgcccatgaccttatttaggtatcttcttacattggctttttttgttgtttttttttttggttttaattttaaacattcttttcaaagatgtggaagggtaaagaaagcaacatcttcctattcgcctaccactgaggataaacatgaaattttgccatatttgcctcagctccttttattttaaaaaaagatatttgtaacttcagcttttcacctcctgcaggtaaccattctgctgtagttgctgttcttaaacacattgtttttgtgcttttactacatatgtgtatacccacaacaacaaacagtatacaatccttcctctgtatctgaggggtacttgttccaggacctccttaagaccataacccacagatactcaagtccctgatgtaaaatggcatcgtatttgcgtataacctatgtacgtcttcccatgtacttcagataatctctaggttacttataatacctaatgttaggtaaatacttgttatactatattgtttagggaataatggcaagtaaaaaagtctgtacacattcagtacagatgcaaccatccatttaaaaaaatatattttcaatccacggttggttgaatccacagatgcagaactcacagacatggagggctgactctgtgttttaaagtatctcagctggtgtccttgttcatgttactatgtctaactctagtttattcatttaagaattgatttatctgttctctatgcagatctagttccaaaatacactttgtgcatttcccagctgtgagacattgggtacgtcttcactttcaagagtctgtcattgaaaaacaggggttaaaaacctgtatcagagggttgttttgaggattaaatgtgatgatatgtgtaaaatgtttagcacagggcttgggagacaaacacacattacaaacatttactattagcaagatatgtagtgctgcggttactttgccattaaataaaataatgtgtgaaaatataatacctggtttggtaactgctgggtttcttttctctttgccctaataatctctcgggtatattaattgctgttctgcaacttttgccatcagaggcatcagagggctgttaaaggatttctggcttgcccattggtacaggatgaattaacagaggctggggagagagataaggagttactgtgtggactacagggtggtaaggcaggatatgaggggcagtgctccttttccagctggttttaaattctcctccttatgattttctcctcctgagggcctactttctgagaagtacttgccatatcctttatgtgcattatcttttgtttaaaaacttcctgaattatacatcttcatctgtaactgtatcttcatctgtaactagcattccctgttagatctgcctaattccaaaacccatgagcttcccacgccagcaaacaagccaaccaaatgaggaaaaaaaaaaacacctacataaactaattttaattaaagtgaccagaaaaagtgggaatataagcagttaaatgccattgtttagctattagatgtattataccgtcaaagtatttatccatatttaaaggagacagatcttagaaagtattgtcttagtcttatttcatagacacctttcctgaatgtatgcccagaaaagtttttctagaacagaagggataagaaaggaagggaagaatttgagagagaatacttgataatataattaattggtagatgttttctgcttttaatgtagacatttattctaaggtcatggtcagagaacacatgactggacgggaaattccaggcctggggacagtgctttcctcagccttgctggtgtcctttcattttgcacactcttgatacataaaattatagaaagtacatagcattttgatcttgggaatccataattgttcccttgaattagaaggaagagaatgtgtgtccatctgcatctccctctcgtttctgctaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagaggtgagtgcatagggtctaagagaagataccaacaatagtagaggattcctgttactgtggacctgtaggtaccaggcaccctgctaaaatcggttatgtttgatttttcccagcaactaggaggaaggttgatcccattttattgattacagtgtagttaaatcacacctgtttttatgtgcctaactcatactaggcactgtgacaagtattgtacacattatctctttgaaggccaacgaccctatgaagtgtttgtgtgtggtgtttattttagggtgtctgttttgtagacaagaaaacgaatgttcatagagataaaacaactcactcaaagtgacaaagtaaatatgtgacagaaccagaatttgaacctaagactggctgactccaaaatcatttttttttaattttaaaatgtttcttttgtagagacttggtctcactattttggccaggctgatttcgaactcctggccttatgtgatcctgcaaaagtgatatgattataggtgtgaaccactgtgcccggccatccaaaatcaattctttttttttttttttttttttaagtatcaatttctcttttaatcttagacgtcgtggtggaaggaaaaatcagttagcaaagaagcaatctcagaaaaagtgtatctttttgatgcctttatgccttttttttcctctttttttttcggttattctttattattatactttaagttttagggtacatgtgcacaacgtgcaggttagttacatatgtatacgtgtgccatgttggtgtgctgcacccattaactcgtcatttaacattaggtatatcttctaatgctatccctcccccctccccccaccccacaacaggccccggtgtgtgatgttccccttcctgtgtccatgtgttctcattgttctattcccacctatgagtgagaacatgtggtgtttggttttttgtccttgtgatagtttgctgagaatgatggtttccagcttcatgcatgtccctacaaaggacgtgtgaactcatcattttttatggctgcatattattccatggtgtatatgtgccacattttcttaatccagtctatcattgttggacatttgggttggttccaagtctttgctgttgtgaatagtgccacaataaacatacatgtgcatgtgtctttatagtagcatggtactggtaccaaaacagatatatagaccagtggaacagaacagagccctcagaaataatgccacatatctacaactatctgatctttgacaaacctgagaaaaacaagaaatggggaaaggattccctatttaataaatggtgctgggaaaactggctagccatatggagaaaactgaaactggatcccttccttacaccttatacaaaaattaattcaagatggattaaagacttaaatgttagacctaaaaccataaaaaccctagaagaaaacctaggcagtaccattcaggacataggtatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaccccatcaacaactgggcaaaggatgtgaacaaaatcaattcttttaatacccagtattctattggagttcagagaggttaattaccgttccaatgagaaagcagccgaggtgggatttaagtccatatcttctgaccagagctttgctgttctgtacacttttagccccaacttattaatatttggccttgttgacatcttaggctttccctttctcatcccacctgcactcgagtttctcatccttaaatgatatggcaatctctggtcaaagcacttgcaggtggctcccatttccagatgttaggacttctttctgaagtgtggagaatggtgatgtcagcttaatggttcccattagagatggatgtgtgagaaagttcaagtcctttgggaatctcaaggacttgaaaacctctaggtggtctggagaagtagagaatccatctaatgagcatgacctgctgtgattcatttactggctctgagatttcaggtgggctgagtcttctattactcagattgtaaatggagatggggagagcttaggttgctgagagggtgcctaaggattgccatcacggggcaggagagtggtaggaaagaagggcttcagcaatcaaagcaggcttggctttttagctattttatatattgagctgttttgtaagttttaatctacataaaggcttctgtggttgctaagagtttgaaaacagagtttcttaggagtcaggagttttcaagaatctaattctgactctactgtcaacaattgtatgctttggtcaaagcacttcttatttcaggcctcactttcttcatgtataaagtgggagagttgtattaaccagtttgaaaacctgactcgggtatatactgaaacacaaaattggaatatagaactgttctgcgctgcccggtaccctgctttgagttgtataagcattagttgattttaatcctaatggtctgtgcctggtagatagcacaggaaactgatcctaaggaggttttcccaaacaggtgatagagccagaatttaaatccatgtctgctgggctccaaatctcagcttattccatcatgtcatgcagtagtaaaatccctctgtgaagcatggctcttggcgtaggaccaggaatgatggcagtggtcttcttcaatttggcctaaacttgttgctatatcaacaagtttggattggatatatcaccttttttggcaacacagaaagaaaagttatactgagttaagcaaagaggattgggcggagggtcattggttcagtgtcagggccttctagagcacttgccatgtggccagctccagcctatatcccaggagatctaaatgcatatctggcacgaacctctcaggattcttaccatctcgcacttgagataaaactgcactaaataaatcccataggaaatagttaaagtctagattacatggcagtgtttgtgaccctctgagaacatcttatattaatttattttaaaaaatcaattttctttcagaattttctgagtaagcctctagtgtggggtgtgttttggtaagcatgtacaggaattcttgctgagaattcctttggctttaacatgattgcaaaatcaaaattaaagagatttctaaagtcagttttagcatcttcttaaagcctgaccaggagggctatagtgcttctcagacttcaatgtgtaaatgaatcacctggagatcttaggttctgattcagtagctttgggatagggactgaaaatttgagattttgtatttctaactcaagttcacgggtgatgctaatattagtggcctgggaacttgtgaaaccacttttaattccaaaagctctgctcccctaccctgaaaagcatccacttttggggaatcagggaatggtacctttgtttttaatgctatgatgggagacacaggaaagtttgatagcttcagtagagctgctcaagtgcccgttcagtataaaagcatgagattctgtgttctaagttcatcaagctgtcatgtgtttactccttcttcattctttaattcttggaagtctgtactgagctcaactatgaaccagcaactgtgataggcactggggaactggggacaataaggactcaaccttaccattgagcagcacacagtccactagggatagtggtaggggagcataaggaatggggtggatgcaggagtgacatgaaaacagagccatcaaatgtactatgcactgtgatatagcaatatacaaagtgctttgggaaaaaggatttgcttcccagaggcaatagtttgacaggagcctcaagatatgagtagaggttttgcctagcagagaagataggaaagacattctgaagagagactgtggttcatctgtgttatggtaggtgagtcccagggcatgagctggggtgcttcagcaagcatagcaggagatgaggccaggtaaatagtctgagttcggcttattaagggcttatttggtgatagggattggttgatggttgttaagcaagggaggggctggcttaggtaactggcagacatgtggagattggattagggtgagaaaatgtgtgtgggggagtaagaactagagttttctcattcccctgatgatagcactctgatggctttgcattgctctgttagataaattccagaaactgaaacatggactagaaaatggtgcatgatgtcatttttacctcttcctctctcgtcactgtttgtcttttacatcctagctcactatatcccatctacaggaatccacttagagttttttgttacatgagtcttggctagaggttggcagactatggcacccaggccaaatctggcctactgcctgttattggatggcttgagaaaatgtaaatggttttacattttcaagtggttaagaaagaatcaaaaggatgatattttgtgacttatgaaaataatatgaaattaaaattttagtggccgtaagtaaagtttgattggaacacagccacactcatccatttatgtgttgtttatgtctgttttcacactacagtgacagctgagtagttgagacagagactatgtcgcctacagggcagaatatatatgtaccatctggaccaacagatgaaaagtttgccgacccctggtcttgacaatgctgagtctttcacctacagtgttcttccctctactcactgctggttcttcctcatcatttaggtttcagttttatttttgctctcttgaaaagcctttcctgatcctcaaatacatcagagtctcttgttattacactcttaattttacttcattatatctttcgtaaattgtaatgctacgtcaatttttgtggtgatttatataatgcttgctccaaccattgtaatctgcaggaggatagagatcatatccacctcgttctttgctatgtcttggtccttaaccaaatggctggtgcacagtaggtgctcagtacatattttctgaataatttgaatgactcaataactcaataaggggctgttacagtactccatgggagaactaatgagacctgaatgaggcactgtgagatggcaggagatgggtcctagaaatttttagaggataatatcaatagaacattgacactgattggctgtgaggagtgagtcagatggaggagccagagctgaccactcacttcgttattgctgtcatttatcttctccttgtccttagcctagagtcagatgtcagaggaagttgggcagaatttggggttttatctgtcttgagatgttctaggaccaccatagctcttgaacaaagtcacctggatcctagtcctgcaaatatggaatttaatcatgtccttttcatttaaagtttatgtgtttcaggttgacatttgtctccttaataagaattgtcagatgaaaggaaaaatgccatttgaatttttcataacccccagcagtctggcttttccatttggtctcaatgattctgactctcatcttaatgaaggccaaatgtaaattaagttctgtcaggcttgagcagctggggtctcctatctttataaacatgaaacattgtagggttaacaaggtgcagactgaggaaggtcaagagagttgctgagctgatgtggatcctgacagctcaatgttaatgggaggtaattaacgtggcttgtaggggctacatggagatcttccaagctgtcttttaactcatttcctcttttgccattgtcagcagagcagaaagctaatcattttatagtttgagatttttcttgcttattccaaagttctggaaccaactgtctggaatgtcacaggattttgttgatggattcaggaaatatacctgctgcttctctctcccctgtctgtgcccctgtgcttctgtcctcctgataacatactgggaaaatgaggaaatgattctccaattggtagattctttggggggaacctgggggtttggatggctagagaggtggtttgataacttcctgctagctgtggaagctgtcacttgagtgctttgcagtaggaactgctgaaaagaaaaccctgctgcaggtcagggaagcttggttcttctagttctttctgtaacttgagaggctggacgaagctaatttttaaaaccttatttggccttattttgtcactcttgttgatgacataataacaccttttctctatcttaaaccttagtctaatcttgaaacttcatgaaagatagacaatataagtttctttccttgaaatgccatcatttaaatagatggcagtatggtggaaactagtctttcttagttagttactgtctaattactattcaactgtgttcatcaggtcttaatagtagcactaatacaagatattgaggaactttgggagatataacacaaatctatacagaaaagtacaggatttggagccaaacttgcatttaaatttttctgtaccacttaccaattgtgggatcttggacaagctaaaatcaacttctctgagtctcagtgtgctgagctataaaatgaggacaatagtatcagtcttgtagagttatgagttagtgaggtatttgtaaagtggcttatatagtagatactcaaatggtactttattttcattatcattgtgtttaaaagtgcttgtttctactgatgggcatttcagtaacatcctatcactaactgagataattttaaagactaaaatatcctatttcatggggctggccataatgagtgatatgttttttcctgttttattaaggaaaattctagaaaccatcatcaaagtttctagagacaatcatagaaaatagagaatagaagagcacagaacatattttcagtcattcatttatttgaatcacccacatcctatgtgtaataccaattccaaaggcagccaacttcgagctgtaaagctgattaacttacttgagtaccttctacttgtttcccttgacatttaccagtgccgccagtctcagaatgtttttacttcacaagagttattttatttaatctttacagcagtctgtgggacagatattatctctttttatattaccagatgaggaaactgaagctcaaaaaagttaaataacttactcgtggtctcatactatgtaagcaaacccatgtcaagagccacaccattagctctgttccctcatctgctaccttatgggaacctgtgcactttcagtgtgggaatccagaagtggtctctgccaccaagaaattacagtctagttaaagaataaagatacagagcaaccaagcagtaagagcagaacaagaaaatagatgaaaataagagctaaagcgtatgtagtgcttgttaatacatctggtacttttctaagcattttacccatgataattcatttatttctcacagctaccctataattattgtatttttcttttcttttcttttttttgagagggtcttgctctgtcacccaggttggagtacagtagcacagtcttggctcattggaacctttgcctcccaggcttgagcggctctcccaccccagcctcctgagtaactgggactacaggcacacaccaccatgcccagataatttgtgtatttttttgtagagatgaggttttaccatgttgcccaggctggtctcaaactcctgagttcaagtgatccacccacctcggcctcccagagtgctgggattacaggtgtgagccactgtgcccagcctaattattgtcttttacagatgaggaaacaggcacagagactttaagcaacttgcccaaggtcactcagctaataagtggcaaggctgggatttgaactttggcatttcacatccagagtacgggcttatcaccattttgctctactgcctctttcagcgtttgctttgcaggctttgcataaactagtttagggaagaaatttgtgggtgatggcttcgggaggatctgaggctgtgaacaatggtcagtagcttcattgtttcatttaagaaatactgagtgtctcctgtgtgagaggcactttgctgggcgctggagatgccaaggtgaatgagtgggataagggccctggggtaggcttctgggaacttagagtctagtgtagagaggcagaaaatagacacacacaaagtaattttgttttctggaaaatgctacgaaggaaaaacacagatgaacagatttggcatagcgagtgtgggcctctcttgggagtttttgtttgacctgaatgatgagataggaaggaggagcaacagattcactgtgggggaggaaagcacctcatgagatcagcaaaggaggtcagctgggccaggagggtatgagcaaggcacagaggcgtaggagggggtttggcgaagtgggcaaaggctgctgcatgcagccttgaggccaggggcaggagtttgagttttattccaagatcagtgggaaatggttgatgggctttaaacatgggtgtgacacagtatgttttatgaccttaaaaaaatcattctggcatatgtgctaggtagatagtaaatatttgtatagcaacaacaaacttcatactgttttttttttattattatactttaagttttagggtacatgtgcacaacgtgcaggtttgttacatactgtaatgttaaagggaagaaaagttagaagactaatgaacagtcttataaatacatttgtttaaagaaactatcagtatggaaaaaaagactggccatatacacacaagaaaacattaatactggtacactgttcatggttggaagagtttgctactgttttagcacaatgctcatgcttttattacttagtaattttccattcaaagcttgtagtcatagctaacctttctggttgacaacacttcattattgagcaagggattttttttttttctttttgggcttattttcctaaaaagcaacatgctagggacttcacaggcagaattttatctctgccctttagtgacacagtgtaacagcatgctgttttactgtatctgtgtggcagtatgaggaaaccaagactcagaggacttaagtagcatccccaaagctacacaatagtaggttgtagagcccagattctcacctagtccagtctgcctccagctcctgggatctaactattgcctctcactgcctgcttttaaagggcactcatttcttcccacttgccagggctacaggctggcagaccactggctgaatctggtccccaatcaggtttagtttgacctaccatgtgcttggaaaaaaaaaataaacaattttaaattagtttccaatatttaaaaattgagaaattttatctgaaaattcagattatttattttcctgaataaataatgaaagaacttggcaatacagggtccacacttccatgcagaagggaacggctggagctgaataggggctgccttctttagaaggggtcggcattcttcattttgcagcagtcctcacccagcctgctacactcatttcctttttcagccctacccctctgagcacttgaatttgagacttaggctgtgggaatttgttcaaggaatctgtcattacttttcctctagcaagcgcttagagaaatggaaaggcattccagatggcgaatttcttggtccagggctctcatgattccatgcctgtattctctcacacctctgggtctttgctcaggtttttccttctgcctggcaaacttatagtaatttcttccttcaccaggaaaacttataataatagttcaaaacccagccttcactgcctccaggaagccttccttgacttagggtcctacactctgtcccctgtggcattctatgcttatctctaccctagaatttattgcattacattgtgctgtatttatctcagtgtccctagcctccagagcaatgtttaaattctaacattaataacttattatatattttgatgggtggatgaatgagcggatgaacttattaaatcatctcatgccatttttgatggctaggtgcatttgtccaatcatttcattccaaactaaaggttcactgtatgcccaacataagttaattttctcttcctcattgtggaaaatgagatttgagcattactgttcctttccatcctagagccaccccttggctgcagtcctgttaccggagtcacagcttattttgtatgcaaagtgaaggctctagactgagacagtaactcctctgggcctctccactgtgtctttggactcctgtgatggataccactttaagttgctcccttcaccccccaggagaatccaagactcatcttctcaatcagaaagactttctttagaatgtttataccagggccctgtatattggaccagattcctcccagcctttgaggaatgaagacagtattgtcagctgctgttagggcatgtgttgtggattttctctccagggtgggtactggacttgtaactaaatacacagaatgttgaggctgatggcttgccttcatctacctggacagtgaatcctttccttattatcctgtatttgcatatttgatttataccaaatatgtgttgcattcttttagttttatagtccagcaaagtaatttttaaaaggcagacaaaagaaaaaaagttgttggccagataccttgtaacatttaataaatgtcagctattattataatactttaaaaaattttactttatggctatggcagactttcataaatatttcctttatatgatctatgacatgaccttgtgggataaatattactacttctcacattttacagatgaatacaagcctcaaagaaatgaaatgacttctctacaggtatcaaatcttggtgaaggtcctttgggcttaaactggagccaaatgaagtcccttggatcttaatgaaggtccttttggctttaaattctggtatatgtgtgtgtgtgtgttattctgctgtaccatgtttcttcctcatttgggttggtggattttcagctccataaaagcagggaccaaatctatcttttcataccttactgttttatatccccagagccaaacacagtgtttggcattgaaaaaatactcaataaacatttactaaatgaattcatgtcccctggccagccaggagctagccatgtgactgtagtgctgaagaccacatgcctggcttacctgttgccagtcttcctgacggctgtgcagggatgttggccacctctaggagtcattagtgtaaccagagaggtacgaggaaggattgtgaagttaggcttgctttatgtacacatggtatgattctgtgtcgatcaaaaattgaacaaaattcttttctcatagtggctaaaatggaagtcacacttactggaggaaaatacgatctttatagaaacaacactgaaaaggacaatgcatttaatgtgtgttgtgatacagtaactcatagcgtgtaaactgtcaacttggaaatctagaggctcagggtcaatggatgtccactgatgcaaggaaggtggcaggctagaagtccaaaaaggtgcaaaatggtattcttttggaggagtaagtaaatctcatttctctgaacacctgggctgttttactttcttttttcctattatccaaagtgaccataattgttctgttattgtagggatatattcatttaatcagtgaaagaaacttttgtctggtaactactaggtacaaagtactgtgcttggtgatggggaggaaaggaggaagccaagctcaccctttatctcaaggaattcccatatctagtaccaagagcgagaggctgtgaaagccattacccgccctgccacccccccgccatgttttattatcaaaatttcaaacatataaaaaagttgaaaaacttttacagtgaatactcagagccatcacctagagcctgccatggacatttactgtccttgctttatgacttatgttgtttccatctgtctgttcctctactcagcttacatttttggaataagttgggagattgttacacttgggaaggcagtttgaaatattaaaagttgtttacatttctgaaatattaaataagttttagttaagatattgactttgttttattgctatctacatacatggccaacacctgtactagactttattaaatatccactgtgtgctttcaaatcttctatcccatttattcttatgaaaatcctgtgaggtagatgttatcacttgctttgcagatgaagaaattgaggatggagggagttaagtagattgccacttatcaactttattacctctggcaacgttggaatgcaaacccaggtttctgactctaagaaatgaatttgaaaaattattgtaaaggttagctggtcaaacaccagcctttatcacacaggtacccctgtctacagataagacatcattggagcttacctaagtaaagcaaagcaagcaattagaaaatgagagctctcttattttgctgattaattattcattattttcttaataatgactttatttttctatcatttttagtattattacttcactttgattagagaaagcaacttctgatggtttaagttaaaaatcccagataacacatttgtttggcataaatttttaaggtaaatatgaactctagaataaaacgttatcaaagttattaaaagtttagctgttcaaagttagactcaaaatgaaagaatcatacttgagactgggtgagatctgtttcccaccactatgcaaactctgacccagggcctcttttgtttgtattccagcacattatagttacctctccaagagctgactttgtcctcttctttgcattcccctgaggtatttgtagtgagaaagaatgactaaatgatggaatgagttcattacctcttctgaacccaggggtcttggaagtgctgacacagctaagacctccctggaggcttgtctgttcatccagaatggccactctggattcctataaaggctcctgtctctctgaatcctccctgtatggagaggctatggattagataaacttcagagtgtttagtaataaaaacaagcttgatctcaactctgtggccctgtcaatacccatacctgcaccctcttgaaaagctacatcagtgtagcttctaggcttgtaatctgaatgatcagtgtcttttggctcaaaaatgcaaagtgaaggaatattcagaggaaattagagagctgcctaagtggctctatcctacctggcctccgtttctcattatggctttgctaaagggtctgaaccgtggcatggacgtacattttttctcagtaacgccacatgtgtagagtattgatgcttacccaagcaaagcaaaacaagcaattaggaaatacagtctctctctcattttaccgattaattattcataattttattgataataagaactttatttttctatcattgttattattattattattattattattatttcaccactgattagtgaaaattattggtcctggactatcaccagtccctgttctggcatttgggaacaactggtgcgtgtaagccctgaaactctccttcgtgctggcattctgtgaacctgagagagatgagaagagaaccagggactagagtgaagcctactgcagttgtcttggcatgaggctgtgtggcttggctttggctgggagtcacagacaagcccacggacctgagaaagagagtgaatcactgtacaagtatttatcgagcacctcccatgtcctgggaagcagtagctggagagtggtgaaggagtactgagttttggggttcaagtggccagggctttcccccaggctttttacctattatctgcattatctgggcaattcagttcacttatgggccttagttttctgtctaaaaaattgtgttgatatactattatgtatcagaaggtatttgataaattgcagaatgctggtggtattgatagattttcagatgatagtgacagaaaaagttgattgttggaaagaaaattagtgaggtctatttttcatatacttacctttagaggcaggtaagaaatctaagagtgaagggaaatggaattcacattgtttgaagggtaggaaattttaaaaatagtgctttttaatcgtccggaagacttggggagagggtattattcctgtttgagtgggtgggaacagtctgagagacacttacctcatgcagctactgagtgggtagagctggggcccagctcagatctaactccagcctgtgctgtttctacagcagctcagaaaccaaagttcaggggagcagaggagctggagacagtgaatccatcctgaggcccccctgagtaaatgcttccagggcaattccacttgcactattattaataccttacagggtgtccttcacaaatttctcagaatgatggctgtaaaaatgggtgtgtgttttagaaataaaaatattgtggtgctaacaagttcctgccggagttgttcaaggacgttcattcattcagcaaatatttattgaaaatttgttttgttccagacactttgttaaatattgggaatatagcagtaaggaaaacagagtcactattcccaggatgctcatattctagaaaggagataagagataaagtcacagtacagcattagtgcagtgggaacttgggttactctagaaatacagcccagttaggatcgaggggctcggggaggtaatatgtaggttgtgggccagtggatgaattggaattgggtaataagcagttgaggtgaggcagtttgtaaaagctagtctggtggcagtctgaggaaatgagacctccgtggggctgcaaatgcagtatagtgagagcttagactgcaagaagctctgtgaatccgtcaaaagttcctttaagtcccttttatatattccatgctattaattacaggattctttgcaggggtgaagggggacctcatgggatggagccagttcaccctagccacaatcagagaaaggtcagaagctatttgtgacatttttcccgactcttctatctcaaagacctggacctgagaactccggagaagatgagctttgagcactcacgtcctcactgggcagacagagcagctctcctcatttcagttgtctcaagactagacagtgtgcctgagaataaagcagtgaattaaccccacttgtccaagagggtgggactgaatactagacagggccctttccgcctctcttgggtggtggggggtggcgtgtgactcagaggcagtgacatcagccatgacttcattcatccacaggaaagacagtgtgcagaccgcgaacacggctgatttctgccctcccttctcgatgctttgtcttgctggggacattgtcatggtcctgctgttatttcccacacattttattcacgtctcatgtttaagctgttctttttcttcaccccattctttttggtctctttgttcatcttttgcttttgtctttattttcttctttctcctatttaatttttcttgtttcattttctttcctgtacttcttctcttttgtctccattttccattctttccatttgctctgtcctttctcttccctctgtgtcagaaatgtatacaggaacacatcctcctgcctcctatttcttctctcctctgggcttcccactaggttattgctgtcctaacattcctaaaactgtgttcacaaaacactctccacacaaggactgatggtggctcccattcttttctgactcaagtatctaatacaagtccagatttacctcttactgcatctcaacacaggtctctcagactgagcttctcatagttccttctccatggccatggatgctgctgatgcttctgcctgcacttttactcaggccattgcctcagtgtggactgacctccatcccatcttcctcagtctttgccttccctctagacacatatctgacattgcctcctaagtaacccccttacttacctccttcccacagcactgtctccttcatgatcatacagaatccatagtttataaattatgtattttagaacttgaattattctgtactatttatacattcttcctgcatgtttcatatgcatagattctttgttccacctagccagtaactaacctgaggataggaagtatattcctgcctttcatcttctatgagcatacctagcacatagttggccacaaaccaggactgacagaccatttttttgcaaagtcaagaaatattttacttgaaaaatagttatttgatgctaattctggggagatagatgaatgaattatagttctttcctaaaaaaagagctaagggtctagtagaagagacagacccacacgtaatttgagaagaacaaggattgtggaggaaactaatgtttactaggagtgtacaagaatgggcacatgaacatgtataatctcactgaattgaattcggctaacaatcctatgagttaaatgttgctaccaatgaacaaagtgagactcatagacattaggtgactactagtcagaaataacaccactaataagtaggagaaccaacatttggactaaggtttgtccgactctaaagcccctactctttcctgaagagggaaggatgtagtgaaagtgacattctaagtaataataagaacaatcgtaggtaaaaagtgcttactatgtgccaggtgctgtaaacagattacctatatttgttcatttgatcccccatcaaccctatggcataggcactattattgtcctcagtaatttttataggatgaggaaattgagatgaagagtagttgagtagattgctcaaggccacatagctacagagtactagagccaggatattcactcttgcattctggctctggagaagaggcagcagaatgtagtgaggccctctacatagagtagcatattgcatgatcagaactgctgttggaccagtctgtttggagaatcagggactgtggagatgctgacaggtgaaggtgttgagaggtgaggctaaagaggcagccaggaatcatcacaaaggaccagtgccctcctcaaggacccgtgacaaaacatgcaattttcctagaaatattttctgtgaggttggaccgttagggatccatcataaggaagagtttaagttgtggtcttattctactacttgagttgtgaaggaacttttgagttgtggcctttgtccatgcccagcgggaaatcacagtggaactctgcaacagtggtgtaaatgaacaagtaaggatgcacatacccaaatagactccaaagaaatgccagttgaaacagtaaagtacgcctgtcctttacgggttggagatgattaagtttgggttgaaggacatttgggaagaaagaagaagggacatctgtgtgagccagcttggaacagatgccaggttatcctcaggtgtcccagagcgctcaacatttgatggagcactctccccactgcagcccccctctccattggtacttggcagcaattcagtggtgctgcactgacctgggagtccaagccaggaagtgaatgaatccattttccaattaaaatgaaacttctccaaaggacctgctaaccctgagagaagaaatttatcttcctggcagtctggcttgcctagaatatgtctctgctcctgaaacagactgagaaaagccattagcttgaatgaaaaaagagaaactgggacagttcttattcacaacctcattcatttatccattcattccttttatttctgcagactttaatttggcttccacatgtctgctcattcattcatttattcattcattagctaacatgactcatcatctatagatcagacaaactgctgtgtcctaggagtagagatatttaataaaaaacatagctcttgcctttgaggagctttcagtctagtgagagagacagacaaatgaacagatgatgggaaatgcagtgatagggatattcatagagtactataggggcatagcataagagcatctgactcagcatagggatgtcatgggtgatttcatggagtaggaaacaccagagttgagtcctaaatgtgtacacacatagacatatacatgctattgcttctgtttctctgaagaactctaatacagggtgatgaggtgggcacctcttcatgaattaattgggagttgaaattagaatggtggttgaatgtaaggaatgagagaagaggtagaagatgactcctttggtagaggtagaagatgactcctttggtaactggatcaactggcactggaaatcaaggaggaggaacacacttgggggaagatagcagattctgtcttggacgtgttgagttggaggtacagtgggacatccaggagacatgtctcagaggagagtttgaattggagtttcagatttggcacgttattcagcgtgtagttggttggaatcacaggagtgattgatatttctcagagagcatgggaacagtgaaaagaacatttggatgaggtaagatccctggggagcagctaaagaaaagagcagctaaagaaaaggagcccatgaaggagacagaaaagcactgatgagaagggcgtgagaaggtcccggagagtgagaggttgaggaagacttcctcatttctcccctggtcccagtctttgactttctttcatgtctgctccaagacctgttcaccctttccaaagccttctcttcctattaggactgtctccctctctcccatagatggtaccacccacaaggcatggcttgatccaggtcactgtggcatctctctcatctcctccagtaagaaatgcacttctgcattatattatgttttagagaggcagatgactgaactcaaacattgggctgggcattagcgatgcaaaatttggtctgactttccatttacccgttgtgtgggacctggggatagtcttggtcccttcctgggctttaggttcataatctgcaagcatagttttctgactccttgccttgcctgccttgaagaattatacaggtcagatgagatcatgcatgtcaaagtgctttgaaaactgtgaaactctgtagcagaagagtgaatcttgttgacttatcaggcactttatattatttcatttaattctcacagcatccttgggggaagatgctaggaatgtggctttgaggaaactggggcttaaagaaattaatttacctaaagctacacagctgttaagtggtgaggacggcaatcaaaatcaggtatgccagactccagagttcttagaccccatctacttcagccttgttttcctaatacgtacagtggtgtcacactcctgggtaaagtcagctttgctgagtatgatgagttttcattaaaatgatagcatattttatggttgggaaatcaactctagtgtggattataagtttttcttttcgtacaagaagagcaaagcccttcagggggaggaaagtaggggaaagggatgcatataaatccagtttttgaaaattaaataaactatacagtggaattatttcattttacaaataaattctatgatgttaccgttaaacaagtcctcatctaatgggggtaatgcgtcttgtctattcaggtttttgtttcttgggtctttctcggcagtgacataaatatttattccacttgatgtttaggcctctgcttgcatctctccccggaagcctttagaaaagcctttagaaaagcctccccaggtcccaaaccctttccccgctctgagccctgtctgtgattactcattagaggcagatatatggccacacacaaaatattacaataatgttatgaggctgactcatcaaaccttggtatcaggcttattacgttattgtcatatatcatcttattaattatctcttcctttgtgtacatctttctctcgaaaggacctggctttagattttcttatatctcccaaaactctgcattttttttttcatgagttagacttggctcttgcccttcagaagtttgtcatttcaaggtagatttaggtatatcaatgaataattagggtacagcatgggatggagaggttcacagaaaaggtgacatctgagctggatttgaatcaagggcagaggtttgataaagggagaagatgggaaagtcaattcaagtagagataccagctgtaacagaggactggaaatatgaaagtgtaatgcatttgggaaagtaaaagaggtgagaaccaaatggagggtgttaggagatgagcccagaaagtcatcatcataatgatcacagccaagttggagccaggttaagagtcctgagagccagactacagagttaaaatgggattctaggccatgaggagatgtcgcaccatctttaataaaggaatggaatgggaagctttatgtttttagaaagatgcctctagtagtgcagacctctcagcttatctgcctatctgacttgaaatatttctgatgttctgtctctgtgcatgggagtttgaaacacacaattattttattcattctgagaagtttctggctgaggtttatgacctactccatgcttccagcgtcatatttcttttaagaatgacattgaagattacgtctcttcctgaaactcttttctctctgggctattggcctgtgccctaatttggagtcttgaacatagagtgaggataaggtctagctctttcttgggtagttgtgctggaaaacaacagcatgagtacttggaatgtacaggcagtactatttattgagtggggaattagggagctgttccctcccttttgtttactgctcacagcagataacccagatagaatccctttgcaattacacagtagattacttggataatcctttgtaactggtcatgcctatcttctcatgttgcccctcgaccctggtgtcactgcagtagctgcctcatttccctcacgagttccctaggtgtctagaagcagcagaaacctcacagcttccctggagtgggagggaaagggtgaaagctacttctctctgtcctgaggctggcagggcggctgcagccttgaatcttggacatactgccctacctccgccctctgcttagacccacagctgtgtgagctttgagtagtagcctcctcccaacaaatgctgtggtttgatgaagtaataattttttcttttttttaaaaaaagctgttctctttggttgctttaagctgagggattgcttaactcaaaggattgttgttggaatgcagaaggcttttgtgccaagtcatataacccaaatcacttttctttttttcttgaaaagactagtttttgttagttgcctggtaactggaggatagaaagacttaactcattcagcacagagagctcctagtttgaactctattaggccatcacctaatgagatacatctgaaattggtgtgtgtcgagggcctgctccttgcactctctaatccgtgcaacattgtgcatgggagatgataagtacataggagttacatgagctgtccaggattgaaattgtacggaaatgtgcttagaagggcttttgtttgtcttttcttctgtaaagagtggcaatagcttccattatgacatttccaaaaggcccaaaatcacacctctgattggactgggaggttcagggtggtaactgtggcatagtggaaggaaagaacatttactttagagctggaagccctgtgactttgggctaagcccttgtggtctgacccccagttccttaatgtgtgagtattgtgtattacctacacgcctctgcatcactctgtagattaaatgagaacactgttgtaaactgtggaggacttagaggacgatcactgtgtcctaatgcaggcccagtggttacaagtagagaattaattcagtaagattgaggcctttggctgggattgtatgggccagagaggaggagggacagagagatttttctgcagaactagactaaaaatccatctatgggggtaatgtgctgttggccaatatggcatttgatgacaaagcacttgtgaatcaggtagcctaatataaaaaactgcatgtggctgggcatggtggctcacgcctgtaataccagcactttgggaggccgaagtgggtggatcacaaggtcaggagttcacgaccagcctggccaacatagtgaagccctgtctcggggaggagccaagatggctgaacaggaacagctccggtctacagctcccagtgtgagcaacgcagaagacgggtgatttctgcatttccatctgaggtactaggttcatctcactagggagtgccagacagtgggcgcaggtcagtgggtgcagcgcactgtgcgcaagccgaagcagggcgaggcattgcctcactcggaaagcgcaaggggtcagggagttccctttcctagtcaaagaaaggggtgacagacggcacctggaaaatcgggtcactcccacccgatactgcgcttttccgacgggcttaaaaaacggcgcaccaggagattatatcctgcacatggctcggagggtcgtacgcccacggagtctcgctgattgctagcacagcagtctgagatcaaactgcaaggcggcagcgaggctgggggaggagcgcccgccattgcccaggcttgcttaggtaaacagagcagcctggaagctcaactgggtggagcccaccacagctcaaggaggcctgcctgcctctgtaggctccacctctgggggcagggcacagacaaacaaaaagacagcagtaacctctgcagacttaaatgtccctctctgacagctttgaagagagcagtggttctcccagcacgcagctggagatctgagaaggggcagactgcctcctcaagtgggtccctgacccctgacccccgagcagcctaactgggaggcaccccccagtaggggcagactgacacctcacacggccggatactcctctgagacaaaactcccagaagaatgatcagacagcagcattcacggttcacgaaaaacgactgttctgcagacaccgctgctgatacccaggcaaacagggtctggagtggacgtctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcccctctcctcctccaaaggatcgcagttcctcaccagcaatggaacaaagctggatggagaatgactttgacgagttgagagaagaaggcttcagaagatgaaactactccgagctactggaggaaattcaaaccaaaggcaaagaagttaaaaactttgaaaaaaatctagatgaatgtataactagaataaccaatacagagaagtgcttaaaggagctgatggagctgaaagccaaggctcgagaaccacgtgaagaatgcagaagcctcaggagacgatgcgatcacctggaagaaagcgatggaagatgaaatgaatgaaatgaagcgagaagggaagtttagagaaaaaagaataaaaagaaacaaacaaagcctccaagaaatatgggactatgtggaaagaccaaatctacgtctgattggtgtacctgaaagtgacggggagaatggaaccaaactgaaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcaggttacccacaaagggaagcccatcagactaacagcggatctcttggcagaaactctacaagccagaagagagtgggggccaatattcaacattcttaaagaaaagaattttcaacccagaatttcatatccagccaaattaagcttcataagtgaaggagaaataaaatactttacagacaagcaaatgctgagagattttgtcaccaccaggtcggacctaaaatagctcctgaaggaagcactaaacatggaaaggcacaactggtaccagccactgcaaaatcatggcaaaatgtaaagaccatcgagactaggaagaaactgcatcaactaacgagcaaaatcaccagctaacatcataatgacaggatcaaattcacacataacaatattaactttaaatgtaaatggactaagtgctccaattaaaagacacagactggcaagttggataaagagtcaagacccatcagtgtgttgtattcaggaaacccatctcacatgcagagacacacataggctcaaaataacaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaggaagagctaactctcctaaatatatatgcacccaatacaggaacacccagattcataaagcaagtccttagagaactacaaagagacttagactcccacacattaataatgggagactttaacaccccactgtcaacattagacagatcaacgagacagaaagtcaacaaggatacccaggaattgaactcagctctgcaacaagcagacctaatagacatccacagaactctccaccccaaatcaacagaatatacattttttttcagcaccgcaccacacctattccaaaattgaccacatggttggaagtaaggctctcctcagcaaatgtaaaagaacagaaattataacaaactgtctctcagaccacagtgcaatcaaactagaactcaggattaagaaactcactcaaaactgctcaactacatggaaactgaacaacctgctcctgaatgactactgggtacataacgaaatgaaggcagaaataaagatgttctttgaaaccaatgagaacacagacacaacataccagaatctctgggacacgttcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcgagaaataactaagatcagagcagaactgaaggcgataaatcgagacacaaaaaacccttcaaaaagttaatgaatccaggagctggttttttgaaaggatcaacaaaattgatagaccgttagcaagactaataaagaaaaaaagaagaatcaaatagacgcaattaaaaatgataaagggaatatcaccaccgatcccacagaaatacaaactaccatcagagaatactacaaacacctctacgcaaataaactagaaaatctagaagaaatggataaattacttgacacatacactctcccaagactaaaccaggaagaagttgaatctctgaatagactaataacaggctctgaaattgtggcaataattaatagcttaccaaccaaaaagagtccaggaccagatggattcacagccgaattctaccagaggtacaaggaggagctggtaccattccttctgaaactattccaatcaatagaaaaagagggaatcctccctaactcattttatgaggccagtatcatcctgataccaaagcctggcagagacacaattaaaaaagagaattttagaccaatatccttgatgaacattgatgcaaaaatcctcaataaaatactggcaaactgaatccagcaccacatcaaaaagcttatccaccatgatcaagtggccgtcatccctgggatgtaaggctggtccaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagctaatatcacactgaatgggcaaaaactggaagcattccatttgaaaactggcacaagacagggatgccctctctcaccactcccattcaacatagtgttggaagttctggccagggcaattaggcaggagaaggaaagaatgggtattcaattaggaaaagaggaagtcaaattgtccctgtttgcagacgacatgattgtgtatctagaaaaccccattgtctcagcccaaaatccccttaagctgataagcaacttcagcaaagtctcaggatacaaaatcaatgtacaaaaatcacaagcattcttatacaccaataacagacaaacagccaaatcatgagtgaactcccattcacaattgcttcaaagagaataaaatacctaggaatccagcttacaagggacatgaaggacctcttcaaggagaactacaaaccactgctcaaggaaattaaagaggatataaacaaatggaagaacattccatgctcatggataggaagaatcaatatcgtgaaaatggccatactgcccaaggtaatttatagattcagtgccatccccatcaagctaccaatgactttcttcacagaattggaaaaaactactttaaagttcatatggaaccaaaaaagagcccgcatccccaagtcaatcctaagccaaaagaacaaagctggaggcatcacgctacctgacttcaaactatactacaagtctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccaggagaaagctgaaactggatcccttccttacaccctatacaaaaattaattcaagatggattaaagacttaaacgttagacctaaaaccataaaaaccctagaagaaacccaggcaataccattcaggacataggcatgggcaaggacttcatgtctaaaacaccaaaagcaatggcaacaaaagccagaattgacaaatgggatctcattaaactaaagagcttctgcacagcaaaagaaactaccatcagagtgaacaggcaacccacaaaatggcagaaaattttcacaacctactcatctgacaaagggctaatatccagaatctacaatgaactcaaacaaatttacaagaaaaaaacaagcaaccccatcaaaaagtgggtgcaggacatgaacagacacttctcaaaagaagacatttatgcagccagaaaccacatgaaaaaatgctcaccatcactggccatcagagaaatgcaaatcaaaaccacaatgagatatcatctcacaccagttagaatggtgatctttaaaaagtcaggaaacaacaggtgctggagaggatgtggagaaataggaacacttttacactgttgttgggactgtaaactagttgaaccattgtggaagtcagtgtggcgattcctcagggatctagaactagaaataccatttgacccagccatcccattactgggtatatacccaaaggactataaatcatgctgctataaagacacatgcacacgtatgtttattgcggcactgttcacaataggaaagacttggaaccaacccaaatgtccaacaatgatagactggattaagaaaatgtggcacatatacaccatggaatactatgcagccataaaaatgttgagttcacatcatgtcctttgtaggggcatggatgaaattggaaatcatcattctcagtaaactatcgcaagaacaaaaaaccaaacaccgcatattctcactcataggtgggaattgaacaatgggaacacatggtcacaggaaggggaacatcacactctggggactgttgtggggtggggggaggggggaggggggagggatagcattgtgagatatacctaatgctagatgacgagttagtgggtgcagcgcaccagcatgtcacatgtatacacaggtaactaacctgcacattgtgcacatgtaccctaaaacttaaagtataataataataaaaaaaaatccacctagttttcatcaaaaaaaaaaaaaatggcagggtgtggtggcatgcacctgtgttcccagctactcgggaggctgaggcaggagaatctcttgaacccggggtgcagaggttgcagtgagctgagatcgcaccactacactccagcctggcgatagagtgagactccatctcaaaaaagaaaaaaaaaaaaaaaaaagaaacaaacaaaaaaaaactgcatgggatcctcacagatgcctgctggcatctcaaggtaagggatcaggcttctggagacatttcctctcattcagtccttattcctctttgctggcctatctccagacttttcttttgtagagaaagcagggaatattgctatcttcccttctgagaccatgtgcatacttaagagtacctcagacttcccacaacatgttatttctagttgctcatcccacaaatatttgttgaattactagacaaactgctcagcttcatcttccagttcctgttatgtgaggagtacttcagaggttatagagggcttccacatgtgttatctccttagagaggagaggttggactgggatctccagctttgattggtgacggttagtgtggtctcaaaaagaaagaacgcagggactccttgctcctcctattcccagtgtctctttttggcaaaaggcttgagttctttgtgacattctacttgggttctgttgtcccacagtggctggctgtgtggctacaggctaaaagctgtcgttatataatgtctttaatgaccacacacaagatctaaagtagtttttttttttttttttttttgcctgaatttaagaagattgttgtgctttggcttgaagcactggttgttgctgcggtggtttggcggttcatatctggtcactggcctttgatttctggaacctttagaaagaggctgccttttctcctctccctgaccactgattgctgaaaccacaagacatatggaaatagatttcagggactagccaaaagccattctggtagtttgattcacatcgtctcaaaggctaccattttctgactgtggcttgttagatcctatacagagatactactagttcttagctgtgttaggaatatttagtatctttaagttttgcttgatttaacattaacatcttagaatgggcgttcaaagagaagtttagggcaggtccctttctagacacaagctttcacctagatgtttaggaagttaaaacaacaacagtaacagagaatcagcttgatactttgccttttagatctgaactcttttgatattgttttgatagggccagcacttgggatagtaccgtttatctgctgtaaatagatgttggtgtttatatagtagtgttagggaagcactatgtaggaggaactcacagaattctgataaaggccagttgtatataaaatagatataataatacccaggacttttgtgttgctctaaggagataacacatgtggaagccctttataaactgaagcacccctcacataagaggaattggaaggtgaagctgagcagtttgtctagtaattcaacaaatatttattgagttcctactgtgtgttaccctgcggcaggtactgaaatatgcctcttttggaacttctgcattgttgcctttaggttcccagagatactcctatgcttataattccttttatagctttttggagagggagtaatagaaaccaggacatggaaagttatctggatggtaggaaacctttcttgctagttcctctgtcttctttactattctgtttttgaaattctacctcttcaggtgtttgacagaaaatggccacttcatgcttttcaagtttatctcacctccagttccattcataggcagaagtgaaatggttccatttgggtcctgattctaagttcttgggagaagaaatctggttggtacaactaggtcacatgcctaaacctggtccaaccaagtgcttgtagtaaggggatgagagttaagtagtttctgcttggcagctgagggtcctctcagttggggtggagaagaggagacaatcatccaatgtcatggtgaacatgactgacaagatccttgacctcacagagcttatagtcagtctgtcaggaaagaaagacttttgtattagtctggtcttacactgctaataaaaacatacccgagactgggtaatttataaaggaaagagatttaattgactcacagttcagcatggctggggaggcctcaggaaacttacaatcatggtggaaggagaagcaaacacatccttctgtatttggtggcaggagagagaagtgcagagtgaaagcaggggaagccccttataaaaccatgagatcttgtgagaactcactcgctatcatgagaacagcatggaggtaaccactcccatgattcaattacctcctacagggtacctcctatgacacttggggattatgggaactacgattcaagatgagatttgagtgaagacacagccaaaccatatcaacattacacaaatgattgtgggggtggtatgggttgtatgacaactagacctaaactaacaatatgacttaccggctttgatttccaggagatcctggaaaccccctcaaggaatggtggtgtgtagggttaaccaaatgaggaaggggatgatgttgatcctgggagggcacagggtggtgggtgaggaatgaatgttttaggcagaagtggcaaagtaaagaaaatgcccagcagtaagaaaaagcctggccattttgcaatacagagaaccaaatctttaaaatgtacaatggcttgcttatgtggccattctctttgacttagactggaagttctttgagggcagggactatcatcttttttctattgcctttgtaaccagttggcatgtggagaattttatatggcaggggacatttagtttcattgggcagtttctgagtacagcttctttccagcttatatctgctctgaaatcttatatgtccatcaccattcactgggaaaatggattgcataccttacagactgtgcttttgatatggtttggctgtgtccccacccaaatttcatcttcaattgtagctcccataattctctcatgttgtgggagggacctggtgggagataattgaatcatgagggcagttttccccatgctgttctcgtggtagtgagtaagtctcacaagatctgatggttttataagaggttttccctttctctgggctctcatttctctctgtggtctgctgccacgattgtgaggcctccccagccacgcgaaactgtgagtccattaaacctatttttctttaaaattacccagtctcgggtatgtctttatcagcagtgtgaaaatggactaacacagctttctatccttccaggttggcaaagagggttttaagggaaattacgatcatttttggaaggatcaagcattgtcagtttttctttcctgtataagtactgcttttatattattcctacccccaccaagctcctgaacagatgtttcaatgggcattgttggctatgcttttgttttgaaaaatttgaaacattattgaaagaggagatggtagaaaaaccccctaattgattctaatatatatttaatttggcagaacttgagagagatttgctgggataaggcgggacatttctttgatctcccggacttcttatcgtggaaggcaacaggtgtcacagcacggtatgttaattacaagttggattgtgtttgcgttcttccattcttggatgtctgtctatatattgctttcttaactctctttgactggatatacttttggtacatctgcatgtgattttgcatacatgaaacatcttgaatctatcttcgacctccactgcacatgcccaaacactgttgttcctaagagccctggaatgtgagtatccaaggtgaagaccattcattaaaattggtcatatttgaaggagatatgaaaaatccagagtgaaatgtggatttttccaaaggcactttttacatgatgaataaaaggaaaaaataaacacacacacacacacacacacacacacacagagtcacgcattccttaaggacagggatacattcagagaatgtgttgttaggcaatttcattattgttgcaaacatcatagagtatactttcacaaatctagatagtgtattctactacatacctaggctgtatggtatagcctattgctgcttggctacaaacctgtagagcatgttactgtactgaatactgtaggccattgtgcacagtggtacttatttgtatatctaaacatagaaaagatatcataaaaatacaatgtaaaagataaaaagtagtatactcatatagggcacttacaatgaatgaaacttgcaggactagaagtttctctgggtgagtcagtgagtgagtggtgattgaatgcagaggcctaggatattactgtacacttctatagactttataaacactgtacctgtaagctacactaaatttattttaaaaatttgtttaataattatcctttgcttactgtaacattttttacttcataaacttttaaactttttgacttttttgtaataacacttatcttaaaacacaaacacattatacagctgtacaaaaatattttctttgtattcttattcaatatgcttttttctttttttttcattatactttaagttctagggtacatgtgcacaacctgcaggtttgttaattatgtatacatgtgccatgttggtgtgctgcacccattaactcgtcatttacatgaggtatatctcctaatgctatcccccgcctccccaccccacaacaggccccagtgtgtgatgttccccttcctgtgtccatgtgttctcattgttcaattcccacctatgagtgagaacatgcagtgtctggttttttgtccttgcgatagattgctgagaatgatggtttccagcttcatccgtgtccctccaaaggacatgaactcatcctttcttatggctgcatagtattccatggtgtatatgtgccacattttcttaatccagtctatcattcatggacatttgggttgattccaagtctttgctattgtgaatagtgccacaataaacatacatgtgcatgtgtctttatagcagcatgatttataatcctttgggtatatacccagtaatggaatggctgggtcaaatggtatttctagttctagatccctgaggaatcgccacactgacttccacaatggttgaactagtttacagtcccaccaacagtgtaaaagtgttcccatttctccacatcctctccggcacctgttgtttcctgactttttaaagatcgccatcctaactggtgtgagatgatatctcattgtggttttgatttgcatttctctgatggccagtgatgatgagcattttttcatgtgtcttctggctgcataaatgtcttcttttgagaagtgtctgttcatatcctttgccccctttttgatggggttgtgtttttcttgtaaatttgtttgagttctttgtagattctggatattagtcctttgtcagatgagtagattgcaaaaattttctcccattctgtaagttgcctgttcactctgatggtagtttcttttgctgtccagaagctctttagtttaatgagatcccatttgtcaattttggcttttgttgccattgcttttggtgttttagacatgaagtccttgcccatgcctatgtcctgaatggtattgcctggctttcttctagggtttttatggttttagttctaacatgtaagtctttaatccatcttgaattaatttttgtatagggtgtaaggaaggaatccagtttcagctttctccatatggctagccagttttcccagcaccatttattaaatagggaatcctttccccatttcttgtttttctcaggtttgtcaaagatcagatggttgtagatatgtggcattatttctgagggctctgttcttttccattggtctatatctctgttttggtaccagtaccatgctgttttggttactgtagccttgtaatatagtttgaagtcaggtaacgtgatgcctccagctttgttcttttggcttaggattgtcttggcaatgtgggctcgttttcggttccatgtgaactttaaagtagtttttttccaattctgtgaagaaagtcattggtagcttgatggggatggcattgaatctataaattaccttgggcggtatggccattttcacaatattgattcaataagcttttttctattaacttttttttcactttttaaacttttctgttaaaagctgagatacaaacatacacattatccaaggcctacacagggtcaggatcatcaagatgtcactaggtgataggaatttttcagctccattaatatcttatgggaccactgtcatatatgcagtctgttattgactggaatgtcattgtgtgatgtataactcgtgtgtgtgtgtgtgtgtgtgtgtgtgtgtgtgtgtgtgtgtatattttggcctctaatattaactaggagatacatttttcaaggaagctgattcagctggatggatgtgttatgtacttgtttgctttttatgtaaatgtacctcagttatcccatactgtagaagtatatatgttgaagtcaacaactatttttcagtaagttatgaatgttaaaaatagagcatatgctacacaatagagacttgtataaaatactcattgagtgtgaaattgtggctactataattaacagagtgagtgtatgtgtggggttacatagacaggttggacatgaaatctttaagtatgacgagcctcttgtcatgatgacctcagatttaaggagatgcctaaggtcaaggcaggtcttctcatcttgaaaaagatttagaatctgggttgaacaaacctgtgaagaagggaatcatttcccagaggatagataaacctctagtaattagggaggcaggtattgtatcttaaaatcagcttattcagagaggggtcagatcttaccctctttccttcttgtttgaattcaagggaagcgggaaatagcagtaccatttctcctatctcattcttttttgtagtgagttgatagggtgtgataattcagcagcgggggcttccagcagggagacagcagagaacatttcagaagcatgtcattcttaatgtcagcaaccccgaacctccttgcggtgaaacaatcattagccaaaggtcctggggcagagagatgcatatgcttgtgaaaatggcctctgcaaacctcaggtacatgccatctctggcaggaggtccctggaggagtgttctcaactttaccctggaaggtgtaattagtcaccattatggttatcatcagtggggagggcagtgtgtaggtgaggatatcatcttgggcattcctcttttggtgtgatgttaattgttcaaagttatttctgagagaatctttctctaggttttttcatcattgtacatccgtgaaagaaatgttttgatcattttggccaaatggtcttgtttgttagtcaagcagtgctagttgtcatgtgtatgggcaataccccattggcctgcaaatccagaggactcaaagctggaacaagagatggaggagaacgtggctttccttctctttttctttgacattttactcagcactttgactgcctccctgattctttctgatggctctgggtattctgtgtcccatttcctggtttccggtgccatattcaggcaccaaggagagggctttttgaagttagctgtggctcagataaagtgtggtggcatgcatacacacggtggactaacaatatgacttaccggctttgattttgccacactagttgtgtgaccttgggcaagtctcttcccttctttgattgtcactctttttgtctatagcatggagattgttatacctattttgcaaagttcttgtgagaatcctattaaagcaatttttccaaattagttggagtataggaattacctgaatgatttgttcaaaacatgtatccccaggtcttctagttttcagcctaatgaatcagaatctccatgggagatgtgggaatttgtatgttaacaagtgcctaggtagtatatgatcaggtaactttggacaacactgcctaacagaatatacatgaaggtaggatgtgacactgagtgagagattggaagtgttttaaaggcctaatgaattttttgaatttaaaagttgtaaacaaaaaataaaattctaaggccccccgccatctgaatggaccccttctcttggccaaaggcattccaaatttaacctgaaaaaccagttcaggccatgatgggaagggtgtgggtaagacattcccccttatacagtcctcccttttggaattcaggacaagccaaccaatactaacatcaacaaaccttaagtctcataagaaatgtttacagtctattctctctgaagcctgctaagtggaggcttcatctgcatattaaaaccttggtctccacaactccttatcctaacccagacattcttttctattgataataacactttcaaccaattgtcaatcagaaaatttttaaatctacctacgatctggaagcccctgctttgagttttctcacccatccggatcaaatcagtattaaccttacatgtattgattgatgtctcgtgtctccctaaaatgtatagaagcaagctgtgccccgaccaccttgagcacttgccatcaggacctcttgaggctgtgtcacgggtgcgtccttaaccttgggaaaataaactttctaaattgattgagatttgtctcagatacttttgggttcacaaagtggagggcgtcttgttaacttatcagaacatgcttgggggcttctagccttgcctttgacaatctcaaaccttgaggaagcagaaagtttaatgctcagaaatgatttattggctgtctaatcatccctgccatttttattggctgtgacactcatgactcattctattttcattagtataaattaatcatcccgttcccccacccaccccgtacttgtgagcaccttcagagacctcccttcccatttccctctcttccagagagcaaagcctgtggaccttgggtaccaggttcctcttgcaaaggtggttgccctttcccttggcccacttacagcttgcatctgtgtttctctctcttatttactcaatatttctgccttctctatttctacttgcatatcaaggtgaaacaaggaacccctctgagcttccttgattgtagatggaaataatgacaacacctgctccatggggttattgtagagaaagcttctaacacaatgctgagaaagctttttaaaggtattagcgatttcatttagttccctttctctatcagttttggcaatgagtctttacattaagcatagaggaaagagggaaatccttgtggtcagactgatctggtttcagtgtctccatcatgtgcagtctgtaagaacctggagcaaattatttacctccctgagccttatttcctcatccataagccctctcagggctattaaaacagttctctgggtaaaacctctgtttttacacaataaagggttcttttaataaaaaaaatccacattgtctgttctcttttctagagtaaggaagatgagggtctgaatttgaatatgccaattccaaaaaaactttgggtaataaaacaccaacttggcatcctctgggccaaggagagattgaaatttggtgtttatttggctcttacatgtgattattttgggaggctttggggaaaatgattgccaaaaaggctagagggtcttttttaaaaatacgttttagtagagtcaagactaacaagtgatcgaatttcaccctgtcttaaagctttcaaacttgtttttggcaatgacagtgtgtaagaacacctcctcccctttctctcttccttctccattttcctctcctctctttcaggttttgtttttgtttttttacccattctccccttttattgttctcatcctccgaaatatggcagctacttttctttatctgggtcactgagaaaatcaccatttggcccatgattagtttgtaattcagctccattctttttcttatattaatgaaaataattattgctatttttgttaataataataatggtaattatcacttattgagtgcctttcctttatctgtgctaggcatatttagcaaatgttaactctgttagtcctcatgaccatccttacagcaggtggtgtcattaccgctttgcaattcaagaactgaagcagaatgctttagtaatttgccacattcttgctattaagtgggttactgtctacaattttgatgacatgagaaatgggaagtcaaacatttgaatagtaggaattttttagtagtcagaaaaatatatgtataaattctccctctaaagagatttgaggtgactaataataataatataagaaaaagtcgtacaaaatagaaaaaaatcagaatggagtgaaaataatgataagataactgagctgaagctaagagctttagagaacctttagagaattcataattactaataactttgtttccaagcttcctagtggccaaagcaaagacagagcttaatcaagattaactgagtgaacagataaaaactttactgctgttcaagggaagtagaactttttctaacattgggagtctgagagaaattaatcctagatgatcaagggtagacaatataaattatttaaaagtatgtgctattaaatttagttataattttgaacaaaattttaattttaaaatagttttaggattatagaaaaattgtgaagacgctacagaattcccatatacttgatgtccagtttctcccattaatatattattatgatacatttgtcataattaatggactgatattgatatattatcattaataaaattccatactttattccgatttttttagtttttacctaatggcctttttaccatgttacatttagtcacgccttctcaggctcttcttggctgtgatagtttctgcgtctttctttctttttgatacccttgacagttttgaagtgtattggtcatgtatattgttggatgtccctccattgaaatttgtctgatgttttctcatggtgagacttgggtagtttgtttttcggaggaagaccatagagataaaatacctttctcaacctatcaagcgaacacactcttatcacaacttaacactattgatgttcaacttgatcacctggctgagatattgtcaggtttctccactctaaattactcttccaccccccaccccccaccatattgtactttttggaaggaagtcactatgcacagcccacacataaggagtggggagtagttatgcttcattttcttgagactgtagtatctacatatattactttgaattattctttatgggagatttgtcttgtctcagttcaccttttttatggctttgaactaaaataaattatttacaaggcttcttatgtacaaacaagagacactgtaagtaagtttggtttactggttaaatgttagaatttctgagacatttctgtggcatatgcgaaaacggttgaatttctataattttaggtttattatttcttatatttctttatattaaatttacatattctacttactcattttacttttcctctcccctccattataatgtataattctgtatgggttattagtaaatattctaccttttcctttaaagagatgaattcatggcttttagaaactgaagtctctttaaaataattattacgtttctgatgtgtgtggttctctgtgttttgggtttataagggatattattgtattgttattcatcttgtgggtttttaccagtctgtcaggagatgattatgttgggttattgatctgtagtcattttctaaatacaattcataggatctcaaatacaaaaccattatttagactcttattctactgatttttcttttgttaaaaaattggaaatatgctttgtacaacttatttttttacttaatatgttgtatttttcatattaatgtataaaaatatttttgacatctgtatagtatcctatcctatgtcagtatcaattttgtcaagggtttgggcttgaaatgggatcttattttaatttgcatttttgattattgaatgcaattaatttttcttatatttatcaaccacttatttatgtatgtcattgtcaattactaattatgacaattagtgttatatatttcaatgatgtttatgtcaattgctaatatttgtattgggagttcagtgttttcttcaattttggtgagaatttaaaaaaaaatttttttgcagtataatttccagaaaaatttaaacctacagaaaacttgagagaatggcatattgaacacccttataccttttacctacgttaatcagttgctaacattttattacttttgtgctctttagtgcacaccttacctacctctgacacacagacctgtaattattttgctgaaccatttgtaaataaattgcagacctcacagtattctccacctgatcagccaatactaacaacattttcctttataaccacaacatcattatcacacttaaggcaattaaaattaatcctcatactcccttacaggtatccctgctgttaaggattcagagggccactcactctttcttgctattggagttctgactgatagagactacattaaaacatattagctaaatgaggagtgaaaagttgtcttattatctcagaaaatactctttagcctctagtgtatagaacttctaatatactagatggataatacagctcagaagtgcagttaaaccccgtctgcatgttcaggtatgtgtacatacataggagttggggcaggaaggaagacccgatttgccaaccctatctcaagtctagcagcttagcaatatgaatccagacctgcttgggtatgattaccacatggcagtgggaagccatgctggtcacacttgggcataggaggtgaaagtgtgagctcattattatcaccttttctttaacacagtgacccttaaaatgtggcttaatctattccagtctcttaatgattacatgaatttcccttaccgtcttggagaaaattgagtaagaggatggggtgcaaagtcaactctgtgtctctggtgcttctctgagtggagagaggaggtcgggtggaagtctcattctccccagagagcagaggcagcagcaggagaagaagggagaaacttgcaccttaatacgtgcctgcctgtggtgactacagtccacatcccttccttggtacttggcctcttcatctcctgtctcattagtatatctgagataagagttgatttttttagaaaacatctttagatgtatatagtatacataattacatataattcacatactatatgattcactaatttaaagtatactattcaatgatttttgcagattacattacttatttttattaattttaataatacatatagcataaaatttgccattttaattatttttaggtatataattcagtgtcatgaattacattcctcatggtgtgcagtcattaccactatctatttctaaaacttatttatcaccccaaacggaagctgctactattaaataataactccccatttccctctttacctatcccctcttttttttagacagggtcttgctctgtcgcccaggccggagtgcagtgtcgtaattttggctcactgcaacctctgcctccagggttcaagcgattctcctgccttagcctactgagtagctgggactacaggtgtgtgccaccacacctgactaatttttgtatttttagtagagacagggtttcaccatattggttaggcaggtcttgaactcctgaccttgtgatccgcccacggctgagtgaacagataaaaactttactatttttatccctccctctcccctcttaaactctaatctactttatgtctgctatgaatttgcctattccagataccccatttaagtagacttatatagtatttatccttttgcgtctggcatatttcacttaacataatgttttcaaggtgtgtctatgctggagcatgtgtcagcctttcttttttatgactgaataatcacatcctattgtgtgcatatactacattttgcttgtccattcatcttgtccaaatggacctgttggtggacatttgcatcgtttctaccttttggctattgtcaatgatgctgtggcgaacattggtatataagtatctttgggtctctgcttttagttctttttggtgtatatctaaggagtgaaattactggttccatagggtcattctaagtttagcttggtgaggaaccaccagatgtttccactatggctgctccattttacattcccaccagaaatatatgaaagttctaattcctccacatcctccccagctcttatttccctctcctttaaaaaaattatacccattgtagtagatataaagtagtctcttattgtggtttaagaattgattttttaaaatactagaaatctgtgggatgaaagtaaaattgattgaatttatatcatcctagaagtaactttttttggcaaggataccccagggagtgtcataaaattaaaaattaaaggtgtctgagagtaaggggagaagcacagttacttctgatgtgcttgatgctaaagctccttgatttgcattgttttatggttgtgttgaaggatgatttctcagaacagtggtatttaaagcagctcttctaagttctaggaaggattcagtcatcctctctcaccagcttattttttagtatatttaatagtgctgagaaataaccagtaaatattagatattctttacccttatttttgagaaagaagagtgttttcactctctacagaagaaatatccttatctcttcactaatgatagtagaaataataggcatttcaaaataacagttacttaaacacataagggctcattctttcctgtgaataaatatagatatatggagtcttgggctactgtgatttccccataaagtcatcaaggacactagcttttttgatgttttttagtcctgagttctattttcaagatcacctcatggtccaagatggcggttgaagtttccattatcaagtccacagtccatgtagcaggaagaaggaagtgggtgtggtgcatacaaaggatgtgcctcacattggagtgagccttctttaaacaatcttcttagaagatctacgtcatacttgtgcttgtatattattgaccagcagctaggtttataatcaaactgaggtgaaggggaatcggggcagtgtaggcttttatctgggtgtcttcctatccaaatattggggttttcttactaaataaaaagggagaattgatatggggtgggtaaaaagacactcaaaatcataatttctcagcaatttacattgaccagtatcacagacaccaatttatagtccaatgatagtcacaaggtaaagggagaaggtggtgatcatgagggagatagtatataatctgagcaatgtaactcacaagtttcattattcattaatacattcattcattcacttattccttacatatatattagtaaagcatctgtgaggcattctctccctaatccagtaattgataggtacacatgtatttgactattcaaacccgtataagagccaaataatccttagttcaaagttttgctctgccacttttaagataaatccgaactcagttaaatagcttgtggatggggtgaggaagagggaccatttagaaacctagtaaacctgtggttcgatgacctttttctccacctcctccctggcttgggatttgattttggctacctgtggagagagtcatccactgaggggtctcagagacattgtgggggtgaagaaatgggtaggtgcccaggagatttcaggccagcccaacctgagttcagaggcttaaagtccagggagggcgagagaggatgaagcatgctgggtcagtcgggctggaggcagtgggggagtcggagggagtaggaggaagtaggaggtgctaacatcatgagaagcatgagttaaggcacaggttctcagggactgtgccttgcacttgtactcacttgttacatcactgactgtccctctctgctacattgaggcaaagtctgaggaaggttgaggttgcttctttctcttttcattagtaaagcaaatctggatagaaaagggtgagaagccccatctttgtcctttggaggaaagggtaaaactgtgtgacctcgacgattatgatgtgcactcttcactgagaaccactagtctgaatctgttccatttctataaagctttttccccagttctctgctgtgtacgtctagatgtggattttatgtggctgaaagatgatctctagcatgactgtcattttccaactgagcagcagtatagcttttcctttactgaacaattttctctgagaccttgaatcacttttggaatttaatttcatttgctttttcaatatgataaagtagaactctctctgaatttgattcctcacttacaaatagatatgatactatattctctgttgaaaatgttttggaactgtgaagatgctagagagttagatctcgtgtttcagggaacagaactgaaactcagaagggtttcattctgagggtgaagccagtgtgtggaataagagttaaattttaaggggtacattcctggatcatgccttgttcaggagtctttttcctgacccaagaaggcctccctcaggatacagtgggcatctcagtctttgtgaactcttaaattcatttcttacccagggtggctaactctgtcagtggactattttgtgaacttcatactttcggaatatgttatacttatgtgattcttggtagtctcaagaaccttggtagaggttcaaatcagtcaatctggttaaaggtatcagtattcagtcttggaatcaagtggcactagagctcttaaggcttggcggttttcaggacctacatcacaagatacagaagtggtgtggcttggagctcgtaagactcgtgtctggtccaaccaggtaacttggggcccctggcacccatatcagacttttctcatctgcaaaatgtgctgcttggagtgggtgatttatttagtacttcccaggcccaaagttctgagtctgtaagatgtagtggggttgaccagcatctccttttggattctcctttaaaactcattcctttgaaaggagattgctaaagtcaaaccttagaatccaaccctttgggctatgatttaatgttaaaatgctgtaccctttcctttcctcctttttctcctttactacttctattttgtttctttttcgaaaaaatataccttcttttaaaatttttcttcatttttccttcttctctgtaaattatcaagggcctttgaagagaattcttacatgttattaagaaattgcagtcagggagccctctgttcccagatcatttagaagattgcttttccttttgttaaatacaaaaaattgtcaacctgtattgttaaaatgtgccaaaaactgcattcaccaataaaaaatgtcagctctcattattgcccagatattattcttttcaaaagcggagcactcttgccaggctttctaaacaatcttcagctcattcatcttcctggttttgttacattttgaacctctctgggtctatataaggtggcagcctgtcttttaaaaattaatggattccaaatgccattcaaacctatttccgcccttaacctcctcctcttctccccaaccctgcctgttaggagtcttatgttctgtataaatattgagctggagatagtttctaaagaggtgtttggacctttaattaacattgacagcctgtctgcttaggattttgctctgctgtctccatggaaaagtcaggtaggtcagtatgtgggggagggacctctgcagtggatgtgttcctggcggctggccctagagacactgcactctgagccaaccgtgaagtcattttgaatttaaggagtcttgctaatccaaggcaatgtgtcttaatttgacaaagtaaaggctgcccgataagcaagcctcactacaagttctgtgaaacagggggtgtttgtaagtttagattgtgctagagaaatgtggtgatgtggaagaacgggctcattttctcctgtttactccctttcccaccccatccccctcctctctcccttctctcttacttactttggcccaaatcagccctgcagtctggcctctgcagtggcttgatgtgaaatttgagaaacatatgtagttttctatttcaggaaaatgatctcagggattgaatgtgtttttttgttggctgttaagctctgatcttgcccagtgtggttttttgatgatgggaaagaggcttcgaagtgctttttatcagaatttcatgtaataaaacttaaggtttggtttctttattttggcccccaaccccctcccaggctcaggacacaatgtcgtctattctgtcagaagtgggaagaagtacacattgttcatattacaatcacttctttgctgcttgcacacacatatataagaatggccactgtgtctatccttcacaaaagctattttaaatgtagttcagtggaggaccaaaggtctgcgtagtgtctcttacaaaggaaaagggatctgttgggggaaaagtctgcctttgttttgccttggaagggccagtatttttctttgttctagaggtgagtgccaataatgggcctagtgccctatcaagcaaacttcattaatccagccctgcaaagggtacactgatcagataaaagggacctacatcctcaaagctcaaggtatttgtttttaaacttttttcttactgtaaataaatatcactattgtacttaatctcatattcataattgtattccttttcttaaagagcctttacataaaagcttcaggccctacaaaatccgagagcatccttcatggaggaaggatagtagactcgagggtgagtggttgaactttggctctggtgtaaaatgcccaccctgggacttattgtgtgaccttgagcacgttacataccatttctgcacttcattgtcttatttatatttcatgggcttgttgcgggattgaacaggttcaagtgtataaagctcatagtacaacctgctaaggactcaacattagctattcctgctgctgtttttattatttgttgctggcgtataagacctaggcaaatggagctaaatactattgtctaccattaaaatattcaccttctggagggaatagtgcaagggtaacttcagatttgcattgaaaaacccatggactatcactttacatatttatttccttaccatcttcaacccttatccagacagctccaaatgcacattattcagaaaattggtgatattttcacagcactgagactaagctcatctcctgctggtccttatcactcaccagcctttcagccacatcagacatctcctcaatctctgggcaaaccaggccttttcatgtcttcttgactttgcacgtactgtttcctccccgcagagtatcatttgcccttttttctgcttgtcaactgctattcacccttcgagacccaacttaaatattatttgtgaattttgggcagttacacagactcttttgggcagttacacactactgtttcatttttcctatagttcttcaagaacttctctcattgtagtgtaattatttcttgacatacatttttcttctaacagcctaggaggtctttggatgaagatactacagtctattcacttttataaccccggtacagagtgcatgacacgtgttaggtgttgagaaatctgagaaatcgactgggaagagttttttttcataccattatattttaaaagctgcaatagtttgttccagaaaagttatatttttcccttggtgtatattctaatttaaaaggtgtttttaatgcctgattgatctccaatctgtaatgactttgtagcattttctttgtttccctgcattcagccttctgatttaagcagataatgcttggaaacacctgtttaagttgtatcttctttgctagttgtaacttcatgagtacagggaccatatatgttctgttcacagctctatccccaagtcctaatacagtggttggcagttctagaggtagaagaaattataataataatagtgcttgtattttatgcttaacagagcacttaacatgctggccactattgtgagtattttagatacattaaccccttcagtcctcccaatattcttatgttatatgtattataattatcatctgttttctacagataaagaaacagactcaaaagaggctaaggaacttgccggtggtcacacaatgattggcagagttgggattttaacctgggcagtctggctccagaattcaggctgtttgccataatggttccttgcctctgattagtactaattagcttagtacttgtttgttaactaattattaaaggaatccaacagagacctatttctctaatgtaaagagttcattcattaggcaaataatcaccctaagccagttgttctggaagtatggccttcagaccagcagcatgagcagcgtcacttggaaatacattggaaatgcaaattctgtggcctcactcccaccctactcaatcagaaactcttgggagtgggaccaaataatttgtgttttaaaaaaatcctccagaagaatctgatggatgctaaagtttgagaaccactggccaagactcagccattttctctggaattttacccctgatttttgcttttcttaagaagtcataattttgggtgtctcacttttgcatactcctgatttttgtgacattaatgtggggactaagctctaacctcagtgaatgtttttgctaaagtttctgagaaattttgaaggtttcaggtgtgtctgtagcttgacagtgtttgtttcttttgatttttttttcctgtgatagcttttaggatcaggaaatttaaaaaatatagtacctcctccattcagccctgctgtctcagactcccctaactggtgagtgaagaaggagcccagaggtgcagggataacagagaaaggggaagtagcagaatcagtgagtggggaatcaaagtttgatgttatcgcacttcctagaagtggcctcaggtcctttggactgttggtttacaaatggtagaaaaaagggacactggacttcaaactggacttggaatcccagttcagtctctctatctatgtgattctaggaaagtaatttttctgagcaacagttccctcatctttaaaatggggataatattactaatgttttaatgatgtgagaatttatggagatgcatgatgagcactcaattcatgcttgttgtatctatactgaaggaagctgtaagagatagagttagtcactagcatatttaccagtgagtgttctaagaaatggattatagattttgcagagcaacaaggaatccacagcattccacaatggctggtattccaaggatcgaaattctgggaggttcagttgcagagaaaactaggcaccagtttgaatgcattatgtcttgagtctgctttttttttttttttaaaagaaaggtatctaaaagtgatttaacaatgtcaggatttagacttaagtttttttctgttaaagaggccattgctgaaagtcaagacccaaggactgtacaaatattgatgcaactgtcagagatacatggtatttgaccttctattaataaagacaaattattgcatttctgtgatatttgagtctgcaggaacttcccttaattccactggtattccattccacggctaccagggctgctgggacaagggacgtggcgttgtgtttctgatttacgaggtggaatattagtctgatttactaaactgaaagagcaggttcagataacaaacaacatagtgaaacttcctgaataacagccacagaaacaactcatgtatttggtggtatcacaacaagtttggctagatttatccacagactagaatacaaaccatggaggaaagaaagcaggtaagcacaagtaaatagagggcaaggcagatactagtggactatactggatgtaggaagactttgaggaaggcttttttttgcagacatctgcagggtgtaggcagtgaagtgtttgttgtgactatttgccagcaccatcccacttcacaggtgggtgggtggttccttttcaccaagattttaatggcaggttgtgccccataaaagggcggggcagtataccctgtattagtttaaaaaaggtctcagcttacacgggacagcatttttactttttacccttgcctttgctcattcacagggagtacttcggaatcagcccatctaagcctcagacttcaaagggagctcattcctatttgacaacagtcatatccattttgccaactctttgacctttgaaatagcatctactcagtcaggtctgacctgtcaactgtctgtaaaaacccatccagatcaagaacttgatattttcaagaacacatctaaaggatgggggcccttctaattttgtttctccaggacttgttttgggagaagccagctgcttcttctggtcttaatgggatgggattatagatgggttgagtctgtgaggcctcaacttacatgatgatcctgtgtccttttattataggttgcacatgttttagccactcatggcagcatttttctccagctacagtcaattttgtctaattattgttgatcatgattttactgtaaaaaaaaatttttttttttgagacatggtttcactcagtcagtctggattgtgcagtggcacagtctcagtgcactgcaacctctgcttcccaggctcaatcgattttcctgcctcagtctcctgagtagctgggactacaggtgcacgccaccacgcctggctaatttttgtatttttagtagagatggtgtttcaccatattggccaggctggtcttgaactcctaacctcaaatgatccacctgcctcagccttccaaagttctggtattacaggcatgagccaccatgcccaggttgtaaaagtatttttaaaaagtgttttcagaggccatttgccatgggaaaatgggatatgttgaccttcctgtttacctccatttgtgggcttttggttgtgagcatcagttcatatccagttttggggaccactcttgggtatactttaaataattcagatgttgaaatttttcagaatgagaaaatctagagagaagtccagtttgattatactagaacctcatttgctgattaaattgtaaaattcctaattgcaacttggtcatgtctttgcaaaatagtaataataatattaacttctatttatatagtgactgtcttctcaaagaactcaaaacagtgtccttttctgtatccctgctattcccaaaacatgtttgtggcaatgtatgtggcttcaaaatgtggatgtatcattatgaaatataaatgcatgtggtgatggtatttattagaatcatatgttattggaagtacctaacattgggtgtaaaggaagcctggtcaagtttccaatagagatttacaattgggcctctttgtatctcagtttcttcatctgtatagtgggcataatagttcctattttatagagttattgtgatgattgtgttaatacatttaaagcattgacacagtaatgctgggatagtcctcaaatgctattgtttgcatcggttttagaatcagtctaataaatatgagtttaaatacccctttgtcccttgcttgttgtgtcgtcttgggcaataacagtaacagtcaacacagatgctatttattgaataatacttatatgtcaggcattatattaggcccaggatataagtgattatttatcacttattcctttaactttcttaaataggtatgattatactcattttatagatgagttaggtaaggtttagagaagttaagaaactttcccatagtaacagagttagattactggcaaagcggactctctgaattcttgtttttggttacctacttaggttcccctgaaccacagtttcatcatttgtaatagggatgacaatagctctttgtaaggattaaatattgtacataaagtatctagcacttactgtgcattcttgacatgatatacaatgatattatcctctccaattagagctttccatataatataatttttttctttgtgttccttatgccatgcatatatctttagagattaaaagacacttcttaagaatggattcttgcatttctgagaacttcagaatcacacttgtgatctgacacagtatatatacactcaggtattgatgtgtgtatgtgtactttccattctgttcagtctagaagtgtatagatgctcaatctgggtgctttgtaaggaacatcacaaatgttcaaaatcgtggatggacttgaacatgaaaatgccttggcctcaaagttttgcttttctgttctcaaagttgttgaggaaactggcttagttaaagctaagtgtttagaaaccaagtgtgttttggatggtaaggtggagtcagcattatatatattaatacatttttggtaccagaaacagcaacaatcccttagtctggtgtgtgcagatgtaatatgtttcatgatatttcagcctgtattttctgtcttaataagtgaaagcactgcagaattgggctgcaggccactgccccatttctctccttttgtagtcagatctcccttgtgaatgataaacacccactcctttcatttattcacccattcactcaacctcctacaatctaagctgcatgcttaccacctaccttaaagaacaccagtgattgcttattgtgacttacgtcataaatatgtattctagacatgacttctcacctgaatatcagtgtcacatccttcatagcctcaaaactttgaggaaatatcctcttatggcatactttaaaatttgtaattttaaagtaagcacaaagtacgttttgagaccttcatttttttctctaacaattctgttttgttttttttttttgtattctgtattttttgttaagtttatatcaggatgatttgtcattagtgttcttgtaacatattttggagttttccttgtgcaatgtggaaatagtaaggttgacattctgcttttaactcttctttataaactatgaggaattcccaaatagaatgttaccttgaaagactcttgacataagtagaactaaaccaaatattttatataattatttttattttttatttttgagatagggtcttgctctgtcacccaggctcaagtgcagtggcgtgatcatggctcactgcagccttgacctcccaggctcgagcaatctgccctcctcagcctctcagagtgcttgggattaaaggcatgagccaccatgcttggcctctgtaattcttaattattattttatatatgttatgagtatgagaactaagcagttccataaagatgagaattataatatctcattttagtagtattttgctttgtattatttgacattttataaaaattcatagtctcaaaaaatatacaatgttcttcgtcaagtagctaatactctctttcttagtgttcggtttaactattaatcttatcctgttaaattatttaaaatttcctaataattggcacataataacagtttttaatgtcagcattgataacatttttctgtcataatattcaactaagggatgcatcttcaatgtataaagcccataagtaggttttttcaccctagattagatctaaattgcttacctgtttttggaagtgaatattatgttattaacaataaattccaaactgctttgtattactgacattgtaacaatgtcttgatatgatggagacccttgctatcacattgtcattgatcatgcacattgatcatgcccgtgttgaaataggcaatgccagagacagaccaaagacgaaactggtagtgattttggtgaacattgttgccatgttaaacttgagtatatttcttgttgaacaaccccattttagagatacggaaaatgttgtgaggcagagatattaagtaaccctgcccagagtcgaatggttaataagtccttgccaggatttaagtgataaaacaaaactcatgcttttaactactatagtcttgtaagccactcaacaagtattggccagttaaactaatgaattccctcaaggaattgattctagtaatagagataaataatcaagtcataagtcatgactcaatgtgaaaagtcttgtgactaaggaatgaacagtacaataaaggaaacatgaggaacagtgaatcgtggtaggattatggagaggaggaggaaggaatgggggagagtggggcctcagagaggtgcaccaagactggggcccaggccttgcttccaaggtaccatggcgttctgtgtttttccttgtcttgggcatactattcagtgtttcgatttatttacttgtccttacctcccactaggctataagctttctgactgcagaggtaaattgtgtgtcttcatcacttagtgcaggaagtggtagctaatgagttggatatgtaggggcgagtacagtggacaggtgaagtcaggacatgatggacaaaagcatgaacatgaaagaagatgtgaacattcgttgcctctttaggaaatggtcgacagtgtggagtggacagagcacggacatgtagcttggggtattgtgaagggatgggtcagccgtgtatacttatctaccatggtaaaaagtgatattattagatttctgagtgcttgcctttccctaatgcatcttcatgtctttaaggacaaagatgtaggaccaagagtgggctacatcacaggagatgaaaagatctgtttgcatatttgacctctgctaattatcagcagtgtgatagtaggcgtgtcatctgacatcatcttgcctgttgcatagtagacatttggtaaagatttgttgaatggattaattaatataattatatgtttttgcggactctgaagaatttgagatacagctatataaaagagttactatttattggtacatattgcttagtatttggaataagcttggtaattattcactaagcaggaaacagggtttagggatttccaggcattagggacactgagccttgagacagggtagcagctctgtggttcagagtgactggtccaccaggaacagaaacaagctagtattgggaggtgagggagtaacattccttgggaggattatttggcaaaacgaagtaagaatcataggggcatagggtcatggaaaaggcttcattcttagtagagctctggagtacccatcaagtctgggtgaagatgcttacctccctgagagggcaagcatcaggaaagcctgggtatgggggtcccgggctcctgaggcccaggactcattgctaggatacagattgcactgtcaagtccagactgtcacgtgtgagtctaagcctattgttttggggcttgccatggtctggatggggcccctcttaaaggttatagagttgtggaagaaagggactgacacattttgatagtcaaagagtaaaagaagctatgagttaccagtgtgctggatgcttctgaaagcgtttgacaagtgctttttgagtttttaaattaaattacttttttatttttgtcttcctctctataaatcataccagagaaggtaacatttttctctatactgactttgacaagcctagactatgctttgtctatgtccagtgtacaaatgtagagaacccattcatttctttactcctcacatatttagtaaagtccggctgtgtgccctgcctttaggggacactgagcagaaagcagactcctccagacgattgcattgcagtataattagcaccataacaagagtctggcagattctagtctgtagtagcaaaatgaagagcaatcaggtctatccagggaatgaggaaatacctcacaagataggaagtgactgaactcggacttgaaggatgatcaagaatctgccaggtgggtatgggggccacctggcaaaaggacagcatatgggaaagcagaggcatgaaagaccttggtgcatccacaaagcgttgggcacgtgagtctagccagatcacaggttgtgtgttggggagcatttagagaagagaacacaaagtcctcacgtgctttactcaggctttgggcttaaggagtgtttctgatgtgggctctggagccagactgcatggctgtaagccccggcctctctgcttcacacctctgtgatcttggacaagtaccttaactttctgtttctcagtttcctcatctcagatgataataggacatgcctcacagggtggttgtgagaacctgaataacatcgtaaagcacttcaaacagtgtctggcacatcagttgttattaataataattatataagataaaattatataattcataatgatgatgtttaatttgtaacctgtagtcaaaaagtagaaccaaatacaacttgcaagggaactggatgcttctggaagagtttgataagtgttgtttgagtttataaagtaaattaccttttttactttccaggtaaaaaaatatacctttgggaggggaacaacacacactggagcctgtcggggggcggggccacaggagggagagcatcaggataaatagctaatgcatgtggtgcttaatacctcagtgatgggttgatggatgcagcaatccaccacgcacacatttccctgtgtaacaaacctgcacggcatgcacatgtatcccggaacttaagaaaaaaaaatacattttttctttccaggacagcgtcagtccttaagaggctagctcaaagactagaggaaaaatagactactaaataaatcaaaattatttagtagggtatagagttatccataaagtgctgggggtcactaattattaaagcagatagagcacaggtagttgttgagcgtagaacagcccaatcagaatgatgcctcagaaaggcagtagttggcctcccagagtggagcatggattgcagcagggggctgaggctggagggggagaagtgttgaactaattcaagggatgttggagggctaaaccagtgtctcttctgctaaatctgagcagaagagacagatctggaagcttctggtaaggtaggcttgattgagtttggtgagaagttagatgaggagggtgagaacctagcatctgggtgtctgctagatagatgctgctgcaccacaccaatgtccgtgtgtctgggtaccgaggtggtgttcaggacaggtcttctccacgtactgccgctgagctcacatccacgctgtgcatgctgggctgagttctcttcaggctgttttcagctgacttaaatgcaacacgtgatgatgagcatatttacataatgtatgcctggtgaaatcacgaaagattggaatttcccattttaattccattttaaagatgcttgttaagcaaaaggatataattcatttttcaaactgctgaaatgttatttggcctcttgaatcaaaggcattccgcaagtgttttctttattacatgccttaaactttaattagaatttaattataagatcctgaaggcatgagcaagaggagcagatgggatagtaaaagcagcttagtgagggaggattaaagattaaaagttgcttgttaatggcataagaaatgaacagagagctaaattactatgcttttgtgctatcctgatgctttttcgattctgtaacttattcctggttgcaggtttttcaattctgcaacttattcctggttggaagttgaagaatctcacaaattagatttttaattttttgagttgctagagtagatttgtacatagaaaacaggtaaaacctgacaaaaaggtgttttatggctagtagcaccttgtacaataatttctgcattgtaggggcttagtggtatttactgaattgaactaaaacttacatcatctcactagtaaacatcgaatgagcataaaataagatttttttttagagatggatggggaaggtgtgagtctataagtccaggctaacctgtcccatggaatgttagatacctactcaggaaggtaacttgtatgaacctcccacctttagcctaccccccagtcgaccttagtcatttgccccacttggttggttggctagaggagtggtagaaatttggtgtgggaaacactttgagactgctcctcatgtcacacagtgaggatgacctgctctgctctctggtgctatgttacgatgatctcccgttaggctaaattattctacttcttagtgctttttcccctagcttttttttttttctttttgaaatctgatatttagagtcctcttccccacttaattgcaagctcaatgaagaaaaactagagaacaataagatagaaaagaagacaaaaatgtagtgaaacaaaaagcattctatctcctattttccaggaacaaatgttttttaaaaagcttttttaagcctgttaatagacagttgattcttcattatttgcagattctttgtttgcaaatttgcctacttactaaatcttatttgtaaccctcaaatcaatacttgtggcactttcacagtcattcgcagaaatgctcagagaggaggataatttctgagtctctcgtcatgcgtgttcctagccgatggcaaataacacaacaccctgccttcttgtttcagctctcatagtgtaaacaagtgtccttttcgaagtctactcgtgccatgtttttctcatttttgtgctttttgttggcgatttcaccatttaaaatgcaccccaagcattgtgcaaaagtactgtgtagtgttcaagtacagtgcaagaaagctgcgatgtgccttacagagacaataacgtgtgtttgataagcttcattcaggcaggagttaagtgctgttggctgtaagttcagtgttattgactcaacaatatatattaaatgagttgtttttaagcaagaatacacatgaaacagggttgcgtattgatgagttggcaaaaatataactggaggctcagaggaacctagccctgtatttcccttaggaacaatggtccagtgttccctaatttaatgtttttggagactaccaaaaataataaggtcagccatgtatctttctccttttctccttgctcttgcttgatctttccatctcttgttacctcaatctgtgtgtatatgatatgcatatatttacttaaattatatatgcatatatttagcaattatgatatcacatgatacacgattctgcaacctgtcttttaacttatcaattgtgttggcctttgggctgtttgcactgagatccatttgtcacccttgccctgctctgcaagggtgctgtgttacagggggttgacccctgccccctgacaatttgtcatcagtgggagatggcaaggcaagagaaagagaagctggagtatttgtccctccctctgtctgccttgggcagcatctctggcagtggcccctctacagctatcccacctgcaggttgggtcctccatggctctgtcatcggctggttggtcctgggtctcgagctttagccctgccttcttcctttgtccttttagctgatgggtggaagaagcttcctgctgatgctgatctctgagtttcttccctgtcccctgggtagagcatcagatttaaaagccaaggcaagacaaaaaatgagagaatggtagcaaagatccaacactttacaagaccgcctgagaaaagggaggagggggtggttcgacaccagggcctgcacactgagtgtgtgatgttgcagctctgcaggcacagattaagcagctaagatgccatcaatgcttggaaagcagccggtgcctcttgtcctgagcttatttgtctggaatatgattcccttgaacctgactagctcatccacggggagagagaaaaaaaaatattctgatagttatcctgaccaggctctaacagggcctccttccctaggatataattttttctggcctctttccattcacttcttcacattaggacccttttcccccagagtgtgagattccctgagggctctaaaaactggaatgctatacagcattttaagccccctgtgttggcacagtccttattaaaaatgtattttcctcaagccatggctgcaccccctgaagtgtggattaacagaaaggccttcagagctggaagacatttttgaagaaccgctgtaccaagtggcattaaatatttattgcctactacatgtaaattgttcatcatcttgttttaactcttggaccaaaaggtttctcatctgctttctgctaaagtggaaatcacaggaaaggtactctttactttgctgtggtattttgttttcccaggaatacggaatatttctttgttctcataagtaatactagaaaagattgccttgactctcagcatttcattgggaggccatgtggtgtcatgatggagaaaaactcgaattctggggcaagtgcattgggctttgccacctgcaagctgtgttggcttgagaacctgataccatttatgtttgttgtgctggaaaaatgggacattgcataaatagcagatagcacaattcctggcacccagtaagttctctctttctcctaggtcttctatttgggactttgcaaatacatttctaagcaacctagaataaaatatgctattaatatgctgttaataataaccaaaagcactcagcttaatctttacttattaaataaaactgaaatgttgctcagacaccttttgctgtttttggaatgcctttgtagacacttttgatcttgcttaaaaaacataacagcatttcaaaggcttatcttagctattcttattcatacctgaaaacctacagagtttggataattttggcacacatatgtgtgcacgcatgtatatgtataaatattctgtctctctaaatatatatgtatatgcaggcacatgtataactctttaagaaatgtttttctaatgtttaattttcttaaagtctgtacttcacatcatttttttccccagaactgtttatcctcactccagacatgacccttggaaaggtggcagaaaaaacaaacggctggtgtgttttggggcagtctgcattccttttaactctctgagaccaggcttatgcatgggctttcaagctatttgtccagaggcccaaccactttgatttctgcttgaaaattagcctgttgttcaagctcaggagagcttccacagagctttcttgggttcgcgaactagagatctatgaagtgtttgcttttatttgtaactttaaccacggcagccttaactggacttttgttttcttatttaacttttatccatgtaaccttaacctaagttctttttcaaatctccatcctcccccatctcacaatttctaatccctcttttgtccttagatttttccttcaaagtcaggatatgacatttatatctatgctttaggaagtatctgaaagctaacatacacatagaattatgatttttttcttgggttgcttaggaggattaaacaaaggttttagaaggcagaattcagaaaaaaattgatagaagttgtgctgcagcttggaggggagtgtggattttagaaagcataaggacactttcatttgtccctttcatatggacttttatttcctctgcgagaggcccaggggcctggcctgtggatggtttagacaggaaaagactgaagggataactgcttccagaccttcagccttgaatgttcagccattattcaagccgttgagaaagggagcaagaggcataaggaggcttcgggagtttccatgcagcttctctgagttccagcttgtgtgcattgttctccaaatgtgtccccagcactactgaaaggactttcatacctcaactaacccttattgcaagcctgtgaaggaagagttttttatatatatatatatatatatatataaacagacaaggcaactaaagctctgggaggttacagaaacttaaggcctaagtagggttacattgagaccagattaatcagttagtagattgtctttctatttcatcatgtgcttcatttcctccttggtttacatgacccttctttggaaatttccttctggtaatatcttagttaaatgaaataactaagttttatggagtatccattatgtgttaggcattgttttatgcaatatgcatctatgtagtgcacattctgataggaaccatgtgaagaaggtgtattacctccattttagacaggaaatccctgcaatacagagggttaggtaatttgctcaagatcacacaggacacagtaggtgacaccaggatttgagcccaggtctgattccagaacttatgccatgcccactacaccagccgtccttattaagaggaaggccattggtatgaggccacttgaaatagacatggtagatatgtggcaatcaatgcaaaggtattgtctttcatgctctgttgcaatctcatttcatttctagcattataggtatttaaagcagaggtaggcttgctttcttagtttcagttttctgagaaacaaagatagtaacaacaatgatgatggatcttgttaccatatgtgaatatctgtgtgtactaggcacggtacttggtctttacacatgttcttctaggttaaccttatgacaactctgtgaagttttctcaaatttatatctgagaaagcactcagaaaggttgagtcacttgcttgcccacatcacactactagtaagtggaggagtgaggatttgaacctaagacctcttacaataaaattatgttctttccactcagtatatgggacatgtatccctgggggcacatgtgagaactataattggtctgtaagattattgatgatggtatagggatagggtgttaaagaacattgatgcccatagtgaaaaagtaattccctttcacttgtcctaccaaccatctggttacatgaaagaggaagtctcagttaggtgccagtatgccttttacaattctaacagagaacagggctcagactctgaggctcgggcaggtaattgaatctagaagaccatggtgacgttctttttgtttttattgtattttaatatcttctcattaaaaaatattataatgtgttcatatatacaaaataaatgtaatgtatatataaggttaaaagaataatataatgagtatccatgtacctatcacctattgaagcattagattaattttagttactatgggaaccttctgtgtcactcttcccatcccaacttctttctttctctcctaccaacatcttacataatcactgtataactatcaaaatcagccagttaacattcacataatactattactcagtctacagactttttgctagttttgccagttgtcatactgtttcatttcctggaccagaatctaggatcacacaatacatttactagtcatatctcctttgtctttggaatagttcctcactctttttgtctttcatgaccatgacgtttttggagtctggttaggcattttgtagaatgtccctcactttgggttggtctgatgtttccacaatattaaattcaaattatgtgtttttggcagggaagctacagaaatgatgttgtgcctttcacagtgcatcacagcaggaggcacatgatgccgatttatcgtatcacaggtgatgtgaactttggccaatttgttaaggttgtgtcttccagtttatccactgtaaagttactatttttccatttgtaattaatgattaccttgtagggagatactttgagattatgtataatatcatgcttcttatacctttgtccactaattttagcaactattgtaaattcttgcctgaaacaattattcctgtggtttttccatatggtgtttttctatgattataattctttctatatttattaactggaatgctttgtaggtggctttatcctcgccacacacttatttattcattcagttgtttatttgtatcagtatgtacttacaaattcttattttattgtctggattataatccattagtatcattattttgttttgcaaatagtccttttaaccaatggggatcccttcaaattagcttttctatctttctgacatgtctccatcttttttaaggcatttttgctttctggtgccagaagataccactttgtgctttacttgctccaaccctgagagaagcctcctcttgctgttctgcatccattcctctcagtcactccttcatgcactataatatgatttccactctccccagtgcactgacacttccgtcacttaggtcattgctaaagcagtagatattttaattcttctattactgcatatcagacatctcttggccccatatcagatcttctcaggaggacagtaaagggaaattgtaccatctcttgttccagctgccgtgaccaagtttgcatagactctgaaaaacttcctacagtataagctgacagtacctcacctcatgctgcatgcttttccatagggcaccccacgaggttccatggggtttccttgtggttgctacctctggatctcactctgttcccacacatgtacaacctggatagagaattaatgcctcctttctctctatcgtggatggttctgagatacagttcatgtggcttggggtgtggagaggttgaggatgatcctatgggatagagaacgagtcacttctagtggggccatcttgataccacaacttcatcttgcctccccctccttattatttgttttattccctttgtctatcagtcctctccttctccctaagattgcactacctgatgcagtagaaccctcttccttgggtctgctgtctcggggacccaggaaaagatgtgcagtgtttaaactccttctctataatctcttaactttcacactatcacattttcattcatttattccaattcattcattcatttacaccttatttattgagactttccctgtgtgagacattgtgtacaggtagacaaaaatcttgatcttatagaagttattgtatttgggggagcagaaataactaaataaaaccaattcagctgaattataagtgcttttaagaaaatgcaacagggagagggcagagagtgggccacgtggggcctggcattgggatggttaccacatacactctgaggaaatgacatttgaactgataaggggtcagcaagaagaaatgggctgagagaagactgatctattcacaggaaagaggaagtgcaagagccctcattttctgttttgcactagaactgctttcctatgattcttcagattgtgccacctttcttccaactcccatgcatttgcacagattgtttctttgacctggaatgccctctctgacttaccaagctggcagatttctatccttagctcagatctcatctaaagcagctctccacccccagggacattttaagtcctttttctgttgttggtgtgctgtgctttgagcacagtattcatttataatagtgatgtcagtgtacgccttagaattgttcacctgcatctctccttcttggactaggagcactctgagggcaggactatgtttgtttactttgtattcccaacaaagtgcttatagggatttaaatctatttattgatgagttggatggatgaatggatgagtacatgggagaaagaggaaaaatgatatatgaattgaaataaataaatgaaagagccagtgaataaatgacagtgacctgaccttaaggcgttgtcttgtttgtgggtgagacaggagtataaccattcagagtactgtgatgaatgcttagagattctcagtgcatgaataacagtggcagtcagcaagttctgctcatagatgcatattgtttcagctatttcatgcttatttatttagtttttaagaaattcatttaggtaccaaacataaaaaaaaacccagacttgcagctttccagatttggggccagacacatgactgtaatcccagcactttgaggggccgaggtgtgcggattgcttgaggctaggagtttgagagcagcctgggcaacatggcaaaaccccgtctctacaaaaaatacaataattagctgggcgtggtggcacatgcctgtagtcccatctccttgggaggctgaggcatgagaattgcttgaacctgggatgtggaagttgtagcaagccgagattgcaccactgtgctccagcctgggcaatagagtgagatttcatctcaaaaaaacccaaaaaacagatttggcagtgctggacccttctacatggagctggggacaaaaatctgctggaaagtaggaaattattagaataactaactgtattaaaatatgttgaattcttcttgtcatgactgttttgacatttgtttgtactagttaagggaaaatgaaacttcaggttgacagcctttaccttccttgtgccataattaatttgctctattctgtttgttcaggaaattcagcttttgaaggcccagaaagaggactaagggtgcaggtggcaaggaaaggttgatttgtggtgacctggcatactgtattccatctttaagtcctcaccacaagtaggcctttatccaggttcttgttacctggaaatgtgtgttcatttggggtatctagatgaggcaggacttcaaggaaggggatggataatgcacttaatcttcatcttcacataaggatagctgctctttatcttctccctctggaagctgccattgtgaggcagcattaaggtgggagaggaccctctggagttcatccagaaccctctgggggcacctgtgtcccttctgtttgtcagtgtatcagccatggatcctgcgtgaaacaggtggcacatttaaatggggtaatccgagaagagtggacaagtgtagggaaaccacatggatagtgcaagatgcttggctatctaaagtggggctggtactctctctgggcctaaggaacaaggagaggggctacgagcaggccctggggagattgttttgtggaggtacttacctttgtgacctttggtggagagctgcagccatcctacactttctcctagtccactgatatccctctgtgtcctccattagctgaacctggctggaggccagaggcagaagagccctctggtgtgctccacacccatcagcatcctggcttacaaggcagggtggagaaagttagagattgaatttgaagagcacatggaagatgtctgggacatctgggcattctttctgtgtggttggttcttgtggtcagatatttgtggaggagtgaggtggtggtggtagtggctgtgctttagagtcagtgagtctgggacaggatcacatctgccccactcgctaacggagttaccctcagctcaaggtcagcaggcaccgatttctttgccgtctggtggggccaagggcaaatgcctatctcaaaaagctttgggaagatcaaaaatgaaaatacttaagtgtttttttgcagatttggaaaaggctgaaagaagttttattaaaatgtgagcaatatacctcaataaagttgttttcctatataagacaaataaaactgtgttgtgatttcacaacaagtgttgatttttttcttcattatatttttctgtattccagattttctgtcatcagaaaaccagacatccataagtgctatttagaaatatgttagtactgccttcaaattattactgttggctaatattgccttctctgggttactgaggtatgtgaattcacagctgcagcatagctgacttgactatggacagactagagtgaacgtgtatgtcatttcttacgatgtgcccatggattcaggtctagtgccccatccccaggaagcctttggcccttcagatgcttctcctctgagctcctgcagctcctgggctgcccctagcagttatcacactgttttgcggttttctccaccactagactgtggtctcctctaggtccaggactgaattttattcatctccaggtcagtgtctagcattgtcttgtaaatgctgtctttattcatgttgcccagcttctaccacacggctactggaagttctcaagctcataacaccgtagcttctacaacagagagcaactgactgtgctttctcctttctgttttcaaagccctgggaaagaattctgattagtttcatttgggtcaagtgtacctacatcccttattgaaccaactatacccatggagaggtatattacagtgatctcagctttggtcaagtgctcattcccagaggaatctgttgtgtggccaatagggtaggatctgtacaactatgacaggtcttatttaaatcaattagttacagtggagaagagaatgaatcagttaggaatgctttcagctgcagtgacaatgcaaaaaagcttttatttaaatcagttagttgcagtggggaagaagcatgtatcaggaatgcatttgcaagggagcaaaaattggttcttgggggatgaaaaagatcttagatattacaatcatttgtggccttctaaagcccatccttatgtaacagcataagtagatacacaatctgtctgtggtattgaaatttcacagtggcagggaaaaggaaaagactgtctggaaagggtctttagtgggggcgatagtgaaaaaaaagtttgagagtgatttatgatgacaataatcatacctaacttatttagtagttatgcaccaggaactgttatgaatgccttacatatactatattaaatcatttcaccatatatccatttgacagtgaccaaaacacaaatagtcttgatttcccactctcacacccctaaattacaagtacaaagatgatttgaccatgtcaccttcagcatatctttaattctttggacttttccctcatgctagctgcctcatggttgtaggatagttgctgcatctctggacgttacattctcctttgatgctggaagaattggtgagaagagcatgatgagattttttgttttgttttttaaatgagaggagcaaaacctttcccaggaatcttctcttcctactatacttctgcttaggtcttattggctggaattaagtcccatggccactcttagcagcaagaagcagggaaagtggaaaacaagattatcatggttggcttaaacctgcacattccaatatgatagttactagctatatggctatttaaatttttttagagagatataattcatataccctaaaattcaccattttatgtatacagtatagtatttctagtatattcacaggattatgcaaccataccccagtatccgattccaaaacattttcttcgccctcaaaagaaatctcatatccgtagcagtaagtcctcatatccctctacacctagccattggcaaccactagcctactttctttctctatggattttcctggacattttgtttggcttctttcacttggcataattttttcagggttcatctatgttgtagtatgtgccagtaatttttttatcagttcctgttttaattgataatactctgttgcatggatgtatcctattttgtttatccattcatctgttgatggacatttagattgtttcactttttagttactgtgactaatgctgctgtgaacactgattgatgtacaagtttttatatcaacatagttttgatttttctttgaattctcttgagcctattagaaggagtggaattgttgggttttatggtaacaccatgtttaaccctttgaggaaatgtcaaactgttttccaaagtggctacacattttgtacatcctggtaggaacatgtaaggattccaatttctccacatccttgtgagcacttgttattttttgtttgtttttattataaccatcttagtgggtgtgaagtggtatctcattgtggttttggtttgcctttatgtaatgactactaatgttgagaatatttaatgtgcctattttccatttgtatatattctttgcagaaatgtctgttcagatcatatgcccattataaaattggattgtctttttattgttgaattataataggtacttaaatttaaattaattaactttaagtaaaatagaaaacttagttcctcagtcatactggccacatttcaagtgctcagttgctgtgtgtggatagtggctatgttattggacagttgcagataaagataatttacatgattgcagaaacttctgttggacagcactggcttagaaccaccatgattgatcacttatagctgggcatatgacttctctaaataaaattgaggttttgttaagctaaggaaggattggtactccagaaagagtgaggtgtcctggtcccagaaaaggaggttatgcagactcagtgtataactcctaaagatgcatcagagtttaccaagggaagaactggggcaggggttgagtgggagggcaaaattctagaccagggcttggcagatgtcttttgcaaagggtcagatagtaaatattttggctttgctgactatatgatatctgtttcaactattgaactgtaaccaaaaagtgtctgagacagatttcaatcgatttagagaggtttattttgccaaggttgaggaagcacccgagaaaataaacacaagttacgttaggatctgtgactggtgttttgtccaaagaggattgtgaggacttcaggatttaaaagggaaagagtgagcaggaagggaaggaggaaagaaaaaaaaaagtttgaggggcataggcgatgaggcaagtggttacattcttgtgaggctttgattagtgctcaccaaatccacagtttacatgtgaaaagaggagtgggggaaagtcatttatgctcagtaaatctacattttacgtaagataaaggaagcatgtgaagttacagcaacccatttgagaacaaaaggatggcagttttttgattttttctttttttgtgtgtgtgtgtgtgactcagttcccaagcttaacttttctctttaacatagtgagtttggggtccaaagattttattttcctttcacacaactttgtccttatagtgaaaaagcagcctaagacaggccataaatgaatggacatggctgtgttctaatggaactttatttacaaaaactggcagcaggcacatttgggctacaggccagggtttcctagggacaatacatagaaaagtatggaagccagaaggggcctggcatactgaaataaagagaatggtaagacgtttggtatggctgaaaactggctgtaggagctatggctgtagagaaggctaggaatagagactggaaccagattataaagggtccgcaatgcatatcaatgttgttttgttctggttggtggtggtggttgtggtgctagtggcagtggtggttttctaaaatcctctaagtggcaagaagccgtcaaatatttttaagtaggacattatatgattatggctttttagacaaccctctggcagcattgtgaaaagaatattggaggaaatgaggctagaggtaaaaaaataccagttaagctttgtattttgtattaaaataaagatctggtaattatcttgctaattgcatcagtagagacatagaccaccaagctgataattcttatcctgactaacctactcactatgagctgagtaaaaagcagtattgatttaaatgagttatgaagagtggggcttggatatgctctttttatatcccaggggaatcaccctggaaacctagagaactggttccaagtattcatctgagaacatctgtgactctcagaaagttatgagattggagttgtacggggaaactcgctgtggccttggaagagttgacttctaaatggggtagtgaacttattctccgtggctcagttctaaaaggccctaagaggagaaaaggattcttgatgaactactaattgatgattttaggtccagagttaagcataatatggaggtttgcctgagagtgtctgccgtcagtgaagatgaattatccatgtgggcttagaaaatcacacatgcaaattatgtgtcaatggatttttttttcaacatgctaatcctagcctttgagtacacagcatattttcaaagccaattttgcaaacaactctatggtaaatgctgctaagctgttgataagttggctttccatttgtaagcctattagttcagaatcttctgaagtttaattcaaaatgagataatgtgtagtgatttgacagttttcattctgtgacgatgctcttcaagaaagcatcttggcttgttcactagttgaatcctcaccagttcctgaaattatgaaatgtaaatttgttataagcagccgctttgggcccttcacaaggcagaattgtaccttatccctgagtggaaataaatgaacatctcatgtgtgtagcttctctctctctgtacatcctgactccaaatgctgtgaggcaccagaaaatgtctcctgaatctgattttgggtggctggatcaatgtccagagggaattaggaatttttccaatggtggtacagatagaggtgataacattagaaaagactgacccttgacaagacccacattagtgaagtcgttattcccaaggagttgggtatgtacttcccacgtgttgtgaaaacagggctctattaccttgccagcaataccccaaaggcagaggctgtatttgtccttggatctcagtctttgacattgttttgggaaggtatgatgagaggcatgaggaaacctcatccattttgtgagtccagtgtacttaaacggtagagactgactccagggcatttggagttcacagaatttgtcaaattatttttcaagcttgtagggttcaagacttccccaaatgtatttttccaagtgcttgtaccctggtgtccattaagggaaatgtactccatatgtttctaattcttctaccctgaaatgatcaaaatattatattgctgagatctctgaagactagaaagatccttttcaattttttttttctctttgatgacactaacagaaatgggtgatcccagtaatcacaaagaggctcaaattcactcccaaatgcccggccaccaagaagctttggacataagtattttttgggggtatttgtgccaactgctgttttaggacatgtttctgataatgctttacacttaccagaaaagctgtttttgaaaaatccagtgttgtcttacaatcattaatttaaaaaaaaaaagtttcccaagtattttcttagagcaaggagatctctttctgatgaagaatacactctagcctaaaaagccacttaggtggaccagtttctttgattaacaaaagttacaaaggggaaaagaagagtgttagagaggatacctgtaacaaaaagagacaggagacatatggaacactcgtggtgtgtcacccttatttgaaccctcattcaaacaacaactgttaagaaaagtaaaacataggaggcatatatcaatacagaatggctatatgatgatattaaggaattattctttttaattatgatattgataattagctattttttgaaagatacctccttttatagatacatgctgaaatatttacagaaaaattttttaaaagcctggaatttgtttaaaaagaatcagggtgtggtatagttaaaactcctccctccctccatctctccctctccccctctctccctctccccctctctccctctctccttttctccttccctcactcccttttcttcttttttccctcccctcctccttcccctcctttctcccccactgccccagcttctcttcccttctgttctctttttctggccttcatttgggctgacaagaagaggatgcatgttttatatcaggttggcaggtatacttgagatatattgtcttggcaatacaaaggcctgacacttcctagggacccagatgggtattgtagatgtttagggcatgccttgacctctgagtagccttcttgggcttgaggtctcatttgactagactaccactccacagtcagccactgtggtctgttttttaaaaacgttgccatgatgagaatgtgaaggatttgggttgaagttaaggacacttcctttttattattagtctggagttttaaaggagatacctgggatcccacccttactttgttactttgatttggagtcagcccttggctttgagagtgtgctgtgatattggtctgatttaatcattgcctatgtagaaaaagagattagatcactggatcccaaactagcctcagaaagtaagtcattgatggcaagaatcacctggagagattttcagtttaattcttaaaaaatttagtgacgatacttggataaccctctgggaattctgattcagtagtcctgggtagaaatagaatctaaatatctgtaattttatcaggtttctacacgattctcatgttccaatagtttggtgatttaccaggttcaatgccttttaatagattcagttgctcaggagcagattgaggttgtatttccatatagtcctaccttgtaaaaaatggatgtgtcaagttttttgttggtgttattgtttttaattgttattttgacttgctgggctgggcgtggtgattcacgccagtagtcccagcaactttgggaggctgaattgggtggattgcttgagcccaggagtttgagaccagcctgggcaacatggaaaaaccgatctgtactaaaaaactggaaaattagccaggtgaggtagtgcgtgcctttagtcccagctactcaggaggctgaggtaggaggactgcttgagcccaggaggttgaggctgcagtgagctgtgatcatgcgctgcactccgatttgggtgacagcgagaccctgtctcaaaggaaaaaaaaaaaaaaggttacttgcttatgaataagaccttccatatagcagttattatataagcactaggtaaatattaataaatggcaaatactaaaaggaaagacaggaaaaggaaaggcaactgatatttattgaaggcctactattatagtaaacttgactcataatttatattttcttctttaattttaaccttggcatgcaatgattattacccaattttgtattcagtaaaattaaagcccagagaagtttagtatttttcctagagtcacatagtaaacacgtggcagcaggggtgtttggatactattgtgccaggcagcctttccgaacactccagcctatttctcaattctttcttggctccagaggattgtgtagcaggaggggaaatctgttcagagatcaggaaactggaccaattgggcaagctgccagagcttcctttactggattgtaccagcaagtttgtttttctctgtccaatactgggtaaaggtcccaccgaaagcctttgtctctgctcagaatgcctggtatgatctctgggaaactatttggcaaaggagtgtggcagctgaagcacagaagcctctcctaggtggttcacccatatctgatttttttttctttggcaccttgtaacagacctgagaatgttgaaattttgtgccaacgtggacaccattcagcatgtcagatttctctgataccgtgaagatcaatatgttggatgcaaaggaaaagtcccagcaatagattccagccctcactgccacttacctggtatattacaacagcctccatactggtcttcctatctgcagcctgtcctctgctttccggcccacttttctcagggggatcctctttcaaataaaggtctgattatgttcctccaatattaaaccccttcagtgactccccagttcttgaggaaaaaatgctgagtctctgagcatagcactgaatacccttcctggtctggccctgtttctccgcatgcttctcccactccacccagcttctggcaggtcatactaccgtggctcaccaaagatgccttggaaaccaggtactttcatgtctctgtttctccagctggagtttcgttccttctttgacctgcctggcaaactcctatgcattctttgattcctactccttcatgaagcctttcagcagtttctttcttagcacaactctaccaccttgtctcacctgttcacagacatctgcctgcctccctctctaggctatggtgccctccaaggggaggcaaggtgttgttttcaaatcattcacagtacttactacataggccacttacagtcagtgtgtaataactgaaggaggacttgagtgaataggcaaataaagatggttaccatgataggccgagatctgaaaagaagctaataatcaatgcatgaagatgtgtgaggaacttgtgtgtcttcagtaccattctaaataccatacaaatacaggtgccgccagagtgcttgcacatggcagcttcacagcccatttgagaagtagaattaatacatgtgaagaatgaggccgggcactgtggctcacgcctgtaatcccagcactctgggaggccgaggcaggcgaatcatgaggtcaagagattgaaactgtcctgctcaacatggtgaaaccccgtctctattaaaaatacaaaaattagctggacgtggtggcacacgcctgtaattccagctactcgggaagctgaggcaggagaatcgcttgaacccgagaggcagaggttgcagtgagccaaaatcgcgccactgcactccagcctggcgacagagtgagactctgtctcttaaaaaataaataaataaaataaaagaatgagtaagaaaaccaagaaaatatgcaatttagttcagcttgtttggtgctggtaatactttatttttcatgtgtcgatttttgatctccaccttgcactgtgagctccctgaggacagggactttgtcttggcaattatgtcttcacacttggcatacagtcagttttcaagatatgtttgttcaatgaataaatggatggtaggcaccattcagtgctgtttagggtcaaaggaaggcatgatttgtgtgggttgaagtggtcaaggagggcttcacacataagccagttatgaaggatataggcattgaagaagcactaaaactggttgtgagctttactcttcagagagtcacagttttagaaaagctcttgctctattggaaagaatatgggttttagaccaaatacatctagaatcaaatttggactctttcccttatctgctatgtgatcttgagatctctgagtttcagtttccttgcccataaaatgaaatcaatattacttcccttagaatatgcttgtgagccgtaaaagcgatatcatatataaagcatgtagcataatgcctagcgtacattaggctctcaataaatggtaagtaaaagctgatatataggtatagtgtgtctgaaatacctgggaaacatggattatttggatgacgtagtaacatttgattaaatttgcatgattattatattggcacataacaattagaattataatagattccagtatttttatggccttttaagtgtgttttggggatttctatcacatttctttacttttttaacattggaaaattggaaatggatatttgcccccaaattgtctgatatatagatctcgcccttcccattacacttgtgaagggaaggcttttctggcaggaggagcataatgcgtagaggagggaaagggaaatgagctttccattttgggagaaaaattagagctactcttccagtgacaaaccgcattgcctggctttccttctgcaggctctgcctcatgcctgtgttcctatagacattggagttaaagctctcattcatggtcatgattctcgcctctgtctaattcttttactttgtcgtgtaccatctctccttttcccactgttttttccagccacctctgtttcttttggtttccttgagcatgtcaagttcttttctggcctatgttctttgaatttactgttccctttgacagacattcttttcctctggctcttttcatttttcagaaaatcagctgactccttaccctgtggtggtattggagccaaataatggaattgatttttcagtgtttattccacataattccaaggaatatgattttaagagtgttcacaattcatatttttttttaatttttgaaattgaataagtttcaaatacgaaaatttaggaacatgatacaaaacttttctctgtgcaccactggagtactgcttttgaaatcaattctctctgtcctggattacccttagagctcctgtctcctgcatggaggagggtggagggcatttaacatgtccatctctcaccccattctacctgagcttccagcaccaccacctctgggcagttccgcttttagtcagcagctcccagttcccataattttgacttctgtccttgctagtccagaagaaatggctcttctgggattgaattcctccctttccccagcagaaatggattggggcagaggaattgcggagctccatggcatagagggtcctggaaggcttgtcattagggtatccagggtgggaaggggagtgaagggaggggaaggaggaaggaattgagttgggaagagtcaaggaggatgaatgaagttgctgactgatgtctggaataacattatttcaccctcaaaaataccagtaattcaggactgaaaaataaatttcacaatatgttttaatttcaaaaagtgatagtgtatttgacattcttatccagcctggtctcacctcaggagttcccccattggagaggccatccctgaatttctaactcacaggcctcccctacgttaatatatttatgtcctcctggcccttgtttactttttacttgtttacttttgcttttgtttacttgtttacttttgctccatgaagtcagggacctgcctgcttgctccgcaatccctagaactgtgtctagaaccttagttggttgcagtaaatatttgttgaatggatggatgagatggttgtagcaatctaagttgctttggatgagattaacactgaaaaaaaaaaaaaaactggttgcctgcaattctgtcagccagtccaggcaatgctaatacagctttgattattatgatcatgattattattttgttttgaaacctttttcagaggccaagcatgctggggacttgagggacataaaaatctttcaactgattatgccacctgcaaacaggataagcctgactttctacctcacccacctcttgctatcacagatatgaatcaacgaacacacaaaaaaggttttcaattctccctttggaaagagggcacatttaatattctgagtcaggcaaggaaagactctagccacaaagacagctgggaactcaggtccatagcaggcacccaggacggaggtgaagagaaggcgcctccctgtctggtgacagcagctggggcccttgctgcctccctccccacaaaaatccagttgggaccagtgcatgctgggaatctgcctgcctgacagaaacagatggcctcaggtggtgactgatctcttggtgacactaactgcatagctgctgctttactcatgaccgaatgagacacgagatggcggaggtaagagttggttaccttgccgtctcctcctcagctgaaatgactcacattgctgtagcttaaatttcagtccaggctctctggactcggggaatttctttttgctcatgctcctgagaaccagagttctccaggaacatctgtagtctctgtcttcaatcaaagcatttgagagatgctttatttttcccctttcctctgtacctgtcacagaagggggcctgtctgaataagatggcacataatctgctgagtgcagcaacccctctgtgcagccttgaggaagaagacaaggcagtcaaagtaccttccatcatttcctggaaaatgtgtcggtagcttggagaggcagagtgggagatggaagtaacactgcatgaggagttaggtggtctatgttcaggggccagggttgtcacttactagataggggacctttagccagtcacttaactccaatggccttctgcttcatatcatctcttatgtagggtggtgggactggattaaggacagcagatagattagctgtcagtcttactgattggaagttgctgtccagagtacagtatgggggatggctgggaagcccatctcagctaagtgagaaagagcagtcaactattggtatttgccaagtgtgtgacagtggcacatctgcctgctattatgagacttgatggtcatttctgcctctgtggttttatgattccaagtgtcctgcaagtgattctagagggatcatgaaacattttctggtcttaataattactcagggatctattaacaatggtgaggaacatactcacaaccagactttcattgagagtttaccatatgtatattatatcacttaaccctcatccttacggatagggaggctcaggctcatagtgattaaatgacttgccaaggtcactcagctaataggtgatggagctggaattcaaactctggtctgtctgcctccagaaccgaagcgctgaactgccaccctatactacttcccagttggagaatacctcagtacagtaattagatgccagtgtgtatggctttgcctatcagtacacagaaatcagaaaggtgattgagagattcattaatgcctccttgcccagttcttttgagcatatcttatttgagaaaggtgcacgtgaccttgggtcagtttgtctaactctgtcagtctcagttatcttatttgagaaatggggctatagcttttaagttaataatccagataaaacatcctatagtgccccagatgtcagtagcactcagtacatgttcatattatgttgccccaaggtcacgtggctgggaattgagctgaggactgcccacctccgaagtctatgatggcaccttttggttttggtacaagtgagtcctgagtggaccacatggcagcattagaggtgcttttgaatacgaaaggtggcgtgaggatccctctcacttatgtctgttctgttgtccagaacttagtgaaaatcctggtccttacccgctagagtgaaaaaggaaggaaaccttaccattctttctgtgtacctttctctggctggggctttctctggtctaggtgtgctcagcaaatatgacaagtagcaggccactcattttgaccacgcccatgtggcagacagctttcttcactttcacgcaaatgaagtacaagacaatcacatgtatggctgcactgaatgtaaaagattaaagagaagtgatatgccaaatagatgactgggagttgacgtttagcaaagtaaatctcttggtggccctggtaaagttaatttcaataattctggttttttttttcatcttagaaacttagaggttaaaaaataataaatatacatgaggagatttagagtgtatgtggaaacagagatcttcggaggacaagtgggatatttctttatagaaagagttttccctcttgatttttttgcttggtaagtttctttcaaatcaactcaattcatttggtgctattgcttttcttttgtgaaaacgattctggggatttgatcaaaaccgacatgaaaatacaaccctcaaatggtaaatatcagggaatctggaatttgcattttctaggctaaagtaatttactggccaagtttgctgtctcctcactcccccaacacatgtacaactcttaaatctcattcccctttaggctccttctctctcagtttatttccagcacacatgcatatgcatccatgcatacacaggtgtgcacatatgcatgtatacacacacacagacacacgacacacacgtgacgcacatattttactctgtgctaataaataggccagtattggctaggctgggcctcaggactgtctggtttaaatctaagctgcctgggagatctggagtaataagtgagtgacaacaggtgcagattttgttacacccttctgaactcagcccatagttctttctttgattcttttcacccaacacccttgcttcaattgtgtccaataaattttatagctgcatgatcctgtttcagagctgaagggagatttttccctccacttggctaaatggtgcctaagtcaaaacaccacttcctgccccctcctcacactttaagaagtaataaggaataaaccccaggccataagctgttgctgggtcctgtatcttcagttttgcatgtgaagagctaattttctggtcccattttagaaaagccaagaattaacttgcagagaattagccataattggggagaaaataattacttggctttttctgccctgtgataactggagccactggcaaatctttcacagcagtgtcaacgcctacttctgtttaaaacaaagtattgcaccaggggccttgaaagtcacatctgaatgttctctgtggtacattttggtccaaaccaccctgaatattggagttggattcatttcatgtcttttttggtgtaaaatcccggtgcagggagacatttcatattacactggaagacatgaatgtcttttgcaggtgtcaggtatgctcatgggccctgcatgcatacttaaggttgggtccaattggatttttttaggagcagtctgtggtctaagctgagaattttttctcataagggcccattttcctctagcatttttctgttttgagactttgcccagctgcctctattccctagtatgtagacttaataaaaaatctcttggttcataataaacatggaaaggagatggtacacgttttccatttgctagtagaggtttacctgaatacagttggtcatatatctcagtgtcgtcagagtacaacaaaatgtcatgccttcccatgatttcagacaccactcttcagtaatgacttatctgaatatcagccctgtacctctcctgagctccagccttaagggcacacttttcattgggtagccctacctgctgacccatagacaccctaggctcaactcattttccctaaataaatttgcttttctttctgtgttttctatcatggtaaaggtgctgtgatccaataactcaaacaagaaaccttgatggcatgccttccatatccattactgttagctaagtgggggacaatctatatattgcctcagatatcactgggatccattgccctcctaactaggctccctgggtccagtcatctttgcctttcctccaacttctcccccatgtcacctacctcctcttttctctacccccaccaaaacagtacttcatacatccctagtattgtctttaaatgtaaatctgatattatttaactatttgaattctttagtaacatcccactgctggcaggaaacaagtcctaacttcctagtataaggaatataaggtccaatgtgatccagctgctccctgactctccagtcttacctcctgtcacactaccatggatcaagccccatggttccctttattctctttcaactctgtattttcgcatatgtgactttcttctgctagtaatgccctttcttaattggcctgtacctttgactcctacacttctgtattattaggctatagcactagatgtggcttaaataagttagattatttgtttatctgatagtccggacgtagatgctttccatgagatcatccaggaacccaggtagcttctgcattggactgtgcttaacatgatgcccctttctgcatgatccaaagtggctttcaaccacagcttccttcaaggcagcaagatggagaatagatgaagaaggaacacaccttctcccttttggtgctgtgactaataagaaatatatttttagtttctgttccaggtttgtgacacagagctcctaaaagccttgtaatttccagagtgatcaacattctaggagtatcttttgttgtactatttagactttgactctggttcctaacagagcttctaaatcccttggggtttcctaagcgatagagcatcttttgctttaatgaggcgactcttgggctcctggataacttcagaatgggagttggtcagaatgggacttggtcactagaaagaccatgtgatggatagcagctcagaattttcagccctactccccacatccacccaatccaccaggaggggagagaggctggagattgagttaataagcaatcatgcctgtgtgatgaatcatccctaaaaatccctgaaagatggggtttggagagctcccgggttggtgaacaagtggaggtgcctggagagggcatgaaagctccccaccccttcccacataccttgccctatgtacctctttgtctggctgttcatttgtatttgtattctttataataagccagtaaatttaagtagagtgtttccctgagttttgtgagccattatagcaaattatcaaacctgaaaaaagggggttatgggaacctccagtatgtagctgatcagtcagaagtatggaaggcctagacttttgattggcatctgaaatgggagcagtcttggattgaagccttaacctgtgtgatctgcccttactccaggtagttagtttagaattgaattgtgggacacctggttggtttctgaagagttagagtattggttagtgtgggaaaatccctcacacacgtgatgtaaaaattgtcatgagtatgcagaaaaaagtttttcccctttagtggcagtttccagagtttgtaaatatctctgcttcccaatcttttgtgcctcctgtctgtctggtactccacctctgtagtaatggcagcagcagcaattctagtagtagtcacagtggtgtttctctagtagaagctgtaatagtagtaggaagaagaggtgtaggagtagtatcagtatcataatttcccattcctagtttcagaagagattgaaaggctaagtgacatgcctgaggtcacatagttaataagtaaacggcaaagctatcgttctgactgggagctctcttacttcagagctcaccactagactgtgggtagttttcaatccagtcacactaaatgccagttatttccttacatgattacctctcccacaagattcagaacttcttgaggaaaaggacatatccaactgacctttgtatctgtagagcctagctccaaggctgggcgtatccatcagttttagacattgaaatcagggtttcttaaccttggcaccattgacattttgggccagataattctttgttgtggggctgtcccattgtgcatgacaggatgtgtggcaccatccctgacttctacccactagttgccagtagcacatatccccacccgcagccagataaaccaaaaatatctccatgcattgccagctatctgctgggagacaaaatgtccctgattaagaaccactgatttaaattaaatgaaggccaaggagccttgagtagtgttcatatccgaaaagggcattttcagaattgttcaggctgctggatctctcaaagatgatgatgtattttccaggcctcatgtgtctggagcacaggttgcctgtggtggtggctgcaatgatctcagtgtgccaggccttcacggggaataccagagagggtccctctggagcagctcttactgggtcatggagaccatctgtctggcatggtaccacctggcaaaatctctttgccttaaccaaaaatatgcttttgtaaatttcctggcaaagcaggggctgcattctgtttcctgatttctctcttttatttccagatgtgtcactggtgacacatagagcccaatgagaactctgttggaaactcaagtttctcattcttcgccagctccgttgtcatgattttcccaccgtctaagccagtgtaggttacgttacccacgtgctggttagtgcttggatgtcagttttcctttttaaattctagatctgtagcatgctttagggaggaaactttatggcttattacacaaatggagttaacccttccctgctttgcagtgtttttgttagtgacagagacatgaattcaagatctgccatttattatttgtttcattttggacaacatgcttagcttctttgatccttgatttgtttaccttcaaaacagagtaacctacctgtcctgtctacctccatgggattattattaaaacacaataagataatctgctcaaaaggcttaaactccctagtatgatttactatcagtataccttttgcacccaagaaaactctacagtatcattgttcatgggcaccaaattgtaagttcagttaaggcagactttgtgtctttttctgccagtttctaggacctagaaggtattcagtaaatatatggtgaatgacagtatgaaaaaaattgggaagtcagattctgtggttcattgtaccagtgggggctggagggaggtaagtgaatggtttgtgtggctttgtgtcatttgtatttgtgacagacattccaagcaatagcattttcaagggttcacaagtgagtgcctgcagaggcaggacacacttaacactctggcagatatgcgacaagacagggtagggaggggcccaagggaactagagagggcatacccagctgtcttagtcattttgggctgctattaaaaaatgccatagactgggtggcttataaacaacggaaattatttctcactgttctggaggctaggaagtccaagatccaggccccagtttattccatgtctggtgaggactcacttcctggttcataggtagccatctcctctgtgtcctcaaaagacgggaggagtaaatgagctttctgggatccattttacaagggccctacttcttcatgacctaatcacctcccaaagccccccccacctccaaataccatcaccttgaggattaggtttcaacacaggaattttgagggggggatacacacactgtctatattgccaacctaaagacattcacagttacacattttgaagtctctgcatcagctaaacaaaatatgtctttgggccaatttaagtcttcagacaaaaatttacaactccttattgacagagtacctaatataaatactgggacagatgcggggcagataaagatgaggtgctcaggatccggcagcagtgatagacaggaaattagtgagacaatgagaatatccaagatacatggagagcttagcccagcactgtccaatgtcctttacaaatgacaacttgtatttaatcctcacaacagcccaatgtgagttagtggatattatgtcccctgttttataatgaggaccctaaggcacaaagaggttgatattttgccagaggctttgaagccagtatctggggaataataaaatgcaacgtgtatgtccaatgacaaaggaaacacagaagccccctcttagatctcactacttctactcctgcccctccagcccctccatttgaagatccctgagggatctgaaaatgcaactttgatcgtggcacagaccagtcctgaggttggtgcagtgacatccccatgccacagaggccctgtgccttctggacgctgcctctcttgccagccttgcccgcccctcatgctctatgctccacttcacttgcccagacagacaagcactttgcccctttgcagccactctcccctttgcctgtgtctccttgttatgcagggcctttcttattcctcaggcctcagatcaatgtcacctcctcagagtgggcctttgctgcccacgctgcccaaagatggcctactgggtcactttcttctttgccacttgcttatttccttcctcacgtgtgtgcctgcgtgtgtgtgtgtgtgtgtgtgtgtgtgtgtgtgtgtgtgtgtattttctgatgcctccacttgactgtaagctccaggagtgcaaagatttttgtcacgttcactgctgcatcccattgcctgagacagtggccagcatgaaggagatacacgagaaagcaatgtgtgtgcactgagtgagcgagcacatgggaggagctgacttcatggggcagattcagtcagagagactgtggctggcctggtgtcacattggtgagaagtggcacagtcgggatttgaactgatcatgacagcatctcgcttgaatcccatcattgcctccctaccgcgctcaggttggactccctggtgtttaccatggacaatgaatcttgatgtctggcccctgtagcacttctagcctcttcaccctcaattgtctgcacatcctcccttgcccctttctatctgcactgacttcaccgtccctcagtcaccccaccttctttctttccctgctcttccttatgttctcttcccacggcaggcaccctctgcccttctgtttcatggggctgtctcttcattgtccctgaaatttgaacttcagtcctcctccccccgcaaacttcttccaagcccatggactagactagaaccccctcaagtgcccctcattgcatttatcatggttgtaactctatagttatttttgtaatttattgtcttttctggcttttctgcccatggcccctacaacaacagcatgttcatctcattcttcttctgccctggctcgttaggtaggaggtgcttacataaacgtttgtcaaggaaatgaataaatgaataaataaatgaataaattgctggatgaatgaatgagagtaagtgaatgaagagttcctgaatttgcttttatgccacctcccttctctgggaaatttcacacaggataggatttctctggcatagagcaacacttctctttgtagatctcagcctgtgcctggagactgggtaaagttgaatgacggggtgcaggaagccttgtgttgtcttgtcacaacacaggaagggaaagtactttggcttttactgttgtaaataggactaaaagtagctcttcgggggtgatctttgtttaccactgcctaaggccactgtccttggagaaaggtcaggaggtgggtgtttacaagttctgtccaaactctcccatgacactatgccacaggccctcatttccctgacccattgttaattagagcagaggaggaacttcagatgctgagtttgtctttgaagaaggatccagaccctaggatgtcatcctggagactttgctcttccttatccttcatacctggtcctccaccttcctgacagtttctcttcttcctcatggttattgggagatagaatgggtggcagatttttattgtttcctgaggagccctgtgctttaatttccattatgtgtgaagatgtctgccatgaccaccaggttgggtgttctgctagattggtgtttgggagccagttgtagacagagtcaaccagaatataaaaagtgtgagtgcagagataaacccactcctgccctataacgacagtaacaaaactggcccagtggtagagctctcatcacaggccaggcactgcgctaagcacgcagtctgcacccctttagactggcccattctctggaaagtttcaaacatacacatcagcaaagagtataatgaaatcctgtgtacccattacgtgtaggggctgaaaatgtatttgccttgatcctgctttcaaagcaatgggtctagtgactgctttgggggaggagttagggaagtgcttaactcatattaacactgatattataaatttacagaatgcagctcgctctggagattatatctggttatatatgtgcacatatcagtgattgctatagtcccctggtaaggggatatatatttaacttaaaatgttctgtttggagtttttacataaatgtcactaaatacatgaatatttcagacccccttcccagtctagagtagtattgggttaagggaactaactgttttgagggaatctgagccaatttagtctggcaggaaaatcatgtagtgaagtagtgaggcccacatggcctctgaccagtcagggagagatactgaagttttacaagagaccatttaatgagagattatccataaaacttgatgcacagatttcaggagaagtctttttagtacttatgtgtgtgtgtgtatgtgagtgtttaaatgtggcaggctaaagtgaagaaatacgactgctactgatagtagctattgtttattgagggccagtatatgggtcagttgctgtgccaggaggtcctttgactacagtctattcctcaccaaggcttttagttcattgttattaccaccattgtagatgtgagaacatggagagtttcagagagttgcccaagactattcacataacaagtggcagggctggaatttcaatccaagttagcctgtttgcaaagcctttgccctttccattagactacatagcatcttaaaatattctggctgcttacttgagaggtaagtatcagttgggaacttactcacttccttctttgtttcaatatacaacccagaatgctttacaaattctgcagaattagccagtgctcatgtttaggcatatcatagattttttaaaatggctaatgttgctgttcctctccttgtgctttggaaaaaattttcagagtccgatacctattgtgacaacttttctaaacactcaaagtgccaagttcatcttgttagctgttcttccaccaggcaatcaaaactcatgttagttccctgtggattcattatagtccccgggaaaccaaaagttttgcctgtgtttggcacataccagttaattgcctaaattgtaacttctgagtattaggaattatcttaaaaactaataccaaaatttggtatgatgtatttcaattgagggggaaaatatttggaaatgaatttattttgactctggggtaatatcttttgcttcacatttagaaatttacatactgggttacttccatgacctaaaacaacttccaagttttcttatttcctcagtacccctagctttgttctggatgaggccagtctctgttccaacgcatgatttaaatatacacggttctgcatctttgtctataatgtttataatatttactatctcatgaattttttatatctacttcataatctactctctccctctatttttccttgcacttgacagcccaactggatgttgtctcttaattctttgtcacttcatggcagtttataattctttaatgttacttattatatttcagctacactgcagtaatggatgggcccattttctctcctccagcgtactgaatgggactgtgtcttgtctccgtgtgcctgacaccttgcatggaatttgcacctcatagccgctcaatagattttaattaattgaaatttaaaagggaacttgtgtggttttgtttaaacaagaccataaattagaaacaactattttcatgaatttgaaattcccagaaacattattctttaatactgtacttttgtcgagactgaagagtttggctttatagtaaatgaaatgaatcacagaatcattgaaccagagtaacaacaatactaataaaaacaccagaaatcatctgtgtaatccattcctctctcttaatgccagacagttccccagccaccttaaaatgatagaactctcctttccttaaagatccttttaaagaagactgtcatcttttcccattccacatcatcatgtcttctagccctacaagttaggcagcttctcctcagatgatcgaaaccctcccttactgaaatttatgcttattgctttcataaagatgaaaagcagctgcttttaactgaaaatagttctcttcctaaagatggttattccattattccatatccttctcttccctaggcataattttcctttccatctgacattcctttttgttctatatttccaaaccattgaatactactctctcaacttacggttttttgcctaagaaaacttggactgggtgtgattagtaagtgatcgttgattttagatgtactgagaaatatgtctcacaccattaaaactagtcgatccagccaggctggtgggtaactggaatactgtgacctcaaatgatatgtggtggtatcttttaaagcctgccatcaaccattcccatctcagtttctccagttgcttaatttataagacataatttatttgttataaactgctttgcaaggttcaaaaaaaaaaaaaaaaaacggaaatgatacacaagagaattagattgaatttaggccattttttccccctcatatctggtttttaaataagccctaagagtgctctcaattagaaaaacacatggtaattctaaaggagataaaaaaggaacatgtacactccaagtgcacttttatcttttcatatttaagaaaccccacaaagctccttcttgcaaattaaagaggatagcaagcaggcagctttctttcctcatttagtttagcaagcatattgatttacatttgagtaggggcctctgatctcttttgtttgtgggtggctttgtttgtttttaatatgaactcatttaaaaactaagcttatggactgagttgcaaaggtagagcttcagtccaacactcaaagtagtcttcctatgcaaaaataaaatagatatttatgtatgtggtagtaggtcaaagaagacatcagtgataactattgattcagtaaatattaaacatctactatgtgtcctccttactaggaagactaaaatgtagaatgtaccatccttgcatctagtgtgcagtgtagtatgggagagagaaataatttagcaggtgatcataatgcaataaatgctatgataggaagcaattaaggcacagtggaggggcgaataacacacctttggatgaattcccagaggaattgacaccagaaggtgattaggatttaccaaggttaagaaaggtgaaggtgtttcaggagtgcgttaccaagtacagaagtgaatggaagtgtgacccattcaagatactcttgagtttgtttcagccagagaacggacaaacaagggaaaacttaagtactctatcctgggttcctcaggatgcacactttaaggacgttttgcgtttttctctggtatttatttattgaagttctcagaacctccacagagctaatttctgtagccttttgtgctcccataaagctttatatatgtacccacatttaaaactttcttacaatactttttgcatttcctccatatgtctattttcccatctactctctgagctaatcaagggagaagacctagtactcacgtctatctatctgcagtgccatgctgagtgcttgcagaaatgtgtttgggaatcagtgcatctctctatgaatggctagagcattctaagtggttttgcttctaactgtgcaggagggcacagtttgggcccaatattggtttgcaaattcaagataagaaccaagaatttgattcttaactcaattttatgttgacttgagcaggctgaactgggttgcttatgccattatttcatttagttcggataatggctatcaaattagctgacaacccatctcagttccctgtagtattcttagcagtgtcttaaagtgggttttcatttgaacatttctttattatattttctttctcagaagtagccaagagatgatgatgatgttgatgctggggaaaacaatggtaacaagagcagctgctttttattgggtatgtgctatgtgaattaaccctgcacttaaccttttaatgaatttatgagataattactactgttaccttcttaacagatgaagaaaatgaagagcaaggaggatatcttactcactagtgaatgatggcttcaccatgtctgatccaaactgtactttgtaatgccttcttcatagcagcactaaaatctaaaagtctggaagagtctttaggagatcagttattccatttcacatctgggggcaggattatgcttgaactgaatgccttggtccactgcctgaaatgtatcctctacaacctttgtccacctggtgaactcctactcatatttcaggactcacaattcaagctgctactcccaagtgaagcttccttaatattcccaggtagagttgccctcttcctctgttgttcctcttaaatatcttgtatttcactcatgaaattcaccaatcatgcagagggtatgtttctagaggcagtttgtatagttgtgaaaggtatggactctgcagctaattgtttgggttccaactctagctctacccgtattagctaaataatatggtgctctcttcccctgacagactgttaatcccttgaggccagataatatttacaagaatttcttaaatggctaagtcacaaaattgtcatgttttttaccttaatagcaagtctgaatgtatcctccttctgaagagctgatgtattgtttctgctggtttctgcatcttgatccctgaaagatattgaaaacctaattttaaggccattttcctgtttgtttgtttttgtttttgtttttgtttttgtttttgttttccatttctgtttcctttccctcttttcctgtccttccttagagacaggacatcttgaaaggtacgaaatcttcaggtctgtacttctacttcaccaacttccttttaatgtttttacctctttgtcttgtgtggaaaatcttaatctgactctttctgctttgtgtcaaagggatactgttcatgttaaaattctcagctctgagaggtatgtgagtaggccgttccttgggtgatgggacagttgacatcatatctgagaagagcatcaccatggtgccctttacttatggccgttgtcatgatgacagtcatagccacctggagcacagtggcctgacaaagacaggaataggaagagggaaataattcgtccaacacttttgtattttgcacaatgggaaaagagtggcatcatttctagatcctaaaccaaaattgatagaaaaagaagactagaatgataagatctgctaaatattctcagggggttgaagtatcaaatatctgcagatggtatcactgagcaaaatcaaggagagcagtttaggatttttagtatgagggaaatgataatgcttttcagtacttcttagagttgtcagtgtctcataaaagataaagaatatttgttgagtgaccacaacttgctgggtactgggctacactacagtatagtatagttattactgagaatttgtagagataatcctagcttatcaaggaaatatttgttttataatttgttcaggtgcttatttatattgaagaatattctcaagttaagatgatttttttagatactccagaggccagaattaatcataaagggccctaatagccaaaaagaattgaaatgcactaggccaattggcagacactatttcagtctgctctctttcatcctttgccaggaattgtacattatctctttaaggcagagcagccttggatgaccatatattaatatgataacttgcttttccttgctccccaccccccaactagtggctttagaatagctttgctatttttcacttatttcttggcagtagcactagatcccaggcttaccgattatgcacactttagataactttgggtcagctcagtactgaacaaatggcaagtcaggaatgccattaagactgaagaatgttggaagataaggattatatagacaccactgtccttatacacactgtgttgtcctgtaattggataggccaaaatgagttgacactggaagaggtattttaatattggagcttataaaatgtttagaaatgttttcctatctgagtcagactgagataggtatgtatgttttctgtctcttctgagtgacactgggaaatagttatgattgggaataggccttggtaccaataacctcatatatacactagggtagaccttgcagaggaagctggcaccagggcatgggaccgtgaagcaaaggggttcagaagaactagagagtggtccaataatgagtcttcagatggccagaggcaaaggctgagatcaagcctcaggtccaagaagccagaatcataagcctgaaataattgagtgagaaacccaacattactagaatggagaagaggctaggggaaaggcaggagcaaacccaagggctgggggtctgaagatgttaccatcacaaggcagccccattttaatggcctctagccacagggtttgccattaaaaactgtaggagtagacagatgcttgatggaaacccttgaccccgggtctttgctcccttaatgaaggaatctaaggcaaagtagagattctttttttaacatttaaactttatttttaattgacagataataattgtacatattcatggggtacatagcaaagtttccatacatataatgcatagtgatcagattaattagcatatccatctcaagcctttttcatttcttcgtgttgggaatgtttaatatcctctttctagtgatgagaaactgtataatacattattgttaactgtagtcatcttacagtggtatagaacagggctccccaaccccatggggttctataccactgtaggatgactagggttaacaataatgtattatacaggtactggtctgtagcctgttaggaatctggctgcacagcatgaggtgggcggtgggctagtgagcattaccacctgagcatcacctcctgtcagatcagcagtggcattagctcctcaaaggaacaggaaccctattgtgaactgcgcatgcaagggatctaagttgcacgctccttatgagaatctaatgcctgatgatctgaggtggcacagtttcatcccggaaccttcctcctcgcaacccccacccatggaaaaattgtcatccacaaaactgggtcctggtgcccaaaaggctggggaccgctggtataaaacagagtttatttctccttatctagttgtaattgtgtatcctttaacagatctctccctatctttttacatgtcctttgataccataagctctatggacaccctataatatttcttcattatacttacccttcatagtaattactagagtgagctcttcatggatttttctcttttactagactctaagctccacgaaggaagagataatatctgtgcctggtacatagtaagagcctaataaatatttttggaaggagggagagaaagagggaggagggaaataaatggctcttttgctccttttcttcatgccagggcaacactcagcttctgaggtatgcacagcaaggatcttgctgagatgggtgtggccacttgcttgcctcacttccagccctgggcacatgcagttctttctacctggtgcagtcctcttcctccctgctctggcacttgcctctgcttccacttctgctgctgcttctttttctagtctcctgcagcctaatcatcctcttgacacattctttctttaaccatctgaatgccttcagtatggttcctgtgagctctgaatgttctggaagccattgttttgttttgataattttgaatattttactcttgctcattatggattaactttacagctgaactctcaaaaccagacttcattttcccaacttgagagaacatctcattgttgtccctgtgtccttgcctatggcacacatctcccgaacacccttttttaccagaacatcctcacagcaaacctaaggcagctaactgctttctacagctctgtgtttcttgacctcttccatctgttttattttcatatttttcctttgttaaaaaaaggagataacagacaagaaaaacacgagaaattaaatacctcaaaattactgtacattttcacttggagtaaccagtctttgtaatgttttgtaaatatctttccctgagtgggcctgaataagcatgtagttaacaagcatggacttttaattgatcagggcaggttttgaacttctgtcctgctctttcctaatgatacaacctccaatgacttaacttctgagcctcagtattctcttctgtgaaatggaaatactaataatagtatcctcacaagtttgttgtgatattcagtaacccacataaaatttctatgcataatgcctggcgtataataggcactaagtaagctgtcacttgttttctttactttcctgctttctctcatattgcctctaattagtaccgtccttattttttaggggacagatccaaatccgtgaatccaggggcttcatcacgatcttggaatattttggtggcaactttaagatcttttgttttctgactcttagatctctttcttttggtggcatgggaaaattccctcaactcgattatttattcagttctttcatgctccccatattgtcatggccacgtttgaatcatgttatcggcaagtctgaccgaaaaagcaatttaatattgccctgtgttgcatcattgcatatattatttcagcctgtcacgggcctgtcagcaagtcttgatgaagtacagagccaatagtaacaggcctgaaatctgacagctctttaacagaagctgctccgattggtgcagtggtatttcttcagaaattaaggccttcttggtctctttgttgatacaattagcaatccaatctgagtcattttatctcccaatgagctgtatcttcagggctggtaattcagtctgttgcatggcttggaaaaacagagccatcagaggcctgtgatgtaccaaaggctgcagccaggaatatcttggtaatttatccccactctcagctctaattattctgttcttcactggctggttcgattgagactctccaggttcagccttccctaagcagagaacaaaaggtttcccttgaaagttggggcctggcaatgtcagtacagtgagctgcgtataaataatgcagcagtgccggcttcatttttataaaatcttggtggagaaatgcatgagaatgatcaggcccctggaactcagcaggcatgtgcttttgatgtgcgccttgctctgagtaaaagcaggagaataaaaagttcttgtttgtgctgaggctacttcatggtctctggctcggattttggtgaccctttcgctttgtttctgatagagtctggaggctcctacctaactaggaaaactctgatatgtatatagagggaaataccttcagtaactattttctgattgaaactaaagatgatgaaaataaagatggtgattatagtagctttacttatattagctttacttacattccctcattttaatcttcctaaggttagagttatctggctaggctattttctctataccttctgctctcccaattagccttatatcttttcttttttctggtcagattccccaaaaataaatattcagggtgtgaacctagcagccaaagctctgggagctgagtcggggaaaggagcttgagggctggcctgcaaaaaagcagatactgaatcagtctctttttgtcaagatactctacccttacctggaccttttatcgcaccctatctaagggtggatgctatggtttggctgtgtccccacccaagtctcaccttgaattgtagctctggtaattcccatgtgttatgggagggacccagtgggagataattgaatcatggggctgtttctcctcctgctgttcttatggtagtgaataagtctcacaagatcagatggttttataagggggaaacccctttcacttggttctcctcctctcttgtctgctgccatataagacgtgccttttaccttccaccatgatggtgtggcctccccagccacgtggaaccatgagtttattaaacctctttttctttataaattacccagtctcaggtatgtctttatcagcagtgtgaaaatggactaatacattggaccttagtacttttcttccgtagtgtgggagaagtagtaccctggttgctaatagtgaggtcacatgggatctaattacttcctaaacatactttttgtaccatctgctgtttttagcctcatttttatcctcactttcaggggtggtgagcaccaccacctcctgaactttttgggtctctgtagggtaatcattttgcttctgggtttttcctgctgctatttaggttttacctttctcaagtctaccaagagagttactactaccatggtttttggcttttagattttcgatgctgtcatcttctatcctgttctcattgtgggtttttgcctctttgaaacattcttgtacaaccattttgttggaatttttaaagggcacagagttcaacacgtgtagtcaatctggcatctttaatcagaagcctctttttgtttttgtactttttgaaataggaaagaaggtctgctagagatctggcatgcatttgtgtcttgggcagtaggtggtgggaggaatgtgaggtaggcaaaaccaggagagcattgttggaaggctctcctggttccattgaggttaatggtctatgcaaggaacccagtgttctgcttcatgcactccaggagtctaacttttgtctcttctccagcctgcatacagagcagtatctaaagatctaggctttataatagaagccattaaaaaatgattaggaacctgaaagcttccttctataactgagatctgaaggtttttattcattcacttaattaacatgcattgtgctctcaaaatttgccagagtagcattgtgcttattcatccatataactggatgaaaaaggcagatatggaccctgctgtgggaggttgtggcctgaccttatatactgaaatttccagaaggccagatagagcatcaagaaataaaataaaataataacattcttttatgataatgagatagatccttcagtgcctcctggtcttccccactcatacacactcatgcctaaaatagtccacggttctggactcctttagtgggccagatcctttcatcaccatgggctgctgagaccactggaatttcaggcaaacctataaaacaggggcagctttaggtgaccacattctgtcatgaatccttgatttcatatacagtttttgcattacatgtttgctagtcctaggccaaaacaaaaggagaaaagatctaattttagctgagttcgagttgcctttctaaaaattatgatttcttctttatgagtctttttggtgaattgacccttttctcaatatgtaatgtacctgtttattcctggtaacatttcttgttctgaagtctactttgatattaatatagccacctcagcttattatttgtatctgcatgccttatctatttatttattttttgagactgagtcttgctctgtcccccaggctggagtgcaatggcacaatctcggctcactgcaacctccaccttccaggttcaagcaattctcctgcctcagcctcctgagtagctgattacaggcgcacaccaccacgcccaactaattttttttgtatttttagtagagatggggtttcaccatgttggtcaggctggtctcgaactcctgaccttgtgatccacctgcctcagcctcccaaggtgctgggattataggcgtgagccaccacacccagcctgcatgccatatttttgcatctttttactctttatcttgcatttttatattgaaaataagtattttttgtttgttttgttttgttttgtttttatccaggcactgcgactcacctcacacctgtaatcccagctactcacaaaactaaggcaggatgattgcttgaggccagcagatggagaccagcctcagcaacatagtgagacccccatctctaaaaaataaaaaaaagaaaaagtaatctgggcatggtggtgtgtgcttatagtctcagctacttaggaggctcaggtggcaggattccttaagctcaggagttaaaggctgcagtcagtcctcatcatgccactgcactccagcctgtgtaacagagtgagctcttctctaaaaagtagaataagtttcttttaaactccatatagttgggttttatttttattcagctttattatctctgccttcgcactggagattttaggtcatttacatttattggttgggttttaatctattttctttttctgtcttccatatattctatataattattcccttttcctgtattctccagattacttaaatatttgttagtattccattttatctctaaaaagttttacctcttgccagtttctaatatgcgtctttcacttatcacagtcgaccttaaaataattttgatgcctcattatatataatacactttcatatcttcctgtgatttgtgctattattctcatatgatttgttcatgcattggattgtataaagatttaaattcaatttttttaaagaaatttatgtctgttgtatttactcacatatttagcagttctgatactcttcattcctttgtgtgtgttcacatttccatttggtatctttaacccatgtagtttctgcatgaattataaagtattctccttctccctcctcctatatgagtatacagaattgagtttgttgattgtattaacaccctttaattccccagtagtaataataatagctattattactcttatagtttacatgtctcttcacattctgaaagtacaatcacatatttaaatagaattgtcttttttcaaatgctttttaaattttagaagctcttgtttcatatatttcatactacattgtttggttcataaaatattatgaatggtagttttcttggattgagcattttgtcattatgaaatattcttcttttccttgttaaatatttttgatcttgattctactttgatacttatattgtcatttaaaaatttttttgtttgtatttgttgtagaacatttttgaaagaaaactgaatcacattttaaaaaatctgaattataaacaaggtatatagcttaattttaaccacagtatgattaatcttatcttttaactggttgtggaattcagcccattcacatttgatgaaatactgagataattgaccttatttgttccatcttattttgttttctatttatattacatcactccccattccctttcctttttgttttgtgtggtttattggtttcactggcttgttaattttttctttattcccttttattccttgttactttgagagtcctactaagtgttttgtttctactagtggttacattctcattccttataaccaacaataaacttatgttctgcctaaacatgtatatgtatttcaaggaacgttttctgtgtaccccttctctagactcttacttaatatttgcttacttaatgtttattttcagttccagactgttactaagttttttttgttgttgtttgttttttttttgtagaacagcaagcctattgtattttaagaaaactcaatattacagattcctgcttacattattattatccacttagatttcaatacgtatatgcatatatttttatgcatatatgtatatgtttaagcatattatgcacatacatgcatatatatacatatatgcaggaaagagacacacagagtgagaaagggtctcagtgtctactggttcctctagtctttgatttccaccatattgagaaagctgctctgaatcaattgttatttggttatactctttctcaagtattgtcctcagacagtgcttatgagtttactttttgaatccttgtgtgttgaaaatgttttttttgcctcttacagctaaataatattttgtctgggtataggattctttaatcagtttctcgtaatagtttgtacattattctagtgtcttctacattccagagttgtagatgagaattcccttagctaggattaatcctttgtaagtaacctattctttctgtctggaagcttgtataattttctgtttactcttgaaattcaagtgtttcctggatttacttcctggacttaatgagacttttaatctgtgggcttaaatcttacttcagttcagtataataaaatacctagccctgtattcatttaattacagtatctccctcatttgttcttttctttttttttttttattccttttctctctcctaaaaaacacaaaatctgttctggaatttctgttattctcatgttaggcttctggaatctgtcctccaagcctcttatctcttccatcattatgtcaatctctttgtatctttgctacttgtagtagcaaagtgggagagatggtgaaatgaatgagcaaagacagttactatggtaaattaagataaagataaagataaaattcagatgtcatatgtcatatttcatttacttggtcttccagagcattaatttgattttcattagtgtcagtgattttttagttcttctgtggaaattttaaacgtaaaatcagtatttatacttccagaaagaattttttgcattcttctgatttctcattgttttcatcattaaaagattctaccatatttttcatcatttctacttctgtgggacttgcctcttgtagatgttctatgtggtctctcaggtgaactactcccattaagttagttaatgtttttgttttgcctactcattgataaatgctattttgactttcatataggtttttagtatctattctgcattaacaagtctgaaagcagtgaaaggtacatcagttcctgccctggcacttgggctggcagtcacccaaccggccaacagcaagtggccccttctttcttcttagagcacccttggtggaagcagcactcctctctagctgccaatcttagaagcaactcagactgccagtgtagccctgactctgtagggcccctatctctaattctaattttacaaacctttgggtgggggtgactagtaggtacagcttgcctaaaggtgaatagttatccaaagagggcaagttgctaaaacacttcaggaaatgtcaaaactggtcttaatagaagactcccggaggggtaagccctttgttctgctgctagtaccttgcctttacccactaataatatgaacaaagtcctatgttttctttccctcctggagagttttggagtacctgtggcttcaattgtactcactaaactttaccagttctgctgcttaatagcacgtccatattacccatcagtttgatttaaagaaactcaatgaattggaccctaatattgtttgaataatcccaatgaaggagggagttgccagaggcatctgtagccataaaacttctgtagtcatcttcactccaggcatactctcttattttaacttcttgtaaagaccaagacatccctaactttccctttattggggaaaaaatctgcttggaaaaacttagttatgctgtgaagtgttgagtttttaaactattgctgtattatgaaccacaaccaatgcttgttagtttaatacagtaatcatttatttgactcatggacagctcatttaggctgtgctgtcctaggtgatccttctggtctcagttggactcactcactggagtcttggctgactgatccacgttgatccaagacaacctgggggtatctgatccagattgagctcagctggctattgccctgctccatgtttctcttatcctcctcatgggaccagtggactagcctagaatgatctcatggcagtgccagaggtgcaagagaacaagcagaaacacatagaatctcttgaggctcagactcggaactggcatgcagttacttctgcttccttattttggctaaattcagtcatgtgacagaatcagaagtcagaggtaaggaatcagaatcagaggtaggaaaggaagccctgcctacaatgtgggggacaggaggaggagggtgcagtactacaaagttacatggcaaagagtgtgggtatgtggagacatgaagacttagggccatgaactcaacctttatcagctgttgagaaatacagtgcaatattttaaacttacaatggtacctcaagagagagagccacgagtttagcttggaggtagtagagaaactttcacagaggagctgacattggaactggaccataaggacaacctggagtttaccaagcagacaaagataggtgaaaggagtaataatccattaagatggaaggagaagtcaaagtagaggcccagcactctacagacaagaatgggacatctggggatttaggagttaccctgtgtgattggatcattggaaacaatccttctatactgccttttgctccctaatattactcttgccagggagctatcgtacctccccaaaagttggaatttcagatgtcatatgccaggaggagttagcatattgtatactcttcagaacatgttacataggtgggctgccttctccacttattagagatgtatgttgcttaaaaaaccgtgaataatttagcatgtttctagaagtgcttgcattccttcagtatatttatgccacttagcatagctcaatgtgttctgtgatctgtgccacatgtaaaaaaatcattaatgataagtgacatttgttggctttcaaaagacatttaagcctcactcagtgctacctcctctatgaacccctccttgatatttcctccctgtctcccaccagattatgtcaggttcttctgctaaaggctttcatttctccctctacttccttcagagtattcatggctgtttgttagtatatgattttagttgtgattatttgatcaatttctgtctccccaattaaactttcagcttctgtgactgcaaaagactagatattttgcataccactggtttcctggatcctagtatagtgccaggatcatagtaactgaatattaaacatttattaagtgagtgagtgaatgcatgaatctatgtgagtgactgaatgagatacatctagactattgtccttgtgagataggttttgggttatctttaaaattgcatgagctcccaggtttaccatttacctaccatgtaatggacaaacgattcattctttaatgtttccattcagtcagtgttcattgtggcttgtcataatcctgaatgtgaatgaggtatttgtgatacagagaagagtaaggctgattctgggctgacggagttgctggtttagtgggagagatggtgaaatgaatgggcaaagacagttactgtggtaaattaagataaaggtatgtccagattggaacttggagaagaagcttttcactcagtctgcccttcattggggcttcctgaaaaaggacaatctgagctgagtcatgaaggctaactaagagttagatgcataatggggatgactgttccaggaagaatgaagcaaaagggttcagtacacagggaagtgggaaatcaaggctcactatagcaaactccaaataattcagtattgcagaatgagaaggcaagggtggggatggccagaacggagtgactgtggagatggacacagtcatatcacaaagggttctttaagccctgctgtgcattggactttgtcctgaagttagagcgtagcaattgaaggatcttaatcagagattgacataaaatattttattttataaagtttgccctgggtacaatatggagaacagattataaggcaataagactgtaggggagcaatatgaagaagcagttacttacccagcatgataagggctatggtagaagacatactccatgctctgggaaatcagaagaggagtgcctaacccagaactggaatctcagcctaggctaaagtaagagtttgaattatcatggtgaagaagctgggatgagttttcccaacagatgggggtagggcaaaggcactgaagtatgtcagaacatgactttcttcagagaactgtaagtaactttttattgttagactacagaatattaagggtaaattgagaaatgtagctggaaagcatctagcgttcaagtcttcctcctattaaatattgccttagactgggatgaccatactctttattatctccaccagacactttaaaaacttttttttatcatagaaacttttgaacatgtagcgagagtagtataattaacacccatgaacccatcactctgtcccaacaaccacccatgaccaatcttgcccttagccacatgccatttacttctccttctcatgttgcttaaagcgcattccagataccatgtatcttatacaaacattttcagtatgtatctctaaatgataaggagccttttgttaacataaccacaactaccaatatcatatctaaaatttcataatttttttatcaaatagcaaggttataatttctaattatctcacaaatgtcatgtaaacgtagatgtaaatacgaatattcatatacagattgtttaatcaggatccaaataaaggactgaaacttttttttttttttttttttgagacagagtctcaccctgttgcccaggctggagtgcagtggcacgatcttggctcactgcaagctctgcctcctgggttcaagcaattcttctgcctcagcctcccgagtagctgggactagaggcatccaccaccaagcctggctaattttgtatttttagtagagacggggtttgaccatgttggccaggctggtctccaactcctgaccttaagtgatctgcctgccttggcctcccaaagtgctgggattacaggtgtgtgccactgtgcccagccagggctgagacttttgaaagtgaaggaaggtactatccataattaacaggtatccatggagactttttacctaagcagggatgtgtcattatctacactggcttattccacttctttaatacctctgcagatacctggacgggtattttgcaaaatataaaggaagcctcactcatatggtcagttctatctatatctcttctattttcttaggtctctctgctccctggtgtgtaagtggacatattcagcagagaaaggctgggacgacagtttctggaaaatgattggtttggaagactttgttgcagataattacagcaaaataggtaaaagaataaaacatctgtagagtgattatgtgcattggaggatcttgatgggtttgttgttattgtggtttgtatgtttcttgtttttgtatgcatgaaaatacaggaatgaagttcactttttccaagacaaatgagttaattatgatgggtaggccatgactagtaggctcttgccttaagatttatatgaactgagtagagatacatgctatgaaaatctgcattgaaatatagaatcagaaattgcgctgggcatggtggctcacacctgtaatcccagcactttgggaactgaggcaggcagattgcttgagcccaggagttcgggaccagtctgggcaacatggtaaaaccccatttctacaagaaaaatacaaatgttagcctggcctcgtgcatatgtctgtagtgtcagctactccggaggctgaggtggggggattgcttgagcctgggaggcagaggaggttgcagtgagctgagatcgtgccactgcatgcagcttgggcaacagacagagcagaactctgttttgagggggaaaaaaaaatgggctagactgaggaagatatttgcaaggagcagcttgggaatagcatactcaaggggctgtgtatggactgcttccagtcagtactacgaaaataattttacaaattaggttcacaggacaaggcaaggctgtgaacaggtaaaaaataaagctaaaagatcaatattagaaaatctagaaaaaagcagaaactagaacgagtcagtggctcctaactaaggccttagggtctcagactaaggccttttatgtgggtggtaaagtacatcttctatgtcccaagcacatttctctgtgcttgtatgtaccttgttttatatatttctcacaactactgacaaaagcactgttgcatgtttacagatgagaatcagagagattagtaaccttgcctaacctggcatggaatcaataaatggtaagtcaggatcgaaattctcccaatgggaggacctagaaggaactaatattttactggaacacaaatttcagcttcagttacctaatggtttaagtgatttgtaaaatgtatatgccctccaaaaaattagttgttttttgctgaatattcccatggtatgttgttaaacatagctttattagtgtatatattgattacctgtatatgtgtcttgattcctcactagactgtgagctgtttgacataaggattttcacttatttacctttgtatttcctgtcctagcacaaggcatggcatattttcatatctcagtgactttttgattaaaatattgagatgcttggtactaggaggttggcactctttcctttaaaaatctgtaatgatatttactgattttaacattatctttggcaattgggtataacttcaactctgattttctgattatttttatatttttctgctcctctttcctgcctcacacatgacacatgtttaattagtatattagctctgctaacgtagcagtatctacaagaaatattcattagaagtccataatgttaatctagcagaaaatttccagagtaactttattagattttttccctgttaagttaatggatttttaatggatttcctaaggagacatatcattaagcagaatattgctgtacgtgaattagaacttacccatttatcaaaattaattgtgtgatgtttcctttgattttcgcttctggacacttgagcttgtagtttcagtctgaacccaaagtagaagatatttaagaggctgtttattctcagttgtgactttcagaaactcctctggaagctacctctagacattctttagcaattcttggaactatgaaagatgaatctcagaagcctccctatgaagtgttaaacatttccagtggcctcattgcccgtcaagatgtgggcaatatagtgtgaaaccttttagcagatttgagcattgagcgtcctggatttgagcattaatacaattaccataatttgctccatgtggagcttttagccaagcctttaccaggcttcctgggcccatgcagtaaataaatgctttccctgaaaactgaacacctcagcaactgatggtcttatggaggaatatttttaaaatgaattatttatgaagtgtaagttaaggatcaaatgcaatatttatatggtgcatttcaaggacaggagaaaaaatttacagggttttaagtaataacatgcaagtttctaaagctaaaatgttactacctaatgccttctttcaaggaggtatttggatggcttggtttgggaacattcacaaagtaaggaaaaatagttttgtgcatcaaaagaatatagtagaaatttctttacaattgaatagaaatttctttacagttgaaactgtacaagttgacttaatgttcagaattgatggagaaaaatgaaacagattttgggtaggagattatatagccctactgacaaaatgatctgtgttcaatgaaatgatccaacaaactgatctgtgtcaataaattttgacctttaattccacatgaataattccccagttacctatctaatcctaaacatctatcaaaagcaaacaggaaggaagagatcagcagggagaaaggaccttaggaagataagcaacatcccacctgttctaattgattatccaggtgccatttcagcatgccgcggttgcctttttaattcctgggaaaatctctttgttctactattggggtagcccactttatgaaaagtcgtgtgtgcaacatggctgaattatagagtgattatctgcattactaacagggtttgtcatataaagggattcagtgtattagcttatagatcattcctttatttgggaccagggaagccaggcaaagaaaaatgtaaattccaagtccaggaagttagtaagtgttaagtgagaggcagaaatgaagataaagggcaggagacagtttcttgagtggagggaggctgctttttaaatgggtttcctcgacccgggaagcacaaggggtgggggagatttccctttcctagacaagggaagccatgacagactgtatctggaaaatcgggacactgccgcccaaatactgggcttttccaacagtcttagcaaacggcacaccaggagattatatcctgcgcctggctcggcgggtcccatgcccagggagccttgctctcactgctagcacagcagtccgagatcgaactgcaaggtggcagtgaggccaggggagaggcttccaccattgctgaggcttgagtaggtaaacagagcagctcggaagctcgaactgggtgcagcccaccacagctcatctaggcctccctgcctctgtagaccccaccactgggggcacggcgtagctgaacaaaaggcagcagaaacctctgcagtcttaaacgttcctgtctgacagctctgaagagagcagtggttctcccagcacagtgtttgagctctgagaactggacagactgcctcctcaagtgggtccctcacccccgtgtagcctaaataggagacacctcccagtaggggccgactgacatctcatacagctgggtgcccctctgggatgaagcttccagaggaaggatcaggcagcaatatttgctgttctgcagtatttgttgttctgcagcctccgctggtaatacccaggcaaactgtctggagtggacctccagcaaattccactttatgaaaattcctgcagctgaggaacctggctgttagaaggaactctaacaaacagaaaggaatagcatcaacatcaacaaaaaggacatccacaacaaaaccatcatcaaagaccaaaggtagataaaactataaagatggagagaaaccagagcagaaaagctgaaaattctaaaaaccagagcacctcttctcctccaaaggatcacaattccctgccagctacggaacaaagctggacggagaatgactttcacgagttgacagaagtaggcttcagaaggtcggtaataacaaacttctccgagctaaaggaggatattcaaccccatcgcaaggaagctaaaaaccttgaaaaaagattagatgaatagctaactagaataaacagtgtagagaagaccttaaatgacctgatggagctgaaaaccatggcacaagaactacgtgacacatgcgcaagcttcaatagccaattcaatcaagtggaagaaagggtatcagtgattgaagatcaaatgaatgaaataaagcaagaagagaagtttagagaaaaaagagtaacaagaaacgaatgaagcctccaagaaatgtgggactatgtgagaagaccatatctacatttgattggtgtacctgaaagtgacgggaagaatggaaacaagctggaaaacacatttcaggatattatccaggagaacttccctaacctaggaaggccaacattcaaattcaggaaatacagataacaccacaaagatactcctcaagaagagcaaccccaagacacataattgtcagattcaccaaggttgaaatgaaggaaaaaatgttaaggggagccacagagaaaggtcacattacccacaaaggaaagcccatcagactcaccacggatctctcagcagaaactctaccagccagaagagagtggaggccaatattcaacattcttttgttttgttttgttttgttttgttttttattttattgtattttatttttttcttctattattattattatactttaagttttagggtacatgtgcacaatgtgcaggttagttacatatgtatacatgtgccatgctggtgtgctgcacccattaactcctcatttagcattaggtatatctcctaatgctatccctccctcctccccccaccccacaacagtccccagagtgtgatgttccccttcctgtgtccatgtgttctcattgttcaattcccatctatgagtgagaacatgcagtgtttggttttttgtccttgcgatagtttacagagatatagatcaatggaacagaacagagccctcagaaataacgccgcatatctacaactatctgatctttgacaaacctgagaaaaacaagaaatggggaaaggattccctatttaataaatggtgctgggaaaactggctagccatatgtagaaagctgaaactggatcccttccttacaccttatacaaaagttaattcaaggtggattaaagacttaaccgttagacctaaaaccataaaaaccctagaagaaaacctaggcattaccattcaggacataggcatgggcaaggacttcatgtctaaaacaccaaaagcaatggcaacaaaagccaaaattgacaaatgggatctcattaaactaaagagcttctggacagcaaaagaaactaccatcagagtgaacaggcaacccacaaaatggcagaaaattttcgcaacctacttatctgacaagggctaatatccagaatctacagtgaactcaagcaaatttacaaggaaaaaacaaacaaccccatcagcaagtgggcaaaggatatgaacagacacttctcaaaagaagacatttatgcagccaaaacacacatgaaaaaatgctcatcatcacttgccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggctctgttcacaatagcaaagacttggaaccaacccaaatgtccatcaatgacagactggattaagaaaatgtggcacatatacaccatggaatactatgcagcctatacaccatggaatactatgcagccataaaaaatgatgagttcatgtcctttgtagggacatggatgaaattggaaatcaacattcttaaagaaaagaattttcaacacagaatttcatatccagccaaactaagcttcataagtgaaggagaaataaaatcctttacacacaagcaaatgctgagagattttgtcaccaccaggcctgccttacaagagctcctgaaggaagcactacacacggaaaggaacaaccagtaccagccactgcaaaaacatgccaaattgtaaagaccatcgatgctaggaagcaactgcatcaactaacgggcaaaataaccagcttacatcataatgacaggatcaaattcacacataacaatattaaccttaaatttaaatgggctaaaggccccaattaaaagacacagactggcaaatatgataaagagtcaagacccatcagtgtgctgtattcaggaaacccgtctcacgtgcagagacacacataggctcaaaataaagggatggaggaagatctaccaagcaaatggaaaaaaaaaaaaaaaggcaggggttgcaatccttgtctctgataaaacagactttaaaccaacaaagatcaaaagagacaaagaaggccattacataatggtaaagggatcaattcaacaagaagagctaactatcctaaatacatatgtgcccaatataggagcacccagattcataaagcaagtgcttagagacctacaaagagatttagactcccacacaataataatgtgagactttaacaccccactgtcaatattccacagatcaacaagacagaagcttaacaaggatacccaggacttgaattcagctctgcaccaggcagacctaatagacatctacagaactctccacccctaatcaacagaatatatgttcttctgagcaccacattgcacttattccaaaattgaccacatagttggaagtaaagcaatcctccgcaaatatgaaagaacagaaatcacaacaaactgtctttcagaccacagtgcaatcaaattggaactcaggattaagaaactcactcaaaactgcacaactacgtggaaagtgaacaacctgctcctgaatgactactgggtaaataatgaaatgaatgtggaaataacgatgttctttgaaaccaatgagaacaaagacacaacgtaccagaatctctgggacacgtttaaagcagtgtgtagagggaaacttatagcactaaatgcccacaagagaaagcaggaaagatccaaaattgacaccctaacatcacaattaaaagaactagagaagcaagggcaaacacattcaaaagatagcagaaggcaagaaataactaaaattagcagaacggaaggagatagagacacacacacaaaaaaacccttcaaaaaatcaatgaatctaggagctggttttttgaaaagatcaacaaaattgatagactgctagcaagactaataaagaagaagacagagaagaatcaaatagatgcaataaaaaataatataggagatatcaccaccaatcccacagaaatacaaactaccatcagagaacactataaacacctctatgcaaataaactagaaaatctggaagaaatggataaattcctggacacatacaccttcccaagactaaaccaggaaaaagttgaattcctgaatacaccaataacaggctctgaaattgaaacaatatttaatagcctaccaaccaaaaaaaagttcaggaccagacagattcacagccgacttctacaaagaggagctgctaccattccttctgaaactattccaatcaatagaaaaagagggtatcctccctaattcattttatgaggccagcatcatcctgataccaatgcctggcagaagcacaacaaaaaagagaattttagatcaatatccctgatgaacatcgatgcagaaatcctcaataacgtactggcaaaccgaatccagcagcacatcaaaaagtttgtccaccatgatcaagttggtttcacccctgggatgtaaggcggttccacatatgcaaattaattaacataatccatcacataaacagaaccaaagacaaaaaccacatgattatctcaatagatgcagaaaagactgacaaaatttaacagtacataatgctaaaaacttaataaactaggtattgatggaacatatctcaaaataataagagctgtttatgacagacccacagccaatatcatactgaatgggcaaaaactggaagcattcccttggaaaactggcacaagacagggatgccctctctcaccactcctattcaacatagtgttggaagttctggccagggcagtcaggcaagagaaagaaataaagggtattcaattaggaaaagaggaagtcaaattgtccctgtttgcagatgacatgattgtatatttagaaaactccattgtctcagaccaaaatctcctcagctaataagcaacttcagcaaagtctcaggatacaaagtcaatgtgcaaaaatcacaagcatttcctatacaccaacaacagacagacagagccaaatcatgtatgaattcccattcacaattgctacaaagagaataaaatacctagaaatccaacttacaaaggatgtgaagtacctcttcaaggagaactacaaaccactgctcaatgaaataaaagaggacacaaacaaatggaagaacattgcatgctcatggataggaagaatcaatatcatgaaaattgccatactgcccaaggtaatttatagattccatgccattcccatcaagctaccaatgactttcttcacagaactgaaaaaaactactttaaagttcatatggaaccaaaaaagagctcacattgccaagacaatcctaagcaaaaagaaaaagctggaggcatcatgctacctgacttcaaactatactacaaggctacagtaaccaaaagagcatagtactgctaccaaaacagagatatagaccaatggaacagaacagagccctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttataccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaccaaaagccaaaattgacaaatgggatctcattaaactaaagagcttctgcacagcaaaagaaactaccatcagagtgaacaggcaacctacagaatgggagaaaattttcacaacctgctcatctgacaaagggctagtatccagaatgtacaaagaactcaaacaactttacaagaaaaaataaaacaaccccatcaaaaagtgggcaacggatatgaacagacacttctcaaaagaagacatttatgcagccaacagacacatgaaaacatgctcatcatcactggtcattagataaatgcaaatcaaaaccacaatgagataccatctcacaccagttagaatggtgatcattaaacaggaaacaacaggtgctggagaggatgtggacaaataggaacacttttacattgttggtggtagtgtaaactagttcaaccattgtggaagatagtgtggcaattcttcaaggatccagaactagaaataccatttgacccagcgattccattactgggtatatacccacggattatacatcatgctactataaagacacgcgtacacgtatttttattggggcactattcacaatagcaaagacttggaaccaagtcgaatttccaccaatgatagactgaattaagaaaatgtaacagatagacaccatggaatactatgcagcaataaaacaggatgagtacatgtcttttgtagggacatggatgaagctggaaaccatcattctgagcaaactatcacaaggacagaaaaccaaacacggcatgttctcactcataggtgggaattgaacgatgagaacacttggacacagggtggggaatatacaccagggcctgtcgtggggtgggggaatgggggagggatagcattagaataaatatctaatgtaaatgacaagttaatgggtgcagcaaaccaacatggcatatgtatacatatgtaacaaacctgcatgttgtgcacatgtaccttagaacttaaagtataataaaaaaaaaacatacaaacctattatacttttcccttcttaaatttatccctttctttgatcttacatttccctgtaggctacatcttgttactgtaattccttttattatagagttactacaataattgtcttttactgcctctacttcctatgatgacattacagttacactttcttccccaccactgtactgaaattaaaaaaataataataaaatggatttcctccatccctatgagactgtactttgggtgtcagatgacaaaaacacagtcacttggcacattttagatactgatgaaatattcattgaatgagttaatatatgtttgaattaaggatttgattttttttaagtcccttgttggcttcaattgtttctttcttgttttttttgttttgttttgttttgtttttttttgagatgtagtttctctcttgttgcccaggctggaatgcaagggcatagtctcggctcactgcaacctctgcctcccggtttcaagtggttcttctgcctcagccttccgagtagctgggattacaggcatgcgccaccatacctggctaattttgtatttttagtagagacggggttgctctatgttggtcaggctggtctcgaactctcgacctcaagtgatccgcccccctcagcctcccaaagtgctgggattataggcataagtcaccgcgcccgactggcttcaattgtttctaaaccacaatggactttcgtaaattttttgaattaaataatactactagctaacaggcaatgaatgtatttccttaattcagtgttcactgtcatctttcatgaacaccttctacataagacgggtccctgcagaagatacaccctatgttgagtgatagtgcaattctatttcattcctgtagcaaatctctcagagacttttctatcttaggaaatatcacagactccttcacagaaggaaaacaagaattaatcttagaaaggttgggcatttcactttttcatagagtaaaataaactgaacattaaatgaagctacactttagatatttttgtcatgtaggctaaaaatttgtaagtaaagaatcttggctgggcgtggtggctcacacctgtaatcccagcactttgggaggccgaggcaggtggatcatggggtcaggagatcgagaccatactggctaacatggtgaaaccctgtctttattaaaaatacaaaaaatcagccaggtgtggtcgcgggcgcctgtagtcccagctacttgggaggctgaggcaggagaatggcgtgaacatgggaggcggagcttgcagtgagccaagattgcaccactgcactccagtctgctccactgagcaagactctgtctttaaaaaaaaaaaaaaaaaaaaaggatcttgactaatgaactaatgataggtatatgctggggacataaatgtgccagtgaacagagccacctcaggcaagggtgcagtattggctttggtcacactgaatcaaagttcagggatcttctgcctcttgttggaatctggctagactttggaacctgcacaatactgacttatccacccactggctggccaagaagctgagacaaagagaaaagaagccacctatacttgcctgaagcaagctgcacttgatcagattgattcatgaactcagagcccacaggcctgagtacaggtggctcaagaagaaagtattagttcttttctgctgctataacagaatacttgaggttgggtgatttataatcagcagagattaattcagctcatggttctggaggctgcagtgcccaagggtgccgataacttctgggcatctgataagggccttcttgctgcatcatcccatggcaaagggtgcaagagtgtgggactgcacacacaagaatgagagagggcaagagggggcttggctttatcagaagtgcctcctaagacaatggcattaatccattcatgagggcagagccctcatggcttaatcacatcttaaaagtctcaccttttaatactgtcataatggcaatgaaattttaacatgactttttgttttaatatgctgagcttttattcatatttttttttaacttttaagttcaagggtagaagtgcagttttgttacataggtaaacttgtgtcatgggggtttgttttacatattattttgtcacccaggtattaagcctagtacccgttatttttcctgatcctcttcctcctcccaccctttgtcctccaccctcccaaaggacccagtgtgtgttatccccctcattgtgtccgtgtgttctcattctttagttcccacttaaaagtgagaacatgtgatatttggttttctgttcctgtgttagttgctaagaatgatggcctctagctccatccatgtccctgcaaaggacatgatcttgttctttttttatggctgcataatagtccatggtgtacatgtaccacattttctttatccagtctaccattgatgggcatttaggttgattccatgtctttgctattgtgaacagtgctgcagtgaacatacatgtacatgtgtctttataatagaatgatctatattctttggggtatatacccagtaatgagatttctgggtcagatggtatttccatctttaggtctttgaggaatcgccacattgtcttccacaatggctgaactatttcacactcccaccaacagtgtatcaacagcgtttaagtattcccttttcttcacaacctcaccagcatctgttattttttgactttttaatagccattctgactggtgtgagatggtatctcattgtggttttgatttgcatttctctaatgatcagtgatgttgacctttttttcatatcaatatgacttctgaaggggacattcaaaccatcacagagatacatgccaagccttcatgaactccacttcaggactgtggccccacttcccatttaacacggcctcatggatactattatacaatcttttcagtctcagggatccagctaagtgattccttctcccatggatggaataagggagattataaaagcaggaaatgggagcattcacaccaatactacctcattttaggggaaagaagaggaaattcccttttgtaaacaaaccatagaggtttccaccaacaacatgcattatgtccagtgctggaagcctgaatccagtgatgccatccatagttgtgggtgttgtaaaatccttttagagcaattaatattcaatgttctgaatttttccagtaaaagtggacatgtttacaaggattcatgtcttcattctttatagtgtgtggcttgtttttcattttgatttgaatgagccatataattcagttatttctgtcctcagagctttgctgaagtgctgcttcatctttgtatcatgtgatataagtgccaattttactaatttatattgagagctctggagaaatctttaactacaggtaatcccagccttttctaggttaaatggggcccatcacaccattacctcccctctcctgagggaggcttatatggtttgcctctgcatccccacccaaatctcatctcaaattgtaatccacacatatatcaagggggagacttggtgggaggtgattagatcctgggggctgtttccccaatgctgttctcttgatagtgaaggagttctcagagatctggttgtttgataaatgtttggcattttccctgcttgttcttgctctctcctgccttccttccccctctccttccaccatgattctaagtttcctgaggcctcccaagccaggtggaatggtgagtcaattaaacctcttttcttcataaattacacagtctcaggtatttctttatagcaatgtgaagatggagtaatatagaggccatccctgtgggtactctggactgagatttgcttttgcctgtcaccctgagcttttgatcttaccttatcctcttattatccttctcttccctgtctaagtgacagaaccaggtcttcacagtacttgaaggcaagtacctatcctctgagtattgatgccttattttactctttagtatcgaatttctgcctgataaagaatgacttggaggtctccatgccagttagccatccatccagtcatgcatccagccaaccacactccccaagtgtctcctgtgtgccaggtgctgggctaagtcctagggatacaaaagtgaattcatcatggtctatccctttggggatctcatgtctactaggggtaggggcaggtaaatgaatcagtaatctcaaggtttttcagtaactctacagatgtccaagatgccatggagaagcagagcaggcagtcactggcactggtggtggtatcaaggaaattttctcatgaggtggcattttatgtgtctggaaaattggagtggtagtgagaagtgacagcgtgctggcagtcctcacagccctcgctcgctctccgcgcctcctctgcctgggctcccactttggcggcacttgagcccttcagcccgccgctgcactgtgggagcccctttctgggctggccaaggccggagccggccccctcagcttgcggggaggtgtggaaggagaggcgcgggcgggaaccggggctgcgcgcagtgcttgcgggccagcgtgagttccgggtgggtgtgggctcggcggaccccgcacttggagcggtcggccggctccaccggcccagggcagtgaggggcttagcacctgggccagcagctgctgtgctcaatttctcgaggggccttagctgccttcccgcggggcagggctcggaacctgcagcccgccatgcctgagcctccccctgttccgtgggctcctgtggggcccgagcctccctgacgagcgccgccccctgctccacggagcctagtcccatcgaccacccaagggctgaggaatgcgggcgcacggcgcgggactggcaggcagctccacctgcagccccggtgcgggatccactgggtgaagccagctgggctcctgagtctggtggggacatggagaacctttatgtctagatcagggattgtaaatacaccaattggcactctgtatctaggtcaaggtttgtaaacacaccaatcggcaccctgtgtctagctcagggtttgcgaatgcaccagtccacactctgtatctagctactctggtggggacttggagaacctttgtgtggacactctgtatctagctaatctggtggggaggtggagaacttttgtgtctagctcagggattgtaaatacaccaatcggctctctgtatctagctgaaggtttgtaaacacaccaatcagcacccagtgtctagctcagggtttgtgaatgcaccaatcaacactctgtatctagctactctggtggggacttggagaacctttgtgtctagctcagggattgtaaacgcaccaatcagcactctgtcaaaacagaccactcggctctaccaatcagcaggttgtgggtggggccagataagagaataaaagtaggctgcccgagccagcagtggcaacccactcgggtccccttccacactgtggaagctttgttctttctctctttgcaataaatcttgctgctgctcactctttgggtccactttgcctttatgagctgtaacactcactgcaaaggtctgcagcttcactcctgaagccagcgagaccacgaacccaccgggaggaacgaacaactccagacgcgccggcttaagagctgtaacactcaccgcgaaggtccgcagcttcactcctgagccagcgagaccacgaacccaccagaaggaagaaactccgaacacatctgaacatcagaaggaacaaactccggacacgccacctttaagaactgtaacactcaccgtgagggtccgcggcttcattcttgaagtcagtgagaccaagaacccagcaattctggacacagtagtttaccagaaaagaggggaaatggcttccaaggcagaagaaacagtgcaggcacagacatggaggcatggaagagtgcagagtgtgtgtgaactgttgggtgtggccagagcatagtggacctgaagcaaggtggagaggagtagttgtgggcaagatagagtttatggggggctagtttctgatggaacttctaactttcctcaaagatggggccaccgattagagactcaacatggcaggagtcactctattcctttcaagagatggttctaattactactcctgccaatgcagtaaataacacttgagggcagtaggagccattttagaatatttgtggctcctatgaagctgtttgtgtgtcggggcaggtggcaagcccatttcttttcttttctaaagtcacataccttgccccttagctatcctcccttccataaaggtttgttgtgaagctggaatgtgatatcagatgtcacagggcagtgtggtttacgaagcctgtagaaatgttcttaccaactgtaagtacaccttggcacctggaggacaagaatattcactcctgcatcactctgttccaactgtgttcacactccttagattcgcagaaggactgttttcagctgctggcccttccaggaatagccctaaagagccagaagggcaaaggagtaacattgaccacatcatggtgatacaaggtaataactttcagaggttttgctgtggaaatgttcctcctttcaatacggcatctgaaagataattggaagtcccccaaaagtgaggtcacccccaacttctcttcctactgctggagaatcagcgattgtcagagctgaaagggatcatagagattttactgtaatgcactcattttatagacaaaaaactgagactcagggatgtgaggtgaatttccttggtcctgcagcattttaatgacagaaatgagaccagaaaccaggtcttctgactcttagtcctgtggtggttctactccttcctgccacttctcctgtttgagttttttggcaatgtgaggacatttagccaatctggatactgacatttgaatgaagctaaccactagaagaatgtcaaggagggaacgatttacataggtaaatttacccaatccattgtccaatcttcagtcatgcaaatgtaggaactggactttgcccaagtcagagacctttggatctaggaacacactgatcaagcccttaagtgactgatgtagataaacgagaataaataagtaataagttcacagttgcctatggtaatagttaagagattggtcaccagggtcagatggacttgacttcaattctgactgtcatctgtaatgaaatttctgccatatgtaactttgggtgagttacttgatctttctcagcctcaattagtatattatgaagattagtaagtatatcatgaggatgaaaggtaataatgcaggtaaagttcctagcatacaataggtcttcagaaaatgaaagttcttactactataatgattgtccattcctctgaattcagatttctctctaggtgatagattatctgccaaagaccataaccccttgaataatcccaggtaattattgccaacttctagatttggaatttttccttttttctgagcttcttccttggattcacacaacctttttccaaccaagatacaataagattaattagatttctgcttctaaattataatcacatttcataatcacaaaccttccttgagaggcatcttaattggaattaagggttttcctgaattcgtcaggtccacatgactggcaatctttagctttttttccatgaatagaggggtgcatatccacaggcaaataaaaaaaatacaggatatgttggttaacaattaactagttaattaataatggctaatgttcctacagtgctttacaacttagaagagtttttcttttcatgcactattgtgcttttttcttccaccaaacttgtaaaataggtttgatttcagttttacacttggggaagccaggattgatgagctttggtcttttccatctcagtagaaggtgtcacaattctccctgtcattcaggacccaaacctagaagtcattcttaatgcttctcttcttcctcttacaccttacatttaatccatcaacaagtactttctgctttgctccaaagtggacccggaatgaggcattcctgcccctcttcactattagtatcgtagttcaaagtagttttatttcttgctggatttgtgtgctagcctcttaaatggtctccctgtttctgtccttccctctgataatccattctccacacagcagccagagtgatattttaaaaatgtaaatcagatcatgttactctcctgcttaaattcctccagtggctccccattgcagctgggaaaaaaataactccttgccatgttcaacaaagtcttgcgtgatctctgtctgacttttattgcttaccatgcccccacgtagtcaccatccaaccacaatgaccttctttttgtccctcagacatttccagtgtatatagcttttgcgttaactctgccttctgtctggcatggcccttctcaaaatattcacatggtctacctctttctctttgttcagatctcagcttcaatgtcatcagagaagagctttcccttaccacccaaacactctcttctactccagcagtattctgtttccctgttgtattttattcttaacactcatgactatccaaaattaatcagtcttgtctggatgctttataggtattaactcgtttaatgcctttaaccagtctagacaggtactactatattcattttactgatgaggaaattaaggaaaggagaggttaagtaagttgctcaaggtcacacagtaagtaatggaatcagagacaggtctgctccagatcctgcacatctgtccatgtagctgcagtctcctggcctgggctgcgctgatacagctgcagttctcagactaagttcaacaagagtcccagtcctagtccagtgatgcctgaagtcacatgtttcattctgggcctcacattcatgaagaccactgacaaaaaggccccagggccccagatgaaaaacataatttaaagccagtgaatttgagaagcagttgagcagttttgggttttctcatcaaattacctgcccaatgtcaaaatattagtaaattatagatctagattttaattgagtgttgtctgacattcccttcctcagtgctgacttgagattactcaagatgacagaagaaaagtgctgcctcagaggttctttcctccctctctgtctttgaaaaagcacagggagaagagggctgaagatgtgactgtccagtaattggaaccatctcggctcctctgaaattctaggagaagaataagtgaacagtatgatatcttgcaaagcttcatgtgccttaatcacattaaaattcacaattcagttttggatttatttttccttgttttttgaaagttattgacttgggacttgcttctggatctcagttggacatctgacctcatgccattattgtcatccatttagaggtcatttatttcagtgttcttgaaaggcagccattcccagtggttggccttctctattgcatgtgacacatcgcagctcttctgcttagcttttcttggtcacacagctatcaggtggtgactttggcctccaatgtggcccttacctctgactttgtagctcctctgcagtactcttcactctggttctgtggagttttgactccgagatacccatgaccttttaagtttcccagcaccagctaacctttctgagaatctgcatcagagggctgcagtggtcagggtggcaggtcaccagttgactaatggcctcctccaaggtttgctggcagacactgcgttgccatgaaccctattgatcccagaagtttgcctgctgcttagacagtctttgcgggcgtgaggaggtagtgagtcatggagccaccacccctgctacccatctgttcttgtggtgaggagaacaaagatgatctctttgtggtatcataaaacctagaaagacattaaaaattccgttaaattttcatacgcttttagctgttgaaatgtacaatctattatgaggggggaaaaacccactgtaattttccccccactgcccttacttcagaggctacttaagggaccaggtaatgattttacgatgtttattaatacttcatgttctgcttccctcccccattcatttatctttaaattgaaagcacagaaactgccagggatctttaaaatccagagtttttgcaatgtcataggttgttctgttatggatattgtatgtagagatctattgttgactcagagctggggatggggttgggggtggtatttatttttaaaatgcactttggagtaatggaaataacatgagttttggagccagatatacatgagtttgaatcctggccctgccatttactacctttgtgaccagtatcaaacaagttacctaacctccgaaggccactcagttcaaccacttgccagattgggaaagtaatacctctctctgagaatttggatgacctcaaacagagacctctcaatgcaggcctcgtgggaacaatcttatcttatccggatatccagataatttttagtttttcttagttgttctgagtaattacttttattttctctgtctctcgtgggtatcatgtggagtaactgtcaagatatccctcacccctttggttgcttgagaattgacagcatattgaagcctcatctatagtagatttataaactatggtataaagctataacctcacctcaatttattttgttcccatgtttggtttatttaatctttgatcccacttacctcattttatatttgcctactagttataagctgtctgaaacattttataacatagcatgtagaaatatgtctggaacatagtaggtactcaatagatatttggtaaatgaatgaataagtaagcattagagatacagatacaatatgtttcagaggataattaaataaaagagggcaagataatgagtttgtgcctttgagatatccaaataaaaacatagagtagacatttggatctatgctaggaaaaaaggctagaaatagagatttggaagtcataagtgtagatgatatttgaagccatagatatgtgtgagagactctagagggagaagagaaatttcagtactttagaggccaggtagaggaagatgtgcctgcaaaggaggctaaggatgtacctgccaagggcagggagataatgaggagattttacaaggggagggaacaatctccaaggatgctgaaaaaggaagggagataaggactggacactgttcatttgatatagtgactcggggaccttagtgaaagtcacttgcttataatagtgaggcagaagataaaagtcgtacagcagccacagctaacactgagcacagatgctgtgccaagtgcttaatgtggactgttacattacaacaacatgagatgtgtagtcatctcaccccattcccattttttacagaggataaaaatgaggcataaagaagttaatcacccaaggtcatatagctgggttcaagccaagacaggtgtcaggactcagagtcacagttgagaaaatgaagccagaaagtttagataactcaagaaatttggtcagagtgtggggggagagagagagagatggggtggtcactaggggaggaagacggttggaaataggtagagtgttccactgtttggttgattgattgttggaagatggagatttgcttgagcatgtctgattgctgataagaagattctagtagtgagtgatgggttgctgatacccagagagaagggagaatcagtactgtgggtccagagaagacaggcaggattagccttggaatacagactttctattttaataggtaggaagaagacaaaaatggtacagctcatgggagcagcatgtgctcggaagtgggaagttaagggatttcccttcatgaggcttctgttttctttgtgaagtaaaaagtgagatgatcttctgacagagtggtagccaagtgagagagtcagaatctgtaaaaaatggaaaaggtttaaaatagaagtacagaggatcggggaaaagatgattagagaaatcttggaggattatcaaacggtacacagaaccctgcttaggggtcgccatgaatttattataaatctgccctgtggtgtgattttctccagcagcactcagcatctggttgtaagcacacaggaaagggttgttcttttgttttattaatcttaatgaatagcagtagtctgttctgcaagtccttgacaccaccctcttttctatatgctgtatctaatctgttaccaagtgctgtcagtcttaggctccaaatacgtctataattcatgaactctttccacctcaaaatgctacctagcctgtgttcccataatctcgcaactggattattcaacaggcttataacacttgtcattgaatggaaacttgcctttttcagtccatcctgaacactgcagccagcatgaactttttataatgaaaatctaatctaatcctgtgacctcccagcataaaccttctcaagtcttcccaatgcttttagggcaaaaaccaaaaacccgaattatggtctcccctccttctggcaccactgttttcattgatctctgacctcagttgccctcttttggttttctgcacacgacacccttctcaccgcaagatctgctctcatggtcttgttttgcttccagtatcgagtccatgttccaggaagaaggacaaggacaaagggcaaaagtatggactttgcttctgttccagtgttaactctgaaacctcactcggtctcttctgcctacatgtcaatggccagaaccgtattacatactactacctgcaagggaagctggggaaaggtccattttttgccagtcacatttcagccttcaataaaatgagagttgtgttatttaaaaagaagaggaggaggggcactaggtaagcaacctggagtcccaccttcaatgaggaagtgttttctaggtgaagagttgagtgaaggagatgctgacagaagtgacagcatgaatacagtttagtgctgagcaatatgatgtgggaagaaggtgctggaacactgagtttgaggcagggaaaagggagggaggaaacagagaagtaggcagggatcaaaaaatcataatgcccttctattccagctgaggaacttaaacttcatcccgtgtgttagcctctaaatgaggtcttatatgccaggtgatgtcaagcaagatggtctactgggtatagacaaaaatgttggtatttttatttatctccatttttatttcattttgtttaaattctatttttaggtatgcatcttgacatacacacatataatttataagttcaatagtacattatatacaatttataagtaatagctatgttgggagtccatctgaagacttttttcttagtgacttgcacagtcaaaatgtttagaaactattgcattaggcatcagggaactgttaaaacattttaaacaaggaaatgatgtgatccaaattgaatatggtccaatttgccttttctttcccctatagagttctttaaatttttaaaaattttagaatgttagtacttagaaagaaacattagggagcatcaaccctgtgtcataagtaagataactgaggcccaggaatattaaataattagaaccattaatttgtggctgagctggagccccatccaacctgggtctcatcttctcccagtggtcctttgtggccctgtgcgagtgctttctctcttcctgaatgcatgtccctattcttcagcaaatactcttctcatcagaattatgacatgtgggaatcaagaggggagtaaaagggcatatttataaaaaacgtggaaaccaagaaatctgttttgtaaaaatgaatcacctatttagcctcagggttctgttgactctttagctgtcaacatggaagtctctaggtaccgattcctgcaggttctgttttcataatgccagacccatcagcagtttaactgagacataccgttgtacaatgtcattattttaggtattgtatttgcaaggccagcggtctaagtaagagattaaactgaacagatttctgacttggtaagacagagactttctaaggggtacactgccccactttatcttaccccagtgtatatgaagaaacacatgtttacccatgggaatgtgtatgtatttggatctatttcacagagtatcttataaaaaccgacatgaaaagaaagtctgatttatagaatcctatttcctgacattgtgaatactagttcaggactttgctaactactttttgaccagtgtgactgatttatttccccatgccatcatcaacccagctatgcaagtacaggaagacagggtatctaataaccagatggtgaacaagatctgtattctcttgggtatactaagctattctgaaaattcagtttataggggtacagactaagggttatatatctccaaacaaatgtgtttgtcaagttgatgatcatgtttaccaagatccttttatcaccagctgagtcctcttttagtggcttaggtcaccctggaattatttcaaaaaccagcctgatgtttagaacctcctgtgggctcgggcttgccagacacaaacctaaaatgaagcctgtagccttcatggtagcaaactgtaacctcaagcacaattatatgaatcatggacaaatgttttcactttcaagcaagtttttgccgcagcaaaaatgaccacttatctaagaggctgcatatttatatatatataaacagtttttggacataagaatcttgactattatttcccacagagaattacagatttatatatgtgtgtctatgtgtatatatatgtgtgtgtgtgtgtgtgtgtctgtgtgtgtatatatacatatgtgtgtgtgtgtgtctgtgtgtatatatatatatatataaacaccatattctgtgtcttttatatatagtatcacttgattattataattaccatgaagtgccattgttcttctcattttataggtgaggaaactgaagctcagagaggtgaaataacatcacaaagctaagaggttgtaaatttggcacttttaaaattatctagttattacaaaagttgatcttcagatcaacaaacttaactgacatttcctttttgggccccattttctactctgtgaactgaggaggattgaattcagtgattctcaaaccagagcatacgtcagaaccacctggggggattcttaaaacactgattcctgggcctgcttagagtttctaaatcagaaattctctggagcgattaagaactggtgtttccaataagttcccaagtggtggttcccagccacactttgagatccattggagtagatgatctctcagtgtcttccagctgttacatcctggagggtcagcaacctgccatacttcattggtgtgtgaccaaaaatactgcttcttcatggagtgactttcctactacttttgccaagtttgttggttagccaggaaaattctcaacatgaatggaggaaaatgctgatgaaaatcactccttcctgtatttattaactcatttgccagactaatatttactgagtataccctttgcagatattgtgctacatactggagatagcacatgtgaagatactcagcccctgcctgcgagatgcctatcaactatggagaaaacagatgattaatttattgttattactaaaagggaagtgctgagacctatgagaataaaatacttctctaggatttgtgattatgacttcaaacttttcctaaacaggactattttctactgtggtcttaagtcataaattgtctattctctgtatctagttcgattctgttcttagctttttgaggtatttctttattgggacaggtcagtaagtggcattttcatttattttttaccaacctaagcatttccttcctgccctagatgaaaacttagctttgttcaaaatttgcattttcatttttagcctatggtgacagtttaaatcaacagcaaaagcagaaacccttgtctaaagcaatttcctcactgttattccaacttcagtgaaatgagaagtcctggggagatgaattcagactgtcttctctactcccaccccttctcctaacagtttggcttcttgaaaaaaaataaaagatgaaggaagcaggggtcttgaagggaagatgtctactgtaaaaaaaatagggaaaggaaatagtgtactgataatggttatcatttgttgagtgtgcattatatgccagggactgtcgccaaacattgtacatgaattagcaggtaaacttccccagtaaccaatgaggtacaggtaccattattatcttccttttacagatatggaaattgaagctcacagagggtagataactgtcccaaagtctcatggttatttgatggaggaacaggaattcaaaagcaggcctgactccaaaatctcatgctttttaccagtaaattagatctccagtcatttcaatccctgcatttttcatagggatggtgctgactcatttggcttcctggttttctgactcatctcactgaacagggccagatccgatatgtcttctgcattctcccttatatcatctttctccctgctcccttttctattatggtccacctactctatcatcttctttccatgggccttaaaggaataccttcttgtggactgtctctgtgatgcagtagaaatctggtaagcttgccagggtgtaaaaagtgcatttgtttaggactgtaatgtttatttgaaagggactttcaatcacagacatgacttttttatgagcctcattatatatccttgtgattggaaaaatgcatcagtaaataatgcctccatgaagagtcactctcacttgcattattttaaaagatttggtaataaaaagtactcagattattgataatccataattaatatgaagtaaataatgtgtgttttcaaataaaattcaccatgataagtgatgagagtatgggcttttatatttctttgtaagtcagagacttataaaagataggttatccatcactaaggaatatgtagacacattaattttagcattcagttttttttctctcttttctaaaaaacatgattctattcttcaaaagaaagagtggttttattatttttccagctctttaaaatggttcaaaaatcttggcctgcagacatctttttaaaaaatcaatttttcaataatttagagtgaatcacacccataggggggatgtgctttcaaaataattaaagtagaggaggcaggattatagatcttgagaaaatgtgcttggaaaatgtcctttgatttgttgtgaaccccaaagctttgaataaaataggataggactggaatcaacttctgaactttctcactagctagtggcatgttaccagtagtccagagaatgctgaatgcccatctaatctacactgtcatcccttttattaacaaaacttaggcttttagggtacatcagggtctttcattatagactacatttcccagctccctttgcagctacacatgttcatctaagttttggccaatgaggtataagcagatgtgtcctgtgggattcctgagacgtctcctttaaggagatcaggcagtggccatcctctttccctcccctgggtcaggtagattggctggtcaggtaggttagcagtgactttggataagggggacagacgccatactccagggatggcagaacagtgagcttttgtggaacttccataccagccttggattcactacctctggactttgtttgtatgagtaggaaatttgtttatttgtttttgctgttgtttttgctttattagaaaatcactgttttgtagatttgtagctacacttaatcataactaataaaaatggtgactcataaggtttgggaaaacaacagttaaattaaggtagtaagtttagctatcattattgagcacctactatttactaggaactgttctaagatctttatttgtaatagctcacataactcattcaacagtctttctaagagacttacccccattttacagatggtcagtcacagagaggttaaataacttgcccaagatcatacagccaagccaggagttaaaatcttcagtctatctcttaaactttctgtaaatcactgtgatgaagtgacttgacaacattctaaaaacaagtaaaactggacctaaactccaacttttccctatgtaggatacctgtctcctagacttgttgctaattatgttagttggcctctggcacatcacttagagcccctgtgcctcagacttaacactaataagaggcatgggacaatacctcaccattgtttagtatccattctgagcctggcactgtgccagacacacagatgtgtgaatgacagcgcacccagagggagaccatgcgttggtcaaggagacaaggcctgaacacttaagaagagccaaggaacagcaagggaaatgcagaaccacaatgtcactacatccaggagggttcttggtgcttgatatgtggctagcaaccagtgaacatccctggaaccaagtggcaatgcatgttaagtgccctgtgagcaggcagaaataaatgttttgaatcaaaagaggaggggagctttggcatctaaaggattcagggacacatggtgagtgctttggttcatgttggttgtgccagtaattgaaggagtcttgtagttggtaagatttggggaggtgatgggaagttaggctcttcccccttctggctttctctgccccagggctaacagggctagttcctggaacaccgtctgtgctcccctgtcttgggtcctacacacagctacctacctgtcagcttgggatgctttcccagcctttcatcctagctaccttcttatcctcctggtctcagaaaaaaatgacatgacctatatggagtctctcctaagtagaccacatcccacttacttgctctactgtgtggtgaaatcccatcaaaatggaggatatggttccaaagtcagtgcatactgtgagcagtgaatcagccaagagaatccttgaaaatccctgagggagctatctccacagtggaaactgataagctatctccagtaagtctaacacattaattccggtatttcttttttccctgttcgagatagctgtcctattttaaagtctaggttgtatgaaaaaaatctaggttacatgtagccaagctataggttatacactccaaggagtctcatgtacatagaccatgatgggagtgacacacccctgaggtttttcagtgtatatagaactgtacatagtggaggtattagggtcagatgtagcaaaaggagatattcacactaaaagaaaatagaaaccgaagccaacccagggaagagctgatttacactccattctcgggttgagctccctgtgtaggatggtgaaataaatcacttgcattatttatattgtttaatttctctctgcatctccttcatttgcttcctgaagcctatgtacagttgactgtgtgtgtctatctctgcaaactacagatcttcacttcctattataacacttatcacatttgaatttttcatggattgtaattatgggttaaatgtgcctgccagattatacattccatgagggcaggggccatgtccatctcattacctgctgtggcccagcacctgcatggtacctggcacacagtctttccaagcagttctgtcctagacattgttgtggctttcttctcacccgccttcaggaagatccacccaacttctttctcagttactcagcattaagatctgtagttgctgaggcactcagttaagcttagggtggagctaaaacctgcctgggctggtgcttctctgatacagaaacccctgaaactgatgattatccagaaatacttgatctctttgggggcctgaggagctttggaccaccttaactcatcacctccttaagctcccctacctctaaatgctcttctcaccgctcccactcccaccccctcccccttgccccaaggctcctcctcagcccaactaactgaggctctttcacaatcctaaaagcatcatctttgttttaattttttcttttatcttcaaaagcatctaaaagtaaaaacaactaaagaaaagccagaaagtgaatgaagcagaaaaacaatttcagcactctgatacagtaccccaaaacaattttagttcactttgcctttttttgtgccattttaacgcagttgaaaccatgccgtatatgccagtgtgtagtctgcagttttaaggtgacattattgcatattcatattttcatgatattctttagaagcataattttaataatgccataatattttattgaatgctgtaatgatatttttaagccttctattaaggttggacacttaaatgtttacctttttttctctagtatgtaaatattatggtacaaatacacaaaaatactgcagggaacctttttattttctgcatctgacagactcgcagaaatggaattactaagtaaaaaatacaaactctttaaaatagatttttatttcaggtgatacttaatgcatattaagtgtaaaaaacttagaaaatacataaaagtatttcatccagcatttacctccaagagatggctaattttttgtatattttctgtctttttgatgtatgtgtatatgtgtgtgtatatatatgtattatgtatatattatatataaatatgtattatgtatatattatatatattatatgtatctataataaaatttatactgtattgatatattcatactatatatgtatcattactttacacaattgaaatactttatatgcatgttgttaaaactcttcaaatatacagcttttaatttactgtgtaacgatttttaaaacaacacttttcttgtatcatttaaattttttctgatttcttctattttgttgtatttgtatacataccttgtcagcattttatgttattccttaggatggattccagtaatggatttaccaagtcaaaaggtataaatttttaaggctcttggtgtatattgtcaagtttctttccaggaagattttgccaaattgcatttccaacagtccataagattataaagcaatggaaaatagcatgtcctttctgttttaatttctatcttattaactcttagtgaggttgagctttttccttatatgttattcatgtatatcttcttttgtgaattgtctagatacttaaaaggctaagaatatttggaggttatttttaaaaaataattttttatttttaattgacgttttatacatatttagggggtacatagtgatgtcacagtacatataatgtgtagtgatcgggtcagtgtaattagcatatccatcatctcaaacatttgtcatttctttgtgctagaaacattcaatatcctcctaggtatttgaaaggatatattattgttaactatagttattctacagtggtatagaatactagaacttattactcgcatctagctgtaattttgtgttttttaataaatctctccctcttcccctcttccctctaccattctctgcctctaatatcctctactttttacttctatgagatcaacattttttagcttcaacatgtgggcaagaatatgcagtgtttaactttctgttcttggcgtatttcacttaatataatgtcctccatttccatccatattgctacaaatgacaggattttgttgtttttttatgtctgaatagtattccattgtgtatgtatatcacattttctttgttcattcatctattattggatacctaggctgattcatatcttggctattgtgaacagtgctgcagtaaatgggagtaaagatatgtctttggtatactgattttgtttcctttggataaatgccccagtggtgggatcagtggatcatatattagttctgtttgtagttttttgaggaacctccatactgttccccataatggctcttctagtttacattcccaccaatagtgtaagagtcctttttctctgcatcttcaccagcatgttaattttttgtcttattttgataatcactatcctaactgggataagatgatatctcattatggttttgatttgcatttccctgatgattagtgatattgaacattttttcatatttttgttgtccatttatatgtcttcttttgagaaatatctgttcagatcatttgccttttttaaaaaatttatttttaggagacgggatttcactgtgttgcctagactgtagtgcagtggcacagtcatagctcactgcagccttgaactcctgggctcaagtgatcttcccacctcagcttcccaagtagctgagactacagatgcacaccaccatacccacctaattaaaaaaaatttttttggacagggtcttgctatattgcccaggcaggtcttaaactcctggcctcaagcaatcctccagtgtcagcctcctaagtctctgagattacaggcgtgagtcaccatttgccaatatttaaatcaggttggttgtttttttcctgtaccaatggttgaattctctgtgtattctggatattaatgtcttgaccaatgaatagtttgcaagtattttctcccattctataggttgaattttcactgtgttgattgtttcctttgctgtgcagaagcttgttagtttgacataattccctttttaaaaattttttcttttgttgcctgtgctttttagatcttattcataaaatattttccctggccaatatcctgaagcatttcccctatgttttcttctagtagttttatagttgcaggtcttgtgtttaggtctttgatccattttgagttgttttttgcatagagtaagagttgggagtctaacttcattcttctgcacatagatatccagttttctgagcaccatttattgacaagactgtcctttcaaagcccagtgaatgctgttggtgcttttttcaaaaatcagttggctgtagataggtggattaaagtctgtgttctctgttcttttccattggtctgtgtgtctgtttttctgccaatactgtgctgttactgttttggttactaaagctttgtaatatactttgaagtctgaaaatgtgatgcctccagcctgcttgcttgcttgcttgcttcctttcctttcctttcctttcctttcctttcctttcctttccttccttccttccttccttccttccttccttccttccttccttccttccttccttccttccttccttccctccttccctccttccttccttccttccttccttcctttctctctttctctctttttttctttcttctttcttttttgcttaatattgctttggcattgtgttttttgtggttccatacaaattttaaggcttttttctatttctgtgaagaatgtcattggtattttgatagggattacgttgagtgtgtaggttgctttgggtagtatggtcatttaataatattaattattctgatgcatgagcatggaatgtctttccatttatttttatcctctttagtttctctcatttgtggttttccttgtagagatctttactaccttggttacattattgtatttaattatttttgtagctattgtaaatgggattgccttcttgctttgtttttcatctagtttgttgttcatgtataaaaatgctactgatttttcatgtcaattttgtatcctgaaaatttactgaatttgttgatcaattctaagagtttttttggtagaatgtttaggtttctctatatatgtgaccatgtcatctacaaacagggataatttgacttccttctttccagtttagctgttcttttttttttttcttgcctagttgctctggcttattcaaaggttgttgacacatacatagatacctattttaaaagagtggcatgtgagaaaaatacaggaaatagagcccaataagatatgaatatttgaatttgctgatccattctttcatataggactataagatttaactcttaaaacttcaaaatttttctgtatgtactttccatcttgtaaagttataatagacgcgtgtcgttcttattggagtcaatgaattgggctctgtcatttgttgagatatcatccttctggctctggagttctgtaagaaaatgacaatatatttagggtgataaagctaatatctcaagtctcaattgtttgagagccagttatcagattacctttcacttctgttcctatcattttgttaataactattgttcatttatttatgtacttattgtctggtaccccactataatgcgtccatcaagagagcttacatctctctcagtagtctgtttccttcatttcctccaaatttccattaactttttaatctgtttgcttatttgggtttctgtctttcatattaggggctctcttcagatgataaggtgatccttggctgtctgtttcatgcttgagaatggggtactaaaaagatgactgggaactctatacatgcataaggcttatcaacagtggtttgtacttgtacggtgatctggatggcttgtttagaaggggaaatcctctgccagtatttttggatttttttctattagtttaattaacatccccagagcaaaactttcaatctttcaatatctaattgcagaaataaagcctggctgctggagttcaaggggctagcataggaaagagactagatgactccagtagatattatgaaaactttcactaaatcctcctttttcactttaacttttttactttcagctgcctggtatccactatctagatgccttctgtttttcctttccaggtaataaacctcgagtcttttgccaagttgacaaaagggatggtcacaccagtgtcaagtcagtactgagtctgcctttttattaaacaggctttcagccagttttactattttcagtccctctttactctcacttctagagatatcatctgccaccaaattcctaagcactttggggttctataaggcaaattgagttactttttagcttttgtcacaatcaattaaggcttcaggttgcttcaaattgttaaattggttaccatttatctttttactttttaactttcatgattttgttgctgctattattttctgtcatatttttgtcttgatgggtttgtatattttaaaaaaatacctcttccatgtcatactcattaggatggctactattaccaaacaaaacacacacacacacacacacacacacacacacacaaaacagaaagtaagtgttggtgaagatgtggagaaattggaaaccttgtgcagtgttggtgggaatgtaaaatggtgtggctgctgtaaaacatggtggtagttcctcaaaaagttacaaacaatattaccatatgatccagcatttcatttctggccatatacccaaaagaatggaaagcaaggactcaaatacatgtttgttcacccacgttaataaaagcatcattcacaatagctaaaatgtggaagcaaaccaagtgttcattagtggcagaactgataaaatgtgatatatacacataacagaatatgattcagcattaaaaagggagggaattatgacacatactatagcatggatgaatcttgaagatactatgttaaatgaaataaggcagtcacaaaaggaccaatactgtatgatccttcttatatgggatacatagagtagtcagattcatagagatagaaagtagaatgatagttaccagggatttgggggaagggggaaaggagaagttagtgtttaatggatatagagtttcagttttgcaagatgaaaaatgttctagaaatgggtggttgtaatgatttcatgatgtgtgaatgtacttaatacaactgaattgtatgcataaaaacagttaagatagtaaatgttatcttacatatattttaccacaattaaaaaatttttaaaaacaatgaaaaataattccactttacatttattttattctcttcttgggggagatagagactaattaatgtattcaatgtgttgcttaaaattaaatctattatttcttagtttacagctaagatgagcctttttagggctaaatcacttgccctggtcacagatctagtcattggcagcctagggtttgattcagttctgggaggaaggcagggtttgtatctgctgtgatacatagatcagttcgattcattctttcattagccagcattagaacacctttttcattccagcactcttgaaggtagcagtaagcaagacagtaaggttacatcacattaccatgtgagatggagaaaccagacagtaagcaagtatatacataaacaagacaaatgcaaatgtggctaattgttatgatggaaataaagtgctggctgaaatgtgggtagggaaggcttctctaaggaggagacttcagagttgtgacatcaatgtggagatggcctaatcagtgtgaacatgtgggcaggagtgttcctggcagaagcaacagcaggagcagaggcccagggctgggaataaggttggcatgtttgagaagatagaaaagaccagtttagcagaatgtactgaggaaggggaaggacaagtgatggggtaagaggtgtaaaaaatgcagaaccttgtgagccttggagtaaagcagccaaagctttcctaggtatacagaaagccactagaggggtttcaaagggaaatgatgattttactttttaacattctgttggctttcactttgtatctactgtatagcagatggtaggttgtagataccagaaatgcaatatgtaatactgttgcccacaaggaaattatggtctggtgaggaagaaagagcagagagtgccagaaaaatatagcagcatattccacagtgtacactttggggtactagaggtgatttttaggaaacaaaaattctttatagtagaacaatttatattcctttgggtatatacctactaatgggattgctgggtaaaatggttctttgagaaagaagttctctaagttctttgagaaatcaccaaagtgctttccacaatggctgaatgaatttacattcacaccactagtgtataggcattcccttttctccacaacctcaccagtatctgttatcttctgactttttaatgatagccattctgactgatgtgagatggtatctcattgtgattttgattttgatttctctaatgattaacactttttcatatgtttgttggttgtatgtcttcttttgaaaagtgttcatgttatttccccattttttaatggggttatttttcgcttgttaatttgcttaaattccttaaatattctgggtattaatcctttgttggatgcatagtttgcaaatattttctcctattctgtaggttgactgtttactctattgatagtttcttttgctgtgtggaagctttttagtttaattaggccccatttgtcaatttttgcttttgttgcaattgcttttgacatcttcatcgtgaaatcttagccagagcctatgtctagaatggtatttcctaggttttcttctagggtttttatagttttaggttttatatctaagtctttaatctatcttgaattgatttttatatatggagtattgattttatatatgatttttatatatggtatacaattaggtatataatacctaattgtatttcctaggttttcttctagggtttttatagttttaggttttacatctaagtctttaatctatcttgaattgatttttatatgtggtataaggaaggggtccagtttcaatcttctgcatatggctagttatcccagcaccatttattgaattggggggaggggtctttccttattgcttgtttgtgtcaactttgttgaagatcagattgttgtaggtgtgtggctttatttctgtgctctctattcttttccatggatctatgtgtctgttattgtactagtgtcatactgttttagttactgtagccttggaatatagtttgaagtcaggtaatgtggtgcctccagctttgttctttgtgcttaggattgctttgtctattcgggctcttttttggttccatatgaattttagaatagttttttctagttctgtgaaaaatgtcattggcagtttgatgggaatagcattgaatctgtaaattactttgggcagtatggccattttaataatattgattcctcctttccatgagcatggaatgtttttccatttatttgtgtcatctctgatttctttcagcagtgttttgtaattctcgttgtagagatctttcacctctctggttagctgtattcctagatatttttattttttgtgtcactattcaaaatagcaaagacatgaaatcaacctagatgcccatcaacagtggaccggataaagaaaatatggcacatgtataccctggaatactacacagccattaaaaagaataagattttgtcctctgcagcaacatgaatggagctggaggccattatcctaagcaaactaatgcaggaacagaaaaccacatactgcatattctcactggtaagtgggagctaaacaccaagtacatatgaacacaaaggagagaacagtagacactggggcctacttaagggtagaggttgggaagagggtgaggatcgaaaaactacctgtagagtgctatgcttatcagctgggtgatgaaataatctgcacaccaaactaatgtgacacgcagtttacctgtgtaacaagcctgcacatgtacccctgagcctaaaataaaagttaaaaaaaaataaaatagatgaacaaataaataaataaaatgtggttactagattgattaaaaaaatgtctacaatcaaatcaggttggggattcatatgtgatatttccttagagattctcagtgcacaccagcatattaaagtcccaattgttacatcacagaaacctgtgtactttgttcaactttacatttcctaaatttatttgcacaaatagcttctttcaaataataccttttaacatctttttaaactcctctgggaaacactgatttaaggcaacatgacaattatatgttaggtgttatggcaataatgaggggggcctaactaccacaactctgggtgtgaaacaggtaagcattcaggattgccttcctggagtaggtgacccctgaattgcttccagaaggagtagagaggttagccttgtgaagaatagagaagggtatttcatagagaaagaactgccaaaacacagatatgtagacccaaacatcccacatcatcatccttggaaaatagatttacaaatttccagcaggaagaggaaaaaaagtgcttgaagtgtgctggtttctcaccttagtggaaataattgcttaaaaaaacagccagaggctggacacggtggctcatgcctataatcccagcactttgcgaggccgaggcagcagatcagctgaggtcaggagtttgagaccagcctggccaacatggcaaaaccccatctctactaaaaaatacaaaaattagccaggcgtggtggcaggcacctgtaatcctagctactcaggaggctgaggcaggagaatagtttgaagccaggaggcagaggttgcagtaagccgagatcatgccactacactccagcctgggcgacagagccagactccgtctcaaacaaacaaagaaacaaaaaaaaccagagtagaatgcaattctcctcatctggatttcagcaagaattgcccatttctgttcagccgtaggcctccatcctctgttgccagtctgttcttctgactctcacctgtctcctttctgcacacagaaggccagagagaatgaacaattcttccccatgtcagttggctcacccttcctggaagtgtggatttcctgttagtacctgcaactctgtcggcgctgctatttctgtcttcgcgttgtttcagaatactctcacactgctgccccatttttccgtacgcagtcttccaggcccttttttgcacctgatttttgccaggcagcataattagaggatgttacatttccctgaaagagcatattctcatggacaacaggacacaagggagtaagaaagcttcaaagatgctggagggtctccctcctgtaccccaacctgtgccacttggtataacaggattctacatgagttagcttttctttattgttattaggagattaataaaaattgacctcatttatttagtgcttactatgtaccagacactgtaccaagaatttattatcattcaactttcacaaccctaaaatatgtgtattttacaaatgaggagaagtaggctggcgagtagcttgcccaaagtcattcaactcagaagagaggccatcgtttaatcttagattgtacttgtaaaattcacacatccaatacataatgcctttaaatgttctcattgttaacatttattttctttggattctgtgcctatttctgcttatgtctccggattacctgggagcttttaaaaataagaatcctagggttccactttataacattgaccagaagtcaagaatggggcccaggaattgctattttcagaagctccctaggtgactctaatgcagggctcttcataccttggtgtgcgtcaaaatcacctggtgagggaggatggctgggctccacaccacagtttctgcttcagtaggtctagggtggggactgagaatgcacacttctaacaagttcccaaatgctgttcatgctgccatcctagcacttgagcatttttcccaatatgtgtatgatccccctcccccaccaactgggtgacgtagatagaactttaagtgtcattaagttatgtcatgttttgaatctttctctgctcgatttccacgtcaacatgagtgagggcttcagggattttactccatcattttggctaaatgccaacttggcaaattccactcctcccccggagggactgcaaatgccagtgtcctccttcattcaggagtgaggtcattgtctgtgtggttaaaagtggacactttctgctgcttctgcttttgcactgtagtagaagtttcaaggagctctattttacagttccaaattaccatccctcccctctttaatgcttccaagatggatagtctctcaccataggttaatgtttagattttgatctctatttctcagccccccaaatctggatgatcctctggtgccagagctgttgcatgtatcacccctggacactttcttctctgcttgaaccagagaataattatatatagtagttcccccttgtccatggaaaataccttccaagacccccagtggatgcctaaaaacatgggtagtactgaaccctatgtatactatgtttgttttttttttttttttgatctggtaactgagaggattactaagcggacgacagggaggtagtgcctacagcatggatttgctggacaaagggatgattcacatcccaggtgggaccaagctagataacgtgagaattcatcacactattcagaatggtgtgcaatttaaaacttatgaattgtttatttctggaattttccatttaatatttttgtactagagttgaccatgagaaattgaaaccatggaaagcgaaactgcagataaggggagactgctgtgctagagtgctatagaggatttcatttggaaaaaaaaagttttggtcctggaaaaaaagtttaagaacatagtcgtattccatttcttcatatgtttgagatatttctggctttggtgaaacataggctaggaaaagaacctaacatcttattagtgtaactgaacaacagtaacagcagacttagcctttcttccttatgtgcaacattacctgtgacctgactcttgaaacatagctgctattaaagtacaagtgagtcatgcatagcagcttctccttgcccagttaatttctctgtaaaatctttactctcttttattcatgtatatatatgtatgtgtgtgtgtgtaaatatatacatatatatgtttgtatttccctttaaggatttcaaacacaaagaccctagtcatttgattgtctctgtactgtcgaattttgcctacaaccctgactgtagagacacattgttacctgttttccatattctgtctagtaaatgcttggttgtcaggacaacggcatagaaggtggaagctcattgataaccacgtgaattctttaaacaaatatgatcagagcaaattccagggtatgcttgaaagtagatttaaggaagagcaaaggtttcagacatatccttccttttataaacttgatattcatctttaaggatcagcaacagttggagttactcataattttatttaaaatcctgaataaagatatcaccttagttttatggtacgtttgtcattccagcttgttaggcatgagtgtgttgttactgacagagcccctggaggacaggcagacactgtggttctccatggtctctcagtaccaggcacagagcaagcacccaatacatattataggaataaatgatctcaaatcttcacagtgcctcttatagatggcttttatgatatatatctgcagagaaactgaattcagggattttaagtgccttttttgcaaggcccttaaagtttgggaaagtaggtgcatggaattagaactcagattatcctgacttctaagatcacactcttcattgtagcacactgccttcttgccaaaaaaaaaaaaaaaaaaaaaaaggaagaaacatgtaaaaagacagaccatttctaagatgaaatgtgtgcttttcaaaacaatagcagaaaaccttcttcaaaggtaaaatagttggaaatagaagaagaaataatatgtaatttagcgttcgttgaggataagcaattaatcctgccctccaggggtgaatttatgtctagcctatttgcacatgaaagtacaagttgggcttcatttctatgcaagtaagacatctggttgggaagtgaaaaattttgtcagttacctgaatcatgtttggtctacatgatagaaaagcccctgatgtcttcagatcaccagaagacatttggcattgtatagttaacaccagatccactgactgagtggttcacctgagagttgctgcttgacatcctgtagattcacccattgttaggaggctgttaccattttgtaagtcagcagtttgcaaacagtagtccagacgagaaaccaacgctggcccttgacaaagtgttcactggtgtgtgatgcaataaatacatgaggtcataaaaggaagtgtatttaccttaaaaaagaacatcctttattttgagatcctctgcttcctatgtttttagtgatacaattttgtgtcaaataaatcctcattgtaagatttggttttaattagtaaatgagacaggataaaaaattgagaaacctatataaatccctagttttctttatgtgatctttgtatttgattgtgaaaaaaaaaagcaaaattgtagaaaccactgctttaaaccttgtaatatttttagcacaatgacacctaaagtattttcatgtatttcccaagttttccttttcctagaagtggggtaactctccatggtagaactgtttgcatgggtcttgaaagcattggacatcttaacagtcaagtattttgctgacaaaataatgaattttccttttgaaacaagcgttttgttcttaaaataactctaaagagaacaccttctgcacttttaaagcatttccctctgaaggcatgccgtggagacatgaccatagggagaaactttttgtgctagaaaactgaattccaccactgtgaattttttaacagctttcacaggttctgcagtttgctctcatgaccccaaaagcatatatctccacatgctgtaacatcaaggatctctcctcaagctttgtaagctcggccagaatgagctgagtaccctctgtgtgtcaggcgatgtccaatacactgggaatagggagtcataataaccataattttatctgacttttgtctagcatttgtcatgtggcagacaacatgctaaaacacttatttgcattatcttgcttgattcttataaccactctgggagaaaaataacattattatagcctttttacaggtgaggaaaccgttgcagggaagttaaatcacttgcccaaggtcacaagccctgtgagtgataaagccaccaccatccaagcctgtccaccccctaacctgaactcccaagtgctatgctaaaccacctgcctcttatggatatattatctacaaaaagagctctgccctcaaggcgattataatctaaattagaagagggaagcacaagggaaaaagccattatgtagagcagaatgatgtaattccaaaaaacatgctgttggattgtagaggaaagagtgattaattatgatctacccagggaaggctttttgcatgtggccttaggctaggtgagaacaaaatagggcaccagcaattatctagagaattgggtcactgtgggtgccaaagtggatgatgatttcaagctaaaaagactatgctctgaatagttcagaattggccgcccacactcctggaatctgttgaatttttgccaactcccttgttctctttgtgacttattgccctggcttagatgagcttcctactccaggtgggggaagatgcaggatggtgctgccatagcagggagtgctgacaacgtggaagaagccttccttgagtcaggagctctggattcaatctagactctgctcccacaactggttgactccagggaagccacctccttctctgggttcagttttctctactgtaaaatgtatacactgaagttgatggtctgtatgggccattcaaaatcccgtgtctctgtttttggaacagagaaggaatcagaggagaggactggaagaagctaaaagattcagcatgttcggatttcatgactcttgtggttttgttcctagacaggacctaccaggggagcctcctgcaaatgaggtggtcttccttttctactcatcacattctatgcctgccctctctaacctacatggtatagtaggaagacgccataccatggagtcagagaatcttgggctaaaatcctgaccatgtcccattacatagtgactttgaacaaattatgtaatctttctgtgcttgtatttctacaactgtagaataataggttgcaatatcatagactcttcatgtagagaatctaattctattactataaaatctaattctaataccattggtttggtgttagcaatgaaggtgatagcaactgaaaagtaagaagagcagtgactaaaagctcataggttttgataaatgggcactattactattataatatttattgtgttaaaatacaaattatgtacagcactcctctgaacactgacctacaatagttaccagttgcttgttggacttcttgaaccagacttgaccaggcaaagagaatttgagaacctctatttcactaaaaaggtggtatctacaatatcttgccactgtagcatctgctatgtgtaatgagatgcttgggcctgctggtggtcacctattttctaggtatacgcattggcttttgtggtgtcgccatatatatatatatatatatatataaaatatgtattatatatataatatatatacatgatatagatataattaaatgttatattcaattaaaataaatataattttaaattaaatataaggaacatgagagttagcaggaatcatgggtgaaaaaaatatgtataataacaccacaaatgcatatatataggtttttgcccatgattcctggttaactcccatagcccttattataacattggggcacttgaggcctcaggcaacagtctctctcagtgaccccctctggtccttcttcacctgcccaaggtaggatgctaatttgattatggatcagaagaccctcattccagagagggtcctgccccatagcctagtggaaagaatgctacacagagaggccaaaaaaagtctgagcagatagtccttgctggatttagatcatatgctttttgtccaatcatatttttacatggttgtcaatcatgcctgtgtaaaaaagcctccataaaaacccaagagtacagggtttggagagctttttgattgctgaatacatggatgttcctggagggtggagtgcccagggaaggcatggaagctctgcgccccttcccccttaccttgccatgtgcatctgttcatctgtatcctttgtaatagtatttataataaaccaataaacgtgtttccctgagttatgtgagctgctctagcaaattaatcaaacccaaagacagggttgtgagaaccccaacttgaagccagtagttcagaagttgtggaagttggacttgccactggtgtctggtgcgtggggttgggggcattcttggggactgagccttcaatctgtgagatctgatgcaatctccaagtagataatgtcagaattgaactaaatgacatccagctggcgtctgctacagaattaagtgcttgcttggtggttgggagaaactcctacacatttagtaacagaagtcaccttctatgtggatgattgctgtggtgtaagaccagaggaaaaacatgatttcagagtttttccctcaacagccttgagatactccattttaataagatagagagatgaaagtgtattactggtgggattatgttagaaaacacatttcttgtcccagtagcattcaagatcaagagttaaacttaatacagtctctcctctttactctcccaactgatattcagcttcctgtgtgagtgtatgtttaatgtttttgtctaaattaattgatctttgtcttatgatctctcgtcttaaaaaaactaagttcagctaaatgaacattgctgagaacttatgttctagacactgctgacgttgtgctgaggggaaatgaatatagaggtaaataaaataatttgaactattctctgtctagtgggaaagagagatcgaggtataaataggggaaaaaataaaacacaacgtaagggtcataatttttaagttggattaaaaatatgtgtgtgtttctttattaaacacctcttataggccagactatcgggccagggatataacattatataaaactcagtccaaattgcataggtgtctacaagatgtaataactacaagatggcataagaagaggtattggatgggaatagtgtcgactagaaagtaagctacttgagcgtaggggccttaactatcttgttccttaatgcatttttagcattagaacagtgcttggctcgtatcaggtactcattaaacatttctgtagtaagtgatgaggctatcataaagttttgtttccccacccctaaaccagattgtaggttcagtctgaaaggactccaggaccctctctgctggtaagacatggtgccactttgtactctcccagccaatctgattggcctcttgactttggcaaaactgagctgggggctggcccccagtgccaagcacagaggaagcagggtcacatgccacccatgcccaaagctctttctgacatttccatgggcctggaaccaactctcctcctgggtttcatctcattatatgtgggaagacaaaagaacactgaaccttccagttaattcaacaccccgcccccacttaccccttcctggagaggataacagttctgttgaccattataatgcattttctgtctcccagcagtccacatagtcattaatttctgctgctgacatcaggaaagaggattatgtgtgtgtctgaaactgttcccaaagtgctcattagtcatagataattgaaaaactggtaggggaagatttggtgtaataggagcccccgcctgtgaagagggactgcaaccaccagataattgtagattccagcttttgaccactcagactgaatctgcccatccaaatgggaattcagcagacttgagcctaagagctctcagagtgatagtgtttttacatacccaggtgagggtgtgtacaccgagacagagacagccaaatcaagagaataggtgaactgcccttgggtctctttcctgccttcagactgtggagcagtgtttggaaaaagtgtccagtattctcctttattttgtttttatttcaacgtaagattgttttgatcacaaaagacatacaaggtcatgggatataagaaacacaaacattagagaagagtaccctacactggatcccaacccatgctgtgacaaaattctagggtttttctggaagtttatgtgcttacatttttatatccttttctttaaaaaaaaaaatcacatgatcatactaagaatactattctgcatcttgccattttttctgaatttatcttggagttccaaatctataccttaattcaagttcattcattttaatggcaaggtgggattctgaccagatttaagggggaaaaacatcttttaaaatattatacaagaggctgggcatggtggcttatgcctgtaatcccagcattttgggaggccaaggtgggtggatcacttgaggtcaggagttcgagaccagtctggccaacatggcgaaaccctgtctctcctaaaaatacaaaaattagccagccgtgctggcgtgtgcccgtagtcccagcaacttgagaagccgaggcatgagaatcgcttgaacctgggaggcagaggttgtagtgagctgagattgtgccactgcactccatcctgggcaacagagcgagactctgtctcaaaaaaaaaattacacaagaaatgtagaccaattagaaattagagaaaaaagaaaaaaaggaaagaaaaaagaaatcactcataattcctccacccagagaaaacctattttctgtatttttttcccctaggaatgtatttttacaaatagttcatctactttcattgttgttgttcttacagctgttaaaagaaaacctttaggcaaattaaatttaacagtttaactgtgcaaagaatgattcatgaattgggcaggtccccaaccagaataggttcagagagacttttgctcagccacatggttgaagagaaattacggacagaaaaagggaagtgaggtacagaaaaatggaagtaaagtacagaaacagctggattgggtacagctctgcatcggccttatttgaacagagtttgaacagttggccgcctgtgggtggttgaagtatgtcttctgtgattggctgagactcagcttctagttacaagagtaggttacagtgtgtttacaaatccagttaagttacagtcactgtgtatgaagaaacctttaggctgaagttacaaacggacacctttaagttaaacttaatttaacaaaaggaagtcatatactgcatgttttgcagcctctatttttcacttggtttgactgttttaaatataaaaattattccccaagcttttctttacactgtgtgtttatcttcttttttatttatttatttttttgagacggagtctcattcttgttgcccaggatggagtgcagtggcgcaatctcggcttactgcaacctctgccttcctgggttcaagcgattctcctgcttcagcctcccaagcagctgggattacaggcaactgcaaccatgcttggctaatttttttttttttttttttttttgtatttttagtagagacggggtttcatcatgttggccaggctggtctcaaactcctgactttgtgatctgcctgcctcggcctcccaaagtgctggggattacaggcatgagcaaccacgcccggccacatttatcttcttaaaaacccaacctgagcacttacagtcgtgcccctctgggcaattcctttttgcctggccacgcctgaagccctccgctgcctcttgtcccgtctgttccagttctctgttcctccttgttcccctttttgcgacatactaaatgcctcaaacacaccatgcccctcagggctccctacaggaaactcactttttgctctgctgtcatccctttccccggagcatgccagcactgaaaccaccaatctccaacttgcctttccacacaggcttgaaagtcatcttcaccttgaagactgtattcactctactagccaccctaactggaccctccacagttctctgggaacaccatgtacacatttcacctttctagcattttctacatggccctaagagtcttagtttttcatcatctttgtcccaaaccacaatatgagacctcagcacctagatcttagcacatggtagatggaaatctatgcaggcaatcattagttctattgtttctgaaatgtttgttaaaatgcatgaatgaatgcttgaatgaagcctagaaagaactgcaaatgctcaggcagtgaagtcttgatttctgggaaaagcaatgctgtgaataatttaattttatggtgaaagaaaagccaaacaaggattatattgggaaaagttgtcaggaggcactaatgtttgcctctgacagctctagtgccctcagtgtacctctggctgataaacttagagtgtgattttgaaggggtgatttctcagggattctcacctatttctatcatcctctctcatgccaagctgtttcattttggtctctaaataaacaaagctccttcctgcttggagtccagatagcctattcctgaaggctgtggttccaaatgaaagatgggatatttgtccttgtatatatttattttcatccctaaccactggattgaggagaaggctggttcactgctgtaggttgggttttccagaagcaaaggctgagacagatttggggggataaggtgtttattagggatggttggctgtgaaagaaggaagagagagaaggactgggtagagggaaaagagctgaactgaggtgcattcctgcagcaccttggtgaactcagcagagtctctggagtgagtggtgtctatcagagcccttctgcctctgctttgcaaagtcaccaggtactggctgtcctgggaggtgcatcaccttgggaaggcagctctctgcaactgaggcaggccctggaacatctggcagctgtctgctgactttactccatccttaagggggagtttgagccatggtatctcagtctctaccatgcttcctatatccacgcaaccactgtgacctgttatttcttgttccatggaatcccttctgtctgcctctgtttctacatctccgttaccaatatctcagtgaagatccttatattctctctctttctttgattactgaaatagattcacactattttccctaaccccagtctatcctctgctataatactgccagagagtgcttaaaaaagcacaagtttaatcgctttcctcctggcttaatgctcctttagtggtttacagtgggcttcatgattaagttcaaacacttaagtatggattacaaggccctgcatccactgccccatctgcctccccagcttcctctgtccttcaacacccaccccctaccagttcacaccccagcctatgttccaatttacctagcccttttgatagttcccttaggggccccttctcccttttttctgtccttgctcaagacgcatcctctgctgatgaagctccctgtggtcctatagcctataattagacccagatctcctgtctgcatgcccaggactctctctgcctcgcagtggtctgcagcctcatgttctgagcctagaggacatagaatcaaattaagctcctttaccagctaaggtttcttcctaaattactatagagaaaacttggaagagtgccccaccctgctaatcctgtctagaaccttttttataaaaattacaccttttatgtttgtggagattgggggtgaaggtggaacagaatttccattttgaccttcctatgaaaaccatttttaaaaaatctcaatttagtaggcaagatttctaaacggtgctcctttttctttttcttttttctttttttttttttttaacatacataatgcttgttctaaaaatacttctcttgatcctttcatccattcagaacccatttttaaacaacttttactccaaaaggtaatgtaatgaataagagcagaggtgtggatatcagtcagagtagaacccatggcctgtcttcagctcttaggctgtctctagggtgtttatttttcttctgtaaaccacaattttcccatctgtctgtaaaatgggggtagtatgggtcctattgtacccttcacagagggttaatatgaaaatgaaatgagaaaatgcatgctatgtccttagtgcagtccctagcatgaaagtgctcagcaaactggagtgcagtctctcctgtgttagatactagccatagtgacataattaagatattgtccagaaccgtattatacaaagccaaggacactgctctcttccaggtttctgctactttggcatttgaaacagaataagattttcctgttctctgccccatcctttgagcatcttatacttatcctccagaccatcagtgtccaatagaaatataatatgagccacatatgtaatcttaaattttttagtagccatgctgaagaaagtgatactaatttttaatgtatcttatttaacttagtatattcaaattattattttaacatggaattgatataaaaattattgaggtattttacattcatttttccagatgaaatctttgatatctggtgtgtattttccgcttaacacctctcaattcagacgctagatttttgttggaaatacttgatttagatttcttaaattaatctagaaaaagtagattcgcatacccaagttgttccgaacatacttaaaagtttttcagtaactgaatttaatatcagtttttaagttgaagttaaaactaaataaaactaaataaaatgaagaatttagtccctgagttactctagccatacttcaagtgctcagcccacatgtgactagtggctgccatattggacagcagagttcttctagaagtcactgcagaggtttcagtcttactcttcttagctaaacttgttttcatattcaattgtagatagaagctcttaaaatggataaaaatggtgtcgtcaaagtgctttggttccatttagaggaggttggttaagctgttcactctctgacccctctcccaacctccaccctcacctctacccccagaggtcctggagcacctctgcccagtccttgagctccatggaacaattaacaagtggcatcttagcactcaaaaattgctgattatgcacccagattctatcttggggctcaaaggggtcttaatatatctatgagtcaactcctagcccctccctgcagtgcagaaatactatagaatccttgggggatgagagagggctcgggctctgtttaacacctaggagcagatggatcatttcattctattctgtcttacgtggttctctgggttcttatcttgtcttcctaactaggttgggggcaaggactgcttttcacagccccacagcacccacacaaagcaagacaatcaattcttaactgaaggcctgactgcaagaattcaaggtcacttgaaaaatcagggtcactgcattgcacaactccaaagaacatcattcaaattgtattatatgattgtgcaagtggcagccttgtaaaatttgcaaaggtttagactggaatattttttccagctgagaaaaactttttaactaattatttgttggtacaaagtacacctttttcctcttatcctctgccaggaagcaactgaaagagtaagttttcttgacttaggaatatacgttcattagagagggtgtatggatgtgtgaacatgtgggtttacgtgcgtttaagtaggttagtagatctgctgtgttaggaagcccatttggaatggtttgagcatttaaaccttgtatttaagaggctactgtgtttatattccttttgaaatttcccattttcagaatctttatctggtttgaatgatgctttagagttccttgtttgtaaagctccacaaagcatgacccataggtaccaagcacgtacactaaagtcactggatgagcaaagggactcttgatgactgcatggtttttatctttgcaaatgcagaggagggaggagagagcaaagagtttctcttaaaaaaaaccctctgtttacttttgtgtttttcaaactgatggtgtttgttttttctcatgtctacccaggaaaccaagtgctacctcctggagcttctcttggaaatgggctcacaccagaggcagcaagagaccttggccttctccctgggattgcggtcgcagcttcactcattgatgcccatgcaggaggactaggtaatctcttatttgttgcctacagccaaaaccgtattcaaatggaatattccctagaaccgaagacactccttttctgtttttaaagcaaaggtcaaggactttggtgtttcaggatataataatgaaaagcctttttacagctaggcatttggatagaattacagaacttttcattaatgataaaatttatttataattgtattaatttctttatacatggcaatagaaaaaaatgtatttgaataactttctgcatagttcttttgtttactgaaaattcaaaaaagatatgttaatttcttgccacacttagctctactgtttttttgtaaggtactccaaaacccttataagtctcttagatttattttaataatatatttggcttatgtcctgtatccagttccttggctgcagtcttgattttatcttgtacataactctcaagtctttcattcatgtattcatttgttcattcataaaacacccgttgaacacttaccatgtccaggcatggtgctagaagacagtgaacttaaaacaaaaccaaataaaaccaaagtctcttccccagcttttaatgggaaaacacacagggaaacaaagaattacagtaaagaatgatgacttcctcatccttattgcaggttgtgtgtgttttttgcaggggaagttgttctggttctcagcatctctcatctcaactgtagccatatatttttttcctagcctttcattctaacaatgttttgttttaaactatgatttataattcatgagatcaatttagcaggacatgaccactgaatttgcacaacagaatggaacagaattgaatagaacaaagtggaaaacatcagagtacatttcacaaagtaagggaaggcactgctttgtggagctgtgtttccattctgtgtgtgtatactttcagacacttccatactctgcccatgcatttacacctctgtgacttggcacacatgttctttgtccagaatgattggtcctccacttctccagctggctaactcctcctctaactgcaagacccatatcagatgctttctgctctgcatagccttccatgaaacactcaggtgtatttagaaattctctaaattatgctttttttcagcacactatttgaagaaatgatcatattgcattgtaatttcaaatatatctgcatgtcatttccattagagtgtgaactccttgagaacaggaacattatgttatctgtcctgtatccttcatgccaagccctatgtctggttcctatagctgcttattaagtttattaaatgaatagtcacattaaggcaagaataaggtgaaatggctttaaacagtagagtgaagattaatctgttttcttatgcaacggattattaaatggtgccttgttctacatactacatggatttccagagcaggatcgctctcatcaatctatggacatgtctgtcctgttcatctctctgtcctcaggatctaaaacagtgcctaagaattagtaaacaactcataatatatgtaggttggttgaatgctatgtaacgtagttctgattacaggcaaggttgtttctctccaaatacttttcagtgtgagcaatgtgtgcttttgattggaatgttaagattttggtttttacatacaagcacagagagaacttgaggtctaggcagacatggagtgtttctgtcccctagcaatcctgacattccagatcatgtgtgaggccacaaaagctttctctgtcatgctttttaaattatccctggggtgacagtgtcaatcatccacccctacctgggtgacaatcacttggctgggaccggcatatgctgaaagaaagagaactgctgcttgaagagccgcaggcactacagtttccttgtcagtttcccagacttccctcagggacgtgccaaaacacaccttctcacttctgcccaggactcactatgtcctccaggaggggagactgtcaatgaccctcacctttttcctaaacagagatgttcagtggcagaagttttacccttagaagctttggcttaagccttttgttccccgtaaaatgcaaatgcttgtaagtgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactgtaagtcaaattaaacctccttttcttccttgtctcgggtatgtctttatcagcagcataaaaacagactaatacagtaaattggtaccagtagagtggggcattgctgaaaagatacttgaaaatgtggacacaactttggtactgggtaacaagctcatagagggaagagacttgccttgtctctgatgagactttggactgtggacttctgggttaattctgaaatgagttaagactttggaggactgttgggaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgtatgtacctaatacctgtacccgcattgtatctaggaagtaactgacttgttttttattttacaggctcatgggtggaagggacttgacttgtctcagatgagactttggactgtggacttttggattaattctgaaatgagtaaagactttgggggacttttgggagggcatgattggttttgaaatgtgaggacctgagattgggaggggccaggggcggaatgataatgatttggctgtgtctctattcaaatctcaactaacttatatctcccagaattcccacatgttgtgggagggacttagggggagggaattgaatcataagggccagtctttcccatgctgttctcgtgatagtaagtctcacaagatctgatgggtttatcaggcttttctgcgtttgcttcttcctcattctttcttgctgccaccatgtaagaagtgccttttgccctccaccatgattatgagacctcccagccgtgtggaactgtaagtcaaattaaacatcctattcttcccagtctcaggtttgtctttatcagcagcataaaaatggactaatgcagtaagttagtaactttcccccatatttttgttagtggaaagatagaatagtttttttttgttttaatggaaagatagaataagaatcttggattctttaaggcctgaacttagatgccagcagtggctgggaagggcacaggaaggtgatagtccatgatgacgggttgatacagacttacttaatatatgttgactatgttttatccttattatgccttcttatgccttcttatgcctctttctttacccttcaccttacagccaatccaagagttggatatctcaaaaaaattaggaggcctgggtgcaaatgtttcctttcatttctacctttcctatacccctattaggatgtggaggtgaacagatgcctgaaaatcttgaaaaggttgtccatgggtccaactctatattaactaaatataattgagtgaatgcaacctgtcagtgattggtctaggcactggagattattagcagtgaacaagtcaggcaaagtccattcgttttggaaagaaaattctcattgttctcccctgcctgcatgtttgtagcttaatagtataggtttgggacagctaatccctgagacatattgtgatgctatgacaagggcactcaaaatggaattttaagttctggatttagattgtgtttctgcctacaaatatggtgcttcgcagaacttttgtctcctgttatgcagtgagagagtgagagacaacagaatgcaggattcactactttgtgattctgtataggttgaggtcagtaatagcctcaagaactggctaaatgaaccctgtgttaagagatttctgaatgtcaagtacagacacagctttggatttggaattgccacccaggaagaggccatccaggcctctcaccaacaaaccctgacaactgtagtcacttcaaatgctgacctggcatggcctgcttgaaaccccacattctgactagtatgaggggtcagcactctgctttagagaaatacccctggactttcattcccaagggaggcctgggatgggaggataaagatcaaagaagcaagcaaaactcaacccatgcttttcccagttctggaaaaagaggaggaagggctttgtgggaataaaaatcaatgataaaagaacattttgttcttaaggtgctggttagtaagttctccagcagacagtcagaagataggagtagctttgtttgcactttgtgggggtggttctggccagggctcctgctgctgatatttttctagcttataaaaataacattaacttttttccaggtcttttcttggctccagcaccccaactgccctgaaaggcaataacaacctgatttctgtctcaggcccttctcttctcagttgctctttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactatgcccggctaattttttgtatttttagtagagacggggtttcaccgttttagccgggatggtctcgatctcctgacctcgtgatccgcccgcctcggcctcccaatcagttgctcttatctggcagacagactcctgattatccatcaaatcttgaatcctgttctcctctgggaagccctccctgacttcccaagttgacttaagcactctctttttcccccactgtgtcttgcgcttgcaggtttgtgtgtgccacattgcctcatctactaatttataaactctttgggcaacctgttgtttcatactcccactgcagcagcctgcagagtgctttacatatggaggacccttaacacatgcgtatttagtgaatgagtgaatgaatgaatggcattccctccatgaggaacggatattacaactgagagagagagtaacctctcattcaaaggcaattgtccctatacaatagttatacttggcttatttctgcaggagcaaaagtttgggttcttctagatgtttggaaatctgtctcctttttgccctcatcacattaccaagtttcggccaagagcaagctttgttccttggtttagcacaactatttgattaccaatattggattatttggcagatgttgaactggcttaaattgctcatctgggccagatattgaattggtttaaactgctcatttcaattgcagagccaggccaaaatgaggattttgaatttcttttctttttaaatggaagaatttattgagccagtcttgcaaaaagggcctttggttcatgccctagaacaacacatagtttgttccagtaaacaataaaacatgccaataacatttctcaccattatcagtgttctagaagacaggataaaggctgcgatctaaagcctgcgactttagataatgtgatttggggggaacatttatttataagtagtatatatactaaatgtagcatgatggataaagaaatatacttattggcaatagtccattgcgtttgtaaacttttgatttatgaagcatgatatggtttggatctgtgtcctcacccaaatctcatgcaaattgtaatccccagtgttggaggggtccctagtgggaggggattgtatcatggtggtggatttctcatgaatggtttcgcatcatccccttggtgctgttctcatgatagtgcatgagttcccttcagatctggttgtttaatagtgtgttgcaccaccccactctctctcttgcttctgctccggccatgtgaagtgcctgcttccccatcaccttttgccatgatcgtaagtttcctgaggcctccccagaagccgagcagacaccatcatgcttcctacacagcctgcagaaccttgagccaattaaaactctgtcttctataaactgttcagtttcaggtattcctttatagcaatgcgagaatggactaatacaaaacacatctatgttcattatagaatttgctccttatagcaactttgtagtgaagttaggacaggtatgtgttccctcattttgcacagcaaacagctgaggctcagtgtattataaactcaagaatagatatttatcttacacttagttcttaaggcaactttatacatactattattctatttgtcagatgagacagttgaggctcacaagactacctaacattctgagctacacagttaaatgagagatgcgtgacttaagcccatgctttgtgcacacttatcactgtgttataaagaatggcctacctatttaaacatgatccactctgctctttaatttgaccctaaaaatgtgagcaagtaacaaattttgaaaaaggaaagtctttaatatttattgacgacccactttactagttcatggggttagacagtgactatgagagagaagtggacttctgggaatttgtattctagtaaagaaaatagacaagtaaataaacagttacggttacttgtgccgtgtatggaaggctttggaaaaacataaaatgggcctaaaattgagacttaaacaattattaaaggattcctagagggagtgatgtccagtaatctaattacgacactgctttccctgttattgcttcctggtaaagtggaatttatatattttttgcgacttttaaacttcaactaggcttcatttctaataataaaataataacattgttaattagaacaaatacaaccaccactctgactggtactactatgatgaccatttcttacatgtgtcctatgtgccaagtactctacctgatactgctcagactttatatcttgctcctcacgataagcctacaaggtagaggttgtttccccattctgcatgagggaattgaaggcagaaagaataatgtttccacaatcacataactaatctcatagcaagatttgaaattgagtctgcctccaaggttcatatatcttttctctaggccagtggttctcaaccaggggtgatttgacccctcaggggacatttggcaatgtctggggacagttttgtttattgcttctggggaaagggaaatggcactggcctgtggtgggtagaggccagggatgctgccaaacaccttacaatgcccaggccaaccccctgcaacaaagaattatccagcttcaaatgtcaaatgtcagtagcactgaaggtgagaaaccctattctctcctggaacacctccagtgatattatttctcttcatcaattcagcttatttctatagaagccaaaaagcagcccacaataagggttttgctgatacattagtactttgttgaaatgtgttttgtgaaattgactcttcagtaaaagtagttgtgagattaagaaaataatagaagtgaagcctgaggagtagggaggacaggatggtttctagctcatctatttcagagtcaagccacacgggacaacttggccgtctttcagcacatcatgcacattccacctcctttcctttgttactcatccatcagcactcagtctaaatgttactttgtggaaacatctccaaatttaatccattcttagaaaagcaccaatcactctctatgctgtatctgtgaaatactttacaactatttcagttttttcaccaaatcatgttcacgtttgtatgcccatcatccagcatgaaatccacatagctggtcttcactaaatcaatgtaattatttaattactattattagtaattaagataataaatataagagggttttgaaaaatccagaataagaattggtaaatataggtgagggagactttaagaaaatatagattcccatgccctaccctgctgaggatgcctggaatcttgttctaagtgtggaaaatgtcacctggtacccagaggagacagcctggggggatgagttggcactgaggacactggggtcagaagcagtattgatgtgtttctgccaagtaggcagatcagaccagagcagaaccgtgctgcgcaggagccaggccaggcgctggccaaaagctgggggcaggagggagcttgtccaaaatgagagagaatatggatccaaagaggcagacggtctgcaagaaattgggggtggggggggattagaaatgcagataaagtcatgccgtggaatctggaaggagaaaaccgtgccagtccctgagcagatagagcaaggacaactctgggagttcctggatgtgaatcacagagggcagaggaagaacgtattcatgggattgcaagtttattgttttaagttgaggttcggtttaatgcgacccactactgcctgagacctcggcagttcatgagccgtggcaacagctcatgtgatggagggaggggcagagagcatacgtggggggaaggataactgagtttcctgttcccaggctccaaggctttcttggagtgctgtgattctctggactgcagaaggctggccttagctgagagaccagactttgactctgtggaagaaaaccgagagaatccagggcctggtgctattgccagctccccatgtgtccccagtttttaaatcttgtgccacacgtcagtgtatatggctgtgaacctgccatgaaaccataatattttgagtttaatacatacactcctgtttggataatgagtaatcataggctttagaactaaaaggctgctcaaagattctgtataccaaattcttcaatttgcagatgagaaaactgaggcccagacaatggtgaatcatccaaagttaccccagcatattactttcagagtcaaatttagaatctgagtgacctagttcatcagccagggtccccgccccattgtactacactgtctccagattaggaaaagggaatgactcctgatttgttattccattttataccttatatcccatttaatggccacaggcagcttcactggtggttattaaataggtaatttagttttcctgagccacacttgagtaaatctctttgttttgttgtcacaatctacaaaaagctccaaagaatctcctccagagctggaaataataaaaacacctgctattcgagttccttccaaagagctcaaagcagttatttttatttcacctaccaatcgttgaatacctatgctgtgccaagtgttttgctaggtacttgactattcactattgtgagctcacaaccacactgtgagctacaattatttttggactttaacatacaaggatgaaggtttaagaacctgccaaaggttacattttaataaattataaagttgggttcctggacccaccgattgcagagcctatgagctctcccgtgttgacctggctagtgaatctatttgtgtgtaggtatgtttgtgcctttacttacgttagcccatacttacaccaatgcatatttgtatctatagtggaagatagagcttctgcttaatatccttctggacgtttgtagatctattttatggatgagaaagttgaggcccagggtggagaagtgactctaataaagtgtatttaaagcagcacaggagtctgggttccatcaatcatggggaataaggccaggcttattagatcagggtaggaatgggatgcgtagctattggggttgtgtggtggagagataaacaatattaatgttgacgttaattttgtttactaaatttgttaattaatgcttacaatctcaatctcaaagattaatcttaatctttttgtagtgacttgctgtttttaaactacccttggaatagggaaggtatttttacctcccacgaatggttgggaaaactgaccttcgaggaggtgaagggatttgcctaaggttacaggaccaggaagactggatccaagactcaaacccttatttgtgtgcctctgtcttcacatcagctttagtgcaacccttgcatcaaacaatggaaaagtagtacctagtaaatggagcaaggtgtcttattctgtgcccagagcctctcattttaaacaagctctgatcatctcatctactacagaactgtatctggtattctggggccatttttaaacagaaggtttcacttattctctcctgtattagtatatggccgagaaaattagctgagctgttattttcctttgctgaactggggaacaaaaacaaaaaaacacacagtaatccagccactggttctgacactgccaagcacctgttaggaggacttcctactccaagttcaaaaggtacggactgctagaaaagtgtgtgtttgggggcccagagtctaagattgcacttgcgtcactggctgcaagagtaggatcaggtccactgtttttcatggcacaaaaactcaacagatagtgcttcacatccatatactgtttctaagcactaatgtttactttgggtcttgcacatcagcagctgatggtgggaaaatacacatctctagttattgccccaaggcggcagcctcacatctaaactgctggcttcttccttattatctctccacaggcctggttcatttccttgttttcagttttctcttagctgtgcattcatatcagtcattgtaaagagcaaagagaaataattttaaaaattttccatatgggcatcttgagcattgcctcagtacactctgtagctagtatagatatctggggaaactaagaaggaaaatttctttgaatatagaaaaatcatactagtctccagttatatcattcaacagcagtccccccagcccacctttccatacctctaatctgtatctgtgctttgtactatgactctgatgtaagagtttggctctctgaagatggtaaaaatttaaatgcttgaggtaaacacagtaagatagttaaaaacacactactggttccatcagctgtctctttgcccttggaagtcatctgacactgatggcagcagtgacccatctggagcagccactgcgaagatgctggctgcagtagaggaatgcactctgcagagctggctggggccagaacaggtgggagccctgtcccctaccaagttggcagggtgggagccccatgctcccaggcacatctgcagccgcccagctgcggctctggacctgggcatccctacgctctcaggggcccaggaagccccccttcctttgcagacttggaaatgcttgctcctactccctggcctcttcccattgctggtgcctgctctggagtggggcagagttgtggctgagcccagtgctgtcacaatccagccaggtgtacatgcacttgaggtggtgctgacacgctagcctcctgccaccttggccctctctggaccttgggcgccaacgagcatggcaggagctgagggcagctcggctcaggcctgcaggtgcctcagtaggaacagactgggtggcgggttgatggcaggaggaagcagacaggctcctgggcagaaaggagcgggtccctggcgaaaccccaccttcaagccagggacagtccgaagcctggtggctggactgccagttccaagtggagtctgtggcccagagtgagaacttgtgttgctttttctgggtccacccatggctacccatggaccaatcagtactcatttcctcccttctgagcccgtaaaaatccctggacccagtcagacacggacagactcaggactaccagctgcaggaaggagctacccactttgggtttctccacccattgggatgacctgcctgcagaaaggagctacccacttcgggtctcctctccactgagagctggacactcatctagacgacctgcctgcagaaaagagctacccactttgggtcttctgagagctattctgtcactcaatgaagcttctctccaccttgctcaccctgcagttgtctgtgtatctcattcttccaggttgtaggataagaactcaggacccactgaatggcaggactgaaagagctgtaatacaaacaaggctggaaacacatccctccggctcactcgctactttgtgggcaatgaggagagaagagctgtggcccttcatggagcccagacctaggggctccccaagccaggggtgtgacactgtctttaaggctttgaggttcatggcatctccaagcctccaggtgcccgtgttcccctcatccagatgcgggtgcccatagcagaagccccatgcagcacatcagatccagctgcagccttgcgtggagctggcacctgtgccagcacctgtagctgcctcccctgccacagcagcttgcttgtctggttgtgtgcagtggccggactctgcacttgctcacccacacacccctcactgctccacgcctgggtcacccttggtaggtgtgggatccaggatggtggcgtgagctgagcccagcctgctgggccaagtgggtggaatgagcccagcaggcacgagcaatactcaggcagaagatgccaccagccacagaggtttccggctggcaaagtgacaccccgaggatcccatgacagtacttcatgcctcagttcccccatctgagaaatgggaataatagtacctcttgcatagatttgagtaataaatgagcttttatttgtaaagcacttagaataatgtctggccatactctgtgtgtgtttagctatgattaatgtgattgcagtaaagttacattatgaatagtagcagtgagcaagagaaaatcaaagatttattacttgatttacaggtagatgacgtcttccttctgtgtgtcaggcattgttataggtatgttagatacagtggtaaacaaagccaagctccttctcttatagagcttctatcctactggggacgttcataaactcccatttaaacatatgtatttataggtatatgtaagtatacatatatgtattgtatgtgtgcataactgtgtgtctctgtatatgtgcatatttataagtgtcttcatacacatgtgtttatgcatggatctggtatttatacatgtatgtgtattacatgtgtatatctgtatgtagttgtgcatgcatatgcatccatgcctgtgtctgaatgcgtgtgtgtatgtgtatatactgtgcatgcacatgtttgcatgcccctatttgtatgtctgtttatgtgtacatttatgtgtgtgtctgatttgtgatgtgtttatgtgtatgtgtgtatattctaatgttcatgagtgtatatgcatgtgtccgtatatatgtatgtgtatatgtgagtggatatgcatgcatgtgtttgcatagggtactgctgagtgttatgaagaatagtcctgattaaagtgatggaaagttccaggaggtgctactggtatacagaggtcaggaaagttcagtctagaatggggacatttgaggaaacataccttaatgaagagaggaaatatttcattgtgtaaaaagcaaggcagagattttttcaatcagcaaatatatgttgagcacatactttgcctcaagcatgtgctgggcactgggaataccaggatgaagatgacccagtcccttctctagatgactcagcagctggtggaaatgggagatctgtattcagaaaaatcctaatacaacttgcatactgcttttccaggcggtgtaaaaatgttacaagagtatagggaatggatcagccagctcttccaggacaagttaggaggtgaaaactcctagaaagtgaaaacttggataagccttttaagaagcagtagtagaatgtgcagaggctcagggacgttaaaatgcccttcataatcaaggaacattttggtgtggccacctcgccattcaaatgtgcgagaggggcagcgagaggcagccgggaagacggagcctgtgtagcacactctgactggaatcagactgcctgggttcaaacccctgttttgccacttgttagtaaagagcttacctgctctgtgcctcagatttcccttctgcaaatggggatgggaatagtgcctcacagggttattttagagatgccttctcctgacacattgtaagcactcaacaagtgttagctactcccagttggaagctagaatgtaaaaggccttaaattcccagccaaagagattgaatgctaaaattaatttcaagcaaacctatctgttcaaatagctttctcagcactgattttgatgtgaaaaatatctggaatattcttcgttatcaagcatgtgccttggtagtgtaattacagtttttaatactaatggatgatcttccattaaagtagtaaaaagataccatctcattttaagcttagagcaaaagcttacttaagtgaaattaagcagatatttattttgtcaggctctggggaggattccgaaattatttgctccctactagtgcctagcactttatctttgcaaccgcacttaccctgtagagtcatagttgcacaggaaactgtattcctgcatctctaccttcagtgtttcacgatcactgtttctcatctgccaggcctgagggtgggcagtgctgatttcactgtctcatacccactcttctttctgccagtgtcttttgtgagagcaattttatctctgcccctttctcttcaccccattgtctcttctccagtcttcaaacccaaacaaaaaacatacaaagtttgctcatattcactgcagtctgagctgctgaatgttcttccagagccccttaggatttctgcacccatacttgtaaatgtttgcatcttcattttgttggtggtgatgacaaattaccccacataacttgcctctgttcctgttttagttagaaattactgtttactggagacagaatggaaaatgtatgaaggggcaacatgagaaaataggttattttgattacttccaatcatccatcgttaatcgaattcataatatagataaccaaataaaaagattatttcaatttaaacttagaatgacttataggtttttttaatctgatttccattcttattacttcttgcagcagttttcaaacttgagtctgcataggcattcatggagctagttaaaatgcggatggctgggtccccaccaccacaactcattctgatcagtggctttaactggggcctaaatatctgcactgtatccagcccacacatgagcctgatgaacttcaccagtggtaccttaaaagatagcaagaggggcagactaattagactcaacgttgtttaccatcaaaaactgtctgtacataatccagaaagagcaaagttgaatccaggctaattgaaagactgcattttaaattttttgtttcaaaagtagagcaataaagagtttttccaatgtgttatacttcccatgagctggatactacctgtttacctagatgccacttaatgtggacagcaacttttatggctgtgcacattctcaccacccccatttaaagagaggaaggagactcgcttagactcaggcagctagtgtggttgaacagagagaaccttggtctgtctggccccagcttgctctcttttaccattatatagcttcacccaagccagcgttaacagctgtagatgattttcttctaatgttctaaaacctgaagacatggggcatcttttaaccaaatgctcagctctagggaaagctaagcctcttctattttgttgaaagataaagtgttaggctgtcgatctgtattgttacaggtccctgggctggatttagcctcaggagttaaaagtatatcagccttgtgactcaccaccatgaaaccctcagatgggagtctcctaccagtatcaataatatgaatgaaaactttatatgccttctggattgaggcctctcacagctcaaagttgtaaagaaaaacccacgcaattggattttgtgaaatatattaaatatgcccagtaatgtggctcttcaaaggaatttatatactgtctgctttactgtggtgtatcattatagctcagccaaatgcgtggcctaataatttgtttcccttatgcatatccatcattaaatgtaacatgcagacaataactatttaaacacctaaatagatgattatatagctgtctgtcccacttagactgtgaactttttatgaacaatggaatctagtcatcttcatctctgtgtctcttagctcagtaaatgaatgaatatatgcatgaatgaatacatgcgtgaatgaatgggtttgcttaacatgctaagcactagactagttactgtggcaaatacagtgatacaaagaaatagaggcagatggattgagttctacaggaattttaaaaagggaagaatcactttcagttgaaacagtaaggcaaagaaaagacaaaaatactaatatttattgagggaccttcctgatagaaatatgctagagagtctacatgtataatcttcacattgactccagcagcttgctcaaggtcacacagctggcagtgagaaccccctgaggttagctaccatggtccttctgggaagtgggaagggatagcctttgaatgaatctgggagaataggtgtattctccactggaagcaatgaaacgtagagtattctggatggagagaataacataaatggaggcactgagatgaggtcgtggaatggtaagcatttcagtttggctgaaatctatgatatctctaagggattcctggaagaagaggatataatgatcaaataggtggagatagattgggagtctgtcccatctgagtaccgttttggagtttgtgcttcctctttctccctggaggcattggcaaatcattgaaggtgatctcaagccagagattcattttaagcatggctttatatacttttatacacaatagttgggggaaaaggcaaagaggtttcctgaaataggttttggcagtggggcttgaaaagaagatagggagtttgacaactttttaaaacaaatccatgcattaggcacaagttatttaaaatttttgatgttctttatattcttctagctctttctatttacatagctattactaaattaaatgtataaaagtatttttcctttttaatttgaaatagatttcatctcatatttggcagaagataataataacttgttaacttcaaggcagtcagggtaattcatccagtctcaaactgggcattcatttaaatctattgtcttagatggagatatctagtatactcactcatttaaagtagagccgtaaatcctgaagttaaataagcaaaacaaaaggcctcccaaagctgagaaaacacttgccatagagtgcacatactgtaggaaagtacaaggattattctccggctgtcacccagcactgctaacttagaattatagataaaatatgctgtaattttaataattaatagctgactatgcaaaaatattattttctcctagcttcaaccaacaggtaacatatctgcctttcatgtcaggtactgtgctaggtactaaagatataaatatgaacaaattatagtctctgtcctcaaagagctcccattctgattggacaaacaggcaagtaagccatccgagtatgatgtggaaagtgtctgataaaagcatgtctgggctattacaggagtctaacctcactttacctgagcaagttagtaaaattccctccccttcccccaaaaatgattggtttgacacttaaagatgaattggagggagaaataggaatttatcagatggacaagacggctaggcaggaaggagggtgagaaggagagggaagcagagggaggtagtatgcaccaagatccagaagcatgagggtacccctttggctgcagaataccgagtatactatagtgtagagtatgctgaaatagaagtgtgagagatatatgtggggacaaagtttttgagggccttgaacatcatttaaaagagattggaatttttatccttaaggtactagcttgtaaacagaaactttagaggcagtgaggttaatggaccagaagacgggactgttgtaagagaccttgaaggccagaactgacgcagttccaaggcagtatcaatggaacaagaggggacattaaaaaattaaaaataggctgatgaacagtgatggggtcctttaatgcatgggcttaaagtgctacatatatagctctctgaagcaagagtgcactggacaatgatggcatggcactatttaacagaagtaagcagagtctatgtgtcaggaggattgagtgtaagtctcaaatctgcccttaccagttatgtaacttctacaagtcacctctttaaacctcacttttttatataggtgtgaagatcaagattcatgctttttcttctaatatatccacttttatatgccaaaattttcctactattgaagtggtattgttggaataaatgtgatcacaaatagaatgtatttaattcattaatttattcacttgccatttattgaatttttttttctggcaacaatgggctgtcctcttggtcccccaaaataaaaagctggtgaaaattaaatgtatccacatattcaactcacaaggcaccagagagctactaaaggacttgaggggccaagatcaaaagagaagcctacagagctgggttcaacatttccacccttttatacgctgagcatttactgacttgctgagatttggactcaacatttccaccattttataatacactatgagcatttgctgagttgaaacctgcaactcagaggccaagaagctaaacaccagtttgggcagtctgcaggctggaagtatatatatttgagtttggacatcattgaagagggagaatactagtaaatcctctaggtgttatttgggaccccgaaagtcagtgtaaactaaaaatagacaaactttacaaaggccaaagcctgggtttgaattaaattaacatctgattaaattcagatcatctatccctacttgagctaactgcaagaagcaaggttatatcctttctagaggtaggtaacataatcagaagctcaagttataactaaaaggtttcatatgtaatgtctgcattgagtagaaaataagcatgtaaaatatgaataatttcaaaaatcaagagtaaaaacaaagccacagaaaagtccatatgctggtggtatttgacatgaactctaacatatctgtgattaatatggtcaacaaattataggagaagatggagaattcagcagagatctgggaagtagaaaaagaagtggggattctagaattgaaactaataactgagattaagaattgactaaatggagtaaagtcaacagcatacaatataattgaaaagagaattagagaactgaaacatagatctgaaaaatctatttatactacagccagtatacaaaaggatggaaaatacatgaaatacacaaacaagtatgagatatatggagcatggtaaagaggtctaacagaggtgtagttggagtccaagaatgagagaagagagataataaatcatacatagaagctatatttgaagagatattggccaaaagtttttcaaaacttataaaagaactcaagtgagttattttaacttttgaataatcaattaatgcaattccatattaaaaggatgcaagagaaaaattaacagttgtttacaaatgcttttgatacaacttagcacatattcatgatttttttaaaaatcatggcaaactacgagtagaaaggaacttattttgattaaggatatcaacaaagaaaaaaacataatgcaaatatcatacttaatggtgaaatattacaatgttccaattcttaccacgtttattccacagggcctatctagtgcaacaagtcaagaaaaataaatggaaaatataagaattagaaagaaagaaagctaacatcatagatgatacaattatacacatatagaatgtcaaaagaatctatagataaaatattaaaattaataagtaatttagcaaggttgctattgcagaaagtcaatacaaaactctattttatttctctaatccagaggcaaccatttagaaaataaaaattttagggaggagccaagatggccgaataggaacagctcccgtctacagctcccagcttgagcgacacagcagacggtgatttctgcatttccgtctgaggtacggggttcatctcactagggagtgccagtcagtgggcgcaggacagtgggtgccgcgcaccatgcacgagctgaagcagggcaaggcattgcctcactcgggaagtgcaaggggtcagggagttccctttcctagtcaaagaaaggggtgacagcacctggaaaatcgggtgactcccacccgaatattgcgcttttccgacgggcttaaaaaacagcacaccagattatatcccgcacctggctcggagggtcctacgcccacggagtctcactgattgctagcacagcagtctgagatcaaactgcaaggctgcagcgaggctgggggaggggcgcccgccattgcccaggcttgcttaggtaagcaaagcagccgggaagctcgaactgggtggagcccaccacagctcaaggaggcctgcctgcctctgtaggctccacctctgggggcagggaacagacaaaaagacagcagtaacctctgcagacttaaatgtccctgtctgacagctttgaagagagcagtggttctcccagcacgcagctggagacctgagaacgggcagactgcctccttaagtgggtccctgacccctgaaccccgagcagcctaactgagaggcaccccccagcaggggcagactgacacctcacacagacctgcagctgagggtcctgtctgttagaaggaaaactaacaaacagaaaggacatccacaccaaaatcccatctgtacatcaccatcatcaaagaccaaaagtagataaaaccacaaagatggggaaaaaacagagcagaaaaactggaaactctgaaacgcagagcgcctctcctcctccaaaggaacggagttcctcaccagcaacggaacaaagctggacggagaatgactttgaagagctgagagaagaaggcttcagacgatcaaattactccgagctacgggaggacattcaaaccaaaggcaaagaagttgaaaactttgaaaaacatttagaagaatgtataattagaataaccaatacagagaagtgcttaaaggagctgatggagctgaaaaccaaggctcgagaactacgtgaagaatgcagaagcctcaggagccgatgcgatcacctagaagaaagggtatcagcgatggaagatgagatgaatgaaatgaagtgagaagggaagattagagaaaaaagaataaaaagaaacgaacaaagcctccaagaaatatgggactatgtgaaaagaccaaatctacgtctgattggtgtacctgaaagtgacggggagaatggaaccaagttgaaaaacactctgcaggatattatccaggagaactcccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtagggttatcctcaaagggaagcccatcagactaacagcggatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcttgaaggaagtgctaaacatggaaaggaaaaaccagtaccagccactgcaaaatcatgccaaaatgtaaagaccatcgagactaggaagaaactgcatcaactaacgagcaaaatcaccagctaacatcataatgacaggaacaaattcacacataacaatattaactttaaatgtaaatggactaaatgctccaattaaaagacacagactggcaaattggataaagagtcaagacccatcagtgtgctgtattcaggaaacccatctcacctgcagagacacacatagactcaaaataaaaggatggaggaagatctacctagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatgtgcacccaatacaggagcacccagattcataaagcaagtcctgagtgacctacaaagagacttagactcccacacattaataatgggagactttaacacctcactgtcaacattagacagatcaacgagagagaaagtcaacaaggatacccaggaattgaactcagctctgcaccaaggagacctaatagacatctacagaactctccaccccaaatcaacagaatatacatttttttcagcaccacaccacacctattccaaaattgaccacatagttggaagcaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatcttctttgaaaccaacgagaacaaagacacaacataccagaatctctgggatgcattcaaagcagtgtgtagagggaaatttatagcactaaatgcccacaagagaaagcaggaaagatccaaaattgacaccgtaacatcacaattaaaagaactagaaaagcaagagcaaacacattcaaaagctagcagaaggcaagaaataactaaaatcacagcagaactgaaggaaatcaagacacaaaaaacccttcaaaaaattaatgaatccaggagctggttttttgaaaggatcaacaaaattgatagacctctagcaagagtaataaggaaaaaaataagaatcaaatagatgcaataaaaaatgataaaggggatatcaccaccgatcccacagaaatacaaactaccatcagagaatactacaaacacctctctgcaaataaactagaaaatctagaagaaatggataaattcctcgacacatacactttcccaagactaaaccaggaagaagttgaatctctgaatagaccaataacaggctctgaaattgtgtcaataatcaatagcttaccaaccaaaaaaagtccaggaccagatggattcacagccgaattctaccagaggtacaaggagtaagtggtaccattccttctgaaactattccaatcaatagaaaaagaaggtatcctccctaactcattttatgaggccagcatcatcctgataccaaagccaggcagagacacaaccaaaaaagagaattttagaccaatatccttgatgaacactgatgcaaaaatcctcggtaaaatactggcaaaccgaatccagcagcacatcaaaaagcttatccagcagcacatcaaaaagcttatccaccatgatcaagtgggcttcatccctgggatgcaaggctggttcaatataggtaaatcaaaaaatataatccagcatatacagaaccaaagacaaaaaccacatgattatctcaatagatgcaggcctttgacaaaattcaacaacccttcatgctaaaaactctcaataaattagatattgatgggacatatttcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggtaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagatccaaatcatgagtgaactcccattcacaattgcttcaaagagaataaaatagctaggaatccaacttacaagggatgtgaaggacctcttcaaggagaactacaaaccactgctcaaggaaataaaagaggacacaaacaaatggaagaacattccatgctcgtggataggaagaatcaatatcatgaaaatggccatactgcccaaggtaatttacagattcaatgccatccccatcaagctaccaatgactttcttcacagaattggaaaaaactactttaaacttcatatggaaccaaaaagagcccgcatcaccaagtcaatcctaaaccaaaagaacaaagctggaggcatcacgctacctgacttcaagctatactacaagggtacagtaaccaaaacagcatggtactggtaccaaaacagaaatatagatcaatggaacagaacagagccctcagaaataacgccgcatatctacaactatctgatctttgacaaacctgagaaaaacaagcaatggggaaaggattccctatttaataaatggtgctgggaaaactggctagccatatggagaaagctgaaactagattccttccttacaccttatacaaaaatcaattcaagatggattaaagacttaaacgttagacctaaaaccataaaaatcctagaggaaaacctaggcattaccattcagaacataggcatgggcaaggacttcatgtctaaaacaccaaaagcaatggcaacaaaagccaaaattgacaaatgggatctcattaaactaaagagcttctgcacagcaaaagaaactaccatcagactgaacaggcaacctacaaaatgggagaaaattttcacaacctgctcatctgacaaagggctaatatccagaatctacaatgaactcaaacaaatttacgagaaaaaaacaaccccatgaaaaagtgggcgagggacataaacagacacttctcaaaagaagacatttatgcagccaaaacacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttgaaccattgtggaagtcagcgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgttagggacatggatgaaattggaaatcatcattctcagtaaactatagcaagaacaaaaaaccaaataccgcatattctcactcataggtgggaattgaacaatgagaacacatggacacaggaaggggaacatcacactttggggactgttgtggggtggggggaggggggagggatagcattgggagatatacctaatgctagatgaggagttagtacgtgcagcgcaccaacatggcacgtatatgcatatgtaactaacctgcacattgtgcacatgtaccctaaaacttaaagtataataataataaaataaataaaaatgtttaaatagcatgatttacaataaaataaaaatattaagtacctaggaaggaagatgtgtaagacatctatgcagaaaggtataaaacattgagagtaactaaagaagtcataaataaatcgagggatatatgatgttcattgattggaaaacagtattataaatgtgacagtttcttcccggttgttctatagattcagtgtacttcagttcagcattctagcagatttgtgtgtaagaggatggaaattggtagacatcctaaaacttagatggaaaggatcaataataagacagtcttgaaaaagaacaaagttgggaaaactccataatgccagatagcagaacatattacgaagtaattaagaatggtattgagggaaggacagacaacccagaggaaaacagattaaggagcccagaaacaaactcacacatgtatggacagttaatttgtggcaaagatgccgttgccagagctgtaaggaagcaatgtatttttcagtgaaatagtaccctgccgattggttatcactatggcagaaattgaattttggcccttctccttatactatgcatacaaatacattccaaacagattaaaaacttaagtatgaaatttaaaaaaataaagttcctaaaagacaaggtcttcatgactttgagatagacaattttcctaaataggacattaatgtaagtacaaccataaagaaaaggattggtaaataagactatgttaaaataagaaacttcttttcatcaaaagcttccattaaaagagtgaaaatgcaagccacaaagtggaaggaaatagttgcaatgcatataacaaaagatgtgtatccagagtatgtaaagaatgtctacacattaatgagaaaagaacaattattttgacagaacaatggttaaatgtgtataaatgtgtgcatatatacatttgagcagctttgcagaaaagaggatatacaaatggacaataagatacgaaaaattgtccagccttgttagtcattaggaaagtccaaattaaaaccatactatgatatcactacacaccctgcaggttggctaaaatcaaacggtttgataatgccaagtattgatggggatatcaaacacctgaaatgctcaagcattgatgtggaaatatgaccacactttgggaaagagtttggcagtatcatgataggctatgattcagcagtcctattcttagacatatatccaacagaaatgtgtaccagaaaaaatacgtatatagtaatacatgtaaaaccattatttgcaataggcaaaaactgcaaacccccagttcccatcaataatagaattcatcaatgtttggtatattcgtggagtaaaggattttatggcaacaaaaatgtacaaaatattgctacatgcagcagtgtggttgaatctcacaaacatgggtgactgaagctggcacaaagaaaatacaccgaatggtttaaaaattaagcaaatcctgtggtgtagacatctggacagtggttatctctggcaaggcatggtatttggaaaaggacatgaggtttatttcttgatctggataggtgtgtttactttgtaagactccactaaattctatacttaaaatctgtagctttttaatgtaggttatacttcattgataaggtttattaaaaatatcaaaggctctgggccgccctgtgctaggcactgggaatgcagacatgagtatgaaataacctggctctgaagaacggagaggaggaggtgagtggtaattaataaacaattagagaaggagtttgttagaagtgaagtcagggtgtgtcactttatatgtcagcacacaaaggagcaactcccaactcaacacacttcctgcctgtattaggtgcttcataaatgttaaattctactcccaccttgctatactcataatcatgagtaatcaagtaagggaaaaattatgttatgaatcctcttttttagtgcacaatccatgttagtgatagtggtggcaagtaggcttttttatttgtctgtttgtttgtttgttttttgatgtctttaacagtgagccttcctcaaacaatgtattagatagaattgcaacttcctcagctgaaattatttcatcagtgattactttctccatggaatgttaatacattgagtttctcttgtatatataaccagggattctgagcctctttcatctctgccttgggccacacagccccatagaaagatgatggaagggagaagaagggaagaacacctgccagcctgccagaatttcggctatagattggcaagcagacagctgaatggagggaggatatggacaatgaaaaggaccatctaacttgagggcacagtgcccaccgacagcacagcaggtgctgccaggcctgtacagagctggaaatcctggcaagatggtagctgctccatcttgtctggcctagttactgcctctggcccatgctgaagggagtctggggagttaccattccaaagaactcacaagaaaacagaactgacttggatatattccaggtttgcctagtggtacttcaaaatggtagattgaatgttattttaaaagtcattttaaaattatttcctttgaaatacagaatttaataggagaaaaatcagaaggagaatgaaaaataatatggatatgcagaatatatccgaaagaaatgtgtacttcaatgtaccaaaaatatgtacagggatacagataacaccatttcaacagcttaatggttagaaagaagtatgatttctggagccagactacctaagtttatattccatgctgtcacctactgtctttgtgatcatgtgtcagttactgaacgtgctgagtctaaatatttcatctccaaaatgggcatcatcatagcagttgtaagaattaaataagttaatttacctaaaacactcaaaacagcacctgtcctgcgtaaatactacacaactactagctgctgctgatgataacagctaagccatttttgtggctgagagtcagcagccacagccagggtggaggagatccttgtaatcataaggtcagaggaaagagggcctcagtaaagaaggcttcttaggcccatacagcgggaattacttcttgccaaaaggcttgtttgtcctctcttgaagccatgattagtctgcctctgccatgtcgttggctcctcaggagattacaagctctctgaggacagagattacattttttttcaagtattatttccccagcagtgctgagcacagtacctgatgtaaagttgtgctctgtaaatgtttactgaattgaatccttctaaacagaggagggagatactattaatcagggctgaacgtgtgacagcactgttctttcaagccaagactatatgtatgttctttactttttttttttttttttttttttttttttttgagatggagtttcactcttgttgcccaggctggagtgcgatggcacgatcttggctcactgcaacctccgcctcccgggttcaagcatttctgtctcagcgtcccgagtacctgggattacaggcatgcaccaccacgcccggctaattttgtatttttagtagagatggggtttctccatgttggtcaggctggtctcgagctcccaatctcaggtgatctgcctgccttggcctcccaaagtgccgggattacaggcatgagccaacacacctggctttttttacttttaaatcatcatttcccttttagagatgggatgtcagaggcccaaaaaactcagttcatttgcgtgaggtcatgtaaatggtgatatctggaagtgtctccctcaaagtcagtgccctccctcacaggcactcattccctaaggcacctaggatgggcacagagaaaggagaaccaagcttggctggggctgctgtccagagaaggtgggcaggtgtcaagagcaggtgcagaggtggagaggagagctaaatcttgtcctcagtagaagcagagatgtcatttcaactgcaggttttgaaaaatgtcagtgcatacttcatgagattttctgaattcatttttactctcatcttctacactatttatctaagctgttgttctctttgaaactatgtcagccacatgtcattcattgtgccacaaccctgggctttttatcctgcttagggttttgttttgttttgcttgttttttctccccagctgctctgcctatcacttaattctctgagccctctggcctgagtcttatccggtggtgtgggtcaccttacaatcccgtttctagtctcctgggagtagtggtggcaggcgagggatagaatcaacatccaggttcagaatctatttgtcttttttggtcttattgtccgaagcttgagtcaaggataaattaatcagtctagaggtgggagagccctctaaccctccccagggaaaatcctagcctttatagaaacttggcctggttttggctctcagatttaattccaagctgtgaagaatctgtcaatgttcaactaaccctgacaaaacctttggaagtttctgttgcaaccgaaactcttatcacaggaggtggtactgagcttggcatcagaggttggagagagaagagagctagcctgctaattaatattttttttccttaaatttcaggcttttttttttagtttaaatgttctaaagaacctgtcctgtcacttcccatctgtttcctggtgttttcctcaagcatctcactggtttgttttatgtttttgaggggattatctggggtgctgattactttccctaccttcaaggagcctttgaataattttataaatgagaccatttgtctaggggcaagagaaggttgctgaaggcaacctagtcctgctttctcccaagagaaattgtacactaacatttgtttagtagtgcctatatcccaagtacaaggctcttgccttatacctaggatgagcaactattccagtttgccccaagataagctggggggtttccttgggtcctggaccttaaatagagtgtagacgaggagagttatcttttcttctgtctatcctaggttcatagctggggcccttttaacaaaagatagattaacaagagagaagcatacacatttatgtaatatgttttatgtgatatgggaggtatcatacagaaatgtagacccagaggaacagttaaacatgagtatttttatgttaggcttgatgaagagtagacagacatggaaaaatatgatagggcaagaagggcatgatttaatggtaataaactggggaacttagcaaagcctgttagtgcagtttcatccgtgtgatccttcatctccagatacaaggatggtgctttcctttgagtacagggagggcacctctcacatgagggtcttatgacctgcttcaggggacagtcagaaaatcctaggtttaatgacctgctttaggggagaatggtgggggaaaggtaagagtgacctctatgcctctatgattttctcagataccttcagcttaaactattcaaaatactaacatgccatattttgggatagcatgtcctgaaccccatcaagtgcagataccaggaaaaatgaccctgtaaaggaaatgccattatttccaccttacaagtgagaaaagtgagtttcgaagaggtgtgttcacttacagaagtttgcacaggaaactggtggtgagaaagaatcaaatatacatctgtcagacttcagacccagaactttacactaaccaacttcttcagaatgcagagttccatctccttcagactgtgtagctcaacagttttgtaccatctggctatttttctctactgtgtatttgactttgtctcttttgtctcagggtgtacttgaaagcctttacctccccatcttccttccctgatggctgatatacttctgcctcacctgctttaggagcccctgcctccaaccatccaaactaggtcaggggctggggctccttccttctgttagactattcagatctgagtcactggtcattcgcatagtgtcttataaatgtctgcctgtgtatttttccaccactgctagactgggatcttgtagaatacaaggaaacaactttcatctttagatttctagcacccagcatagttcctggcttataattggggatcagtaaatagctgttgaattaatcaatttataaattttcaggaagcatttgtgtgccttcgagtcacagtatttgatctatttaaggacttattccataagatgcatttgtgatgcttaggccagttctcttaatttttttttctatttttaatttttacaaagtaatttttgtgagttaacttggctgtttggattagatttcaacctgatactttaccatgcctaatgtctgagaatgagaaattgtcttttctgaagtcatagatgataatgtccaagtaatctagaggctgtgttgaagttaggaagaaaggaatttctgacatcaagtttttgctttgtcttcactgtggatttttctagttttctctaagtctcaaatttccaagctatacatattagcctacctttgagatttgatctttctgggtaggaaggagaaacaggagtgagacccagttatcagaaggtctgttctttgttctctccactcctcgcaatacaaccagcctcttgaattggtttctgattgctctaagtcatggaggagtgtggcatgaagacagaaatgatgaatgccatcccaagttaaactgcagtatgcatggtgctacatgtaattgtggcttttcatgaaataagcagattttggtttattcttaatgtttaaaatgctagcctgggttatacctactacctggtacctcattttccttattcctttgggcccgcaattattttgtcatcagttgtatagtcaaggacagaaaacagatgttccaatcaatctaagtaaacccaaataactctggcaaagcacacaccgtgctgaaatcaaatgaactgttatgccaagccttgctattaacaccaaagattggaagttgttggtagtaacatcaaaaatggtgaaaatatattgagtaaactgtcccagacattgttcccctcagttaatctccatgatagccctataagccacattctatcatcattccaattttatagatcaggagactgagacataggaaacttaagtgatttgacctacttgccagacttgaaaccaagcagtcgagttccagtgcccttgctttgaaccattacgccctaactagttcatatatctagtaaatgtctgtttacatctcatgtagaaaaagaccttccctattatcttgctctgcagagggtgggagggttggggtggggagggggcagtggcagtgtcaaggtgtgtaaaatttctctgttgacttaaagcataggatgatgatgatgatgatgatgatgatgatgatgatgatgatgattattattattattatttgagacggagtctggctctgtttcccagtgcaatggcgcgatctcggctcactgcaatctccggctcagtgcaagctctgcttcccaggttcacgccattctcctgcctcagcctcccaagtagctgggactataggtgccgccaccacgcccggctaattttttgtatttttagtagagacagggtttcactgtgttagccaggatggtctcgatctcctgacctcgtgatccaccctccttggcctcccaaagtgctgggattacaggcgtgagctaccacacccagtgcagtaaaagtaaacctactttaggatttagttggggtaagttctagaccacatttctttcaaggtcaaagcaatacttcatgaaacattgggattacctttttgacttttttttttttttttttttgagatggagtctcgctctgtggcccaggcttgaatgcagtggcgcgatctcgattcactgcatcctccacctcctgcattcaagcaattctcctgcctcagccccctgagcagcttggactacaggcgcgtgccaccatgcctagctaatttttatatttgtagtaaagacggggtttcaccatattagccaggctggtcttgaactcctgacctcatgatccacctgcctcggcctcccaaagtgctgagattacgggcataagccaccatgcccggccacctttttgactgttttactccccttcatttgctaggcttgaggttaaccctttgggtttgctttagtggcattttgacagtaagtcctgaaagagatctgagttcagctatcctattgtctaggaatagttggagttcttgtaagtagttgaaaagaaaggaactagcttctgtgaactccacgagataatgtaggataaggtagaattagagtcaggtagatctgggtgtgatatagtcccaccccgaggtcccccacaatttagtagtgtgggaccttgtagaagttgcttggaaaactttactctccttttctctatttgtaaatcaaagtgataataactaccttgcagtatcactgtgggaatcaaatatgataatatttgcaaagtgtcaagcacaaagcaatctcccaataatcaaggatcttagaacctttagtctttaccagtgatttttgacaaggtatgttgtgaggctccagtaattacattattacccatgagttgtcactcaaaaccaatcaatatttttcacctttattcatatttaagacacggagcctttgtccgtgattaaatgtgctattgttacctagaaaatgtcttgtgctttactagtatgtgacttctgccacacacattcatttattcattcattcattcatcaacaataacaacaaaaaatagtgagctactgcagtgtgaagacttgccctggcctccgtttgcttatagtgtagtagagggatttgtttgtgttgtctgtgcagacacataaactaaagttacagtgacagaatctgtagagagtcagaagatgggctacaaaggaaggaggcttggtcggttctgctggtctggggtgttttggggatgtggggagatgtgatcaggaaaggcttctgatgctgcaactgagtcttcaaaatggagttggtgttccccaggattgttatgggatgaggtgtattggtggaaaggatatcctaggcagagggagcaaagtaaacaaatgcttagtggcaaggaccaccaaatcacattcaggaataaggagaaaaggtcccaaccatatggaaccctgctcatgccaggcaattctgcaggtcgtggatggcgtatctcccatttattgagtactggtgtgttccacctaaatctcatttaattctcacagcaactttgtgggtgagtattgctatccaaattcttcagatatggaaattgaagttctaaggggtcaaggcatctttgcccaaggggatgaaagagggattcaagtctaactctgaagaagtagataaacaacaaaaacagcaataacaataataaaagtaataaaaacagcaaaggttcatatagtactaggcatgttttaacctgtaccgttcaatataatatccactagctatatgttgctacttaaatgtgaattaattaggatagaataaaaaattcagtcctcagttgtactagccacattttcagggctcaattgccacatgtgtctggtatctattgtatcagacagtgcaaatatagaacatttccatcatcacagaatgctcttattagcactgttatgggtactttacacctatattaacatatataatttttataatctgtgaggaggatactattcatattgtagagatgtggaaattgaggcataaggaagataagaaacataaagaagataagaaatcacatgatgaatgagtccttatttttaagcactgtgccataatactaactcaatatattgtgttctgtttaacataaatgaatgttagtcaaaataatggacttcagtgtctgcgtgtatgtagtctggtgttaagtcttctgcagagaacacgtctttgatatgattcttatccttccagaagcatacagttgtcaatttgcatgtataaagctggtggtcactagagagtcttctctggagcccttcctctccaggaactccagaaacctcccagccagctttggcaagaaactcactggatgggattcatcagtcagttcattcatccaaatgactgaatcaagagtctcaaacagatgtagtcttaaataatgttcaaaacccttcttatcctttttgatacttcagagaaggtgcctgaggttattaaaagagaatctttttcaagatgccaacacatcagactcaaagactgaaaatcctagttgagtccaacttctacctctaagttactaaataaactcgactaaattacttcacctttctgaaattcaatttcttcaactgtgaactggaaataaaatacacatatcacaggattttctaaggactaattgaaggttacagtgtttgaggatactttgcaagctataaagtactttatatggctataaagtgggagataattataacacaaatgcgagaactcaggatgtttttcttctatataaccttgtaagctttcaaaactgccacagcgtgataaattataggaaaatgtactcttaatcataacatttgcaaagtctcttttttattttacataaatatagtagggactcaatgcttgggtggaagtattgttggttggatgaatgggagagatgaagggagacagcatattaaataagagagctgttcatgaagttttaaatgttccttttttaacattctttttaaacattgcttgatatgaactatgtgtgttacatggagggttgggagacatttaattcattgagttagcctgtttttctgctatttgttttttagttcaacaaacatttattgagcaactgccatcagttgggcattgtgcaagtttcagggaaaacacagttgatgatgtcactgtttttttatgcctgtttcttcatctgctaatttttctccttaaacattttgaggattgcagaataaactgacactggtatggtcatatgaagggccccagcggtaccgagggctgcacttgtgtcaaattgtttcctgatgtacacatgcagcctgtgagttctctgtggatggcaaaatatgtttctccggaaagaagaaagctcctcccaccttttcttgcttttccctgcttatctctgaacctcttttctcggggatagcccatcaaagcactgtgtggccaaaggaaaaataagatgtcagctctccgactcatgtggtcttgcagtgaacatcagctatgcatggctgctgaattggggtggacattaggcagagtgtagagaacctcttgaggggaaatgaggccagtcctgcccaatatatataattttaggtaaggagatacctcagcttgtattttaggagaagcactgtgtatatactgagaatggctgaggaaggacctccatttgtaattcatttctctcattgtggggatgagagaaccagttcaaacttttaggccatttgtggcagaattggggctgaaactcttgtttttctaactcttagcccatggctctcactgagtttcatggtgaactagcacttccaagtatgttttcattatgtaagacaattataacatcataaagtgaggagtatagaaagaacataagctttggagtcagacagaacaaggtcaaatcctggcactgcttcttaaatccatgtggccttgggcaagttacctgaacactctgctctgttcttctacttctgcatctattaagaggaagaaagaatgtttaccttttatggatgttgcaaagattaaatgagagaacattcaaggagctcagcacagtacccagcctatctttgatgttgatatgtttactagaaaggaagaatccagttgtctcttgagagggggttcagatgatgatgatggtgatgatggtggtggtggagagagtgatggtagtgatgatggtgacagagctaccattaaacatctctttttaagcatttctgcaatatcacaacaaccatgtgatgttgtgattttcctcattttatagcagatccttctgtctccaaattccatccttttctcataatagcacactagttctcaggttctaagtctagatatagcagcagtgaatctgccaacccaagaagaaacaaataaatatttcctacacatttctttttccttcattttaattcccttttcgtattgactgaccctgtaacattaactttgcctgtactttatgtttatgcaaccagtaaatgtgggtgattctcaggaattccttgaacctatttatgatactgtggagcagcgtggccaactccttttctgtcaaggatctcagaatcaatatatttaagatcccaagattttgagatgtacagataagtgaacattggttgcctggctattggatttttatcttagagaaaaacctgtgagtcttggtggggaagaaccagcactttggaatcagattacctgaatgtgaatcacagcccagttccttgtgagctgcatgaccctggtgaagttactactcatttctaagcttcgattttcttatccataaaatgaggataatactaataccaatgacattagtttgttgtaagaataaaatgagacatgtatagaaagagcatgtaaaaagagctcagttaaaatgagctcatatcttgggttattcctgtacaaaagcctttgtgccctgaatggagaatcgtgtcactcaggattcactcagcaaaacacaaaccactctaattgtttaaaaaaccagtaacttaatacccaaaaatggcgatcctgatgatggaggagctgagaagggctacattccctgtgaagcaaatcagagatcagtgaaatggaagcagctaccatccccaggctggagggactaaggagggaggagggaggtggtgttctcatagtctgagggcaggggacaccagccgatgctggagccatggcagccctgtcaacagagcccgagtggtggaggggaagcagctgctgcctggcacagaagagaagtagataggctcttgcttccccttgcctgcaggggtagccccacaatactgagcagagcagcggacttgatctgaaaacacataggccaaggattcttgcaggctaaagtctcagacttctattgcctggttgtggatatgtaactactgtgataactaacacagaaagtttggaagagtcttacttccccctgttgctagacctctgaacaatagcagagattcacaggttgctgtgccccagaaggtagaatttggaaaaagcagtggaaaaccctcgaaagctgtaagaggcctgtctctggcctttttctcacattactttctagcaagtatctgagcagccagtgccttcagtatctggggatttgtggtctgatgagacattcccaccctgccgtttacctggctaacttctgcagaattgagtatagactgaacttccttgggcccctataggtgggttagctgcctttgtggcccctcctgtgatacactgatttccctgcactgaaatactccatttaggcttccatctccttcccaccagactgtgagcagggacttgtcttcttcatccttgcatccccaagcatttgtactcttacttcctgtattgagctagctactgtggtaggtcctgggctatgcatgtaagtaagagtgccagctactagcaacttttattatagaagggaggcagatgggatatatgatgttttaaaattacccatgtcttttgtgctagggaagtccattgcatgagactatttaacagggagaatcgtctgtcctagagggtcagggaagccctataattaggagtcggcctgacagcgaggttgggggaatggcattccaggcagagggaagagcaaatgtgaaggtcttgaggtgggaaacagcattaaggattagagattgagagcaaacgtggcattgcctgggagctgatgaggtcagcaggacctgttctctcctgtgtccaagtctctgcgtcctgcctgagcactttccacccccagctttgtgttgtagtcctgcaagtctgcgtgtttgtggcttccacatcacacctagtatatatcgttttgtgcatagaaggggcttattggatatttgaacaaatgaatacaattccaggccctaaagagtctttctagctttcttgtcatatttataactttagttgccctgcaagtatcaaggaatacgagctctatggggaagaagcctgaatttataccatttatgggaaaccctctgctatttggcattctgttactaggaactcgctctcagtcattctctccttcacaattggagttctgcgataagtagtagtaagaatggtgacctagggatgccagaaagattcagtcatcagaccatcctttgcttttgcttctttgggactgagatgtgatgtgttaaaccagattccatttggctccgctccttcttagcagtgaccttgggcaagtcagttaacctctgcagaccttagtttctcctctgatgtctaacattaataatatctatgatagtgttaaaatgagaccatgtatgcaaatatgtagcatagtgcctggtatttagtgagcagaaaataactgatagctgctgcttttattatgacaatcacaattactgccattattataacgttgggtgccatacattgaccagaacaaagcaaaatctgagcaggcttccgaggtttcctatgcaggcaagtatgccctttgggtttctccttgagactgccctacacacaggacccttcctccatgttgtttgactattaaaaagaagatttgttaatgcttgtttttagctttctctccctctttttttatgtgttaaagaggatttgtttttgttttcctttctcacaggagtgattggggcagatgtgagagggcacggcctcatctgtgaggggcagccagtgacgtcacggctggctgtcatctgtggaacgtcttcttgtcacatgggggtgagtccactgagcacaaaggcaaggccaccacacagcaggaggtagcctggaaggagaccctgagtgctggcttcttcaccctttcacttctttcctcttttccctgcctgccccttgtgctttgtctagccagaagcccagctccccactctacctcccttgcttaacatttgctggatctttttccaggggccaaattcttagtaagcatgaaaaggattgagtgctccctttgacgtcaccctggccagagagcccaggcatgaatggtgacatctgatcctaaggtgacaaagtctagctcccccagactgatctgtccctaatgggtagcggggtcttctcggcaaagagtgtctgttttccttggccagggaactctctctcaatcaatataaatccatctccctgggagcgtcctgatgatctatagaattagcctgcgtatcatgacttcaaaagaacactgataagcaattttcactttgttaatttttctccatgaattagtgaaaaggctttctccaagattgcagttaaaatttagtgcctgccctaaaatttatatcttctttaaatgcatgagtctgaaagcattccattccgataagtacccatttctaccatatttttatttaaaagtcattactctgttaaacttaaatcgacgactctttggaattttcccagataagtataatagagggcagagtgggggaggagcagggagatgagcagagattagagcgggacacagcccagggcagaaccaaagcagctatggaggaaattaagtgggatgtgagactgttttgcaactgtagggacccctgagcctttttaccatcagatattctagttcagttgatataaatacatgtacttacttatcaatccctgctcttgtgctaaactgtggatataagaatgacatcggctcagtgggatgagatgaagttataacaggtattagaatataatgtgaggccccccaatgtagatacaaattgaactcatgatactaagcatctgttatgtgccaagcaatatgcgaggtattcttgcacatggcatcccattttctatggctgagggagccagcccgagtggtttccagtcccacttcctcagtttactaagtgtgggcctttgggcaaggtacttaaactctctgggtcccagattcctcatctacaatatgtagagagtgacagcacctgtcagagtgctgcaagaattaaatgaggtgatactaagtgctccacatgcagtaagcacatcacaagggctcactcttaatcactaggactgttgttgttactgagcagaaagcaaacagtggctgactctgcctgggagggtgcagggtgatagaatcttcttgaggtgacatttgtgctggactttaaggaaatagatttccttctgtttgggctctgggcagtcttgaatggaatttttctaagtttaaaaattgcagcatatttggccagacacagtggctcacgcctgtaatcccagcactttgggaggccgaggtgggtggatcacctgaggtcaagagttcaagaccagcctggccaacatggtgaaaccccgtctctactacaaatacaaaaaattagccgggcgtggtggcaggcacctgtaattccagctgcttgggaggctgaggcaggagaattgcttgaacccagaaggcagaggttgcagcaagccgagatagtgccattgcactccagcctgggcaacaagagcgacactccatctcaaaaataataataataatttcagcatatttcttctgctcagcagcccttttgtaaggctcagctgtccctgaagggagagatctgcagaggcctgaggcctctttaagccagaaggcaccagcccaggagccagcccttctttcccttgatatgagtctacacttgttagattgtcttcactgaatactgatttaatcctgtttaaattatctcttattttcacagggatacatctaatcaggcttctcctgggagatctgaatctcaggcatttttaccccactcaattcagatttctgaacagaagcaaatctaaatggatgcaagtgtctctgtgatggcctgcttcttagtcttactgtctcttaatggagatgaggctggctttccctacccatttaatgtacacatttgggacctaaagcgtagaaaagtccagtaattttcccaaagtcacaaagctttgaagttcttgagctaagaactgaaatctaactctgattccaaagctcatactcctccttgcctccctgaattgtgcatgaagatgatgtacccatagaggaatggtgagaacatgggcttttacattgtccagaggcaagcttgaacatctgctcatgcatgttttggccctctgacctgagtgagctacttaacttctctaagcttcagattcttcatccatcaaattggggataatgatgccagtctcacagggttgttgagtaacatgcattatgtaggtttgtacctagcacacagcagacactcaaaaatggtggagattgttattaaactttcctagtgatgtaaacggctcacatgaagcaactgtttgggctttaacgagtttgatgggcagctgcagttggttgcgatgaatgagggccataaaaggccagtttatgatggctgtgttgtgctggaaataaagtccccacccccatcctgctttgtacttgggagtgggaagggaccctctgggccaaggggattaatcatcagctttaatgttatgtcatgagggtgagactgtggtcatgctggcatgggaaagtgcctttgatctcctcaggtgctgggaacccagcaacaataacacctttgtgaggtctaggagaggtgcaggtctgaggaaacactcccagggagactcaaggaccccctttgttgtggttctggcaaataaaaccgccactgtgaggaaaaattaaccaaacagaacacagggaccaaagggtgatgcgggcttttcaaaaagtggttttcagcatgatctgaaggatcctctttcttcctgtctgcttacttctgatgtttccaatttagtagattgagacaaaattcccaggaacgttttgtgcttgatccaggttgcctctttctagatcacccaaaaagaataaatgaatgaacgaatgaccacataagtgagtattggtaaatacttagaagcttcgtacctccaggttcctgttgcttccaggaatctggagaaaaagcctgaggttgaacataagacatgttaataaggcctttgatattttagaagatacaagcatgggctgcacatttatcttccttgtgggtgatttaattaacaggggaaaaatgccattctttttttaactccatgaaagcagagctgcttgttcagagttaattactaccaagtcaccaaaaccccagataatacacagcaggggttagccagaggttgaaaagtcatggggtaagatggagctgatccttgccattgtactgacatccttttcttgagctgtcaggttgggttgtaacttggcaacttgtcttccagttagcatgtcagatggggacaggaccctgggggggtcggggtagggagaaacactgaggaggtaagatttgagcagaacaatacctgaagagagctgggaactacatctgcatcttaaatcgctcagaactgaagttttttcagtcttaatattgagatagtggttctctatcattgaagggatgtggagactcaaagacataggctcatacgctgcccccaccacttactgtgtgaatttaggcaggatgcttcatctttcagtgcctcagtttctgcatctgttaaatgtgagtgatagtatttacccataaagttttgttcaggttcaaattaggccatctttgtaaatgacttggcactgtacctggcacaaaataccaaatatgatattgttattaaaaatgagttgttaatcacatgaacaatccatgtggttatggactagaattagagacatcagtatgaactcatattgggggaacccacccccaatatttcaacgtaggttctttctattttccgtaagtgtcagccggctgagaaataaagagaaagagtacaacgagaggaattttacagctgggctgctgggggtgacatcacatatcagtaggaccatgatgcccacctgagccttaaatccagcaagttttattaaggatttcaaaaggggagggggtgcaagaacagggagtaggtcacaagatcacatgcttcaaaggcaaaaaggagaacagagatcacatacttctgaggaaacagtacaagggcaaattcagaactactgataagtgtctatgttcagctgtgcatgtattgtcttgataaacatcttaaacaacagaaaacagggttcaagagcagagaaccgatctgacctcaaatttaccagggtgggttttttccccaccctaataagcctagggtactgcaggagaccagggcatatttcagtccttatctcaacctcataagacagacactcccagagtggcttttatagacctccccccaggaatgcattccttccccagggtattaattattaatattctttgctgggaaaataatttagcgatatcttccctacctgcacatctgttttaggctgtctgcaagaagaaaaatatggctctttttgcccgaccccacaggcagtcagaccttatggttgtcttcctatgttccctaaaatcactgttattctgttctttttccaggtgcactgatttcatattgttcaaacacacatcttttacaatcaatttgtacagttaacacaatagtggtcctgaggtgaagtacattctcagcttatgaagataacagggttaagagattaaagtaaagacaggcataagaaattattaaagtattaattttgggaactgataaatgtccatattaaaatgaaatcttcacaatttatgttcagagattgaagtaaagattggcgtaagaaattataaaagtattatttgggaactgatatatgtccatattaaaatgaaatcttcacaatttatgttcctctgctgcagctccagccagtcccactgtttgaggtccctgacttcctgaaacaaactcatatttagtttaacatagatgcagatggatgcatatagaaatagttatggatatatatacatatacaggttagtaaacacatatttatttcctggctctgttagctgagatggtctagaaataaggatacctcaagagctagtttttacaagcacatagtgtccagatcatggtatctaataccattatccaatacaaagaaccaggactccttggagaaatagttgattttaggattggaataggaaatatacaagatgagcttggagcatttgcagtgccagaaagttaggaagttctcaacaaaaaagatgagaatatgtcacagggagccaactgtgggagctcccactagccaaaactggaacaatttaagcagtaaaatgaagtattatgaattataactcaaagtataacataaatatccataagaccatactgacataaattattttgaataaataaatcaatgaaaagaagagagacatctcccatgcagaaagattccaaataatttatataaatgttccaccatcaaggaggtggagcataactttccactccttaagtgtgggctgcacatagcgatttccttccacaaaatatggtatggaaaacgggggaagagtaattttacattggagaaatatgagaaacagcatccacgtgacaaggtcaacatcaacaatgataagtcatgttgatagtacgtacccttgatatgatgtaatgaaaatgacactttgtctctgttgtgttcatcccccaatcctataagcccagtctaattaccaggaaaacaccaaacagatcttagttaagggacatcctataaaatacttgaccagtatttctcaaagctgtcatccaggtcatcaaaaaacagggaaagtcagagaaactatcacagccaagaggaacctaaagagccatgataactaaatgtaatatggtatcctggatgggatcctggagcagagaaagaacattaggtaaaatctaaggaaatctgaataaagtatggtcttcagttcatgataatatatcagtgtcattcactgtgacatatatacttgacaagatagtaatgataggggaaatgtaactggatgtgaggtatatatgatctttacaaccatcttatattgtaaaactattctaaaatttaaaatttatttttaaaatattcattaactattcactcataaagaaaacttttttttttaatttacctggctaagtgctaaaagtcttcataagataaaatgtcatgcctgccttcaaagagctcaggcacattgagaaagacagacagaaaaaggagatactacaatacaaaatggtaactactatagttaatgcatggctggagtgtggtggaagtaggaagaaggggctgtcccaagtcttgggtagatgaggaggttttcctataggaagagatatttgcaggatcatggcttccccgcccccactgagacactgttcctgccagcccaatttctgtagtaggccctttcctcagtcttctccactttgtttttctttgctgtgtccacaaagcctcacagctgacttcccctgaggcctgagcaggatgtgggtgtgtatgagccctttgggagggcaccacagggagacagcacagtcatgtattatgaactgatggtcttctgttactagctgagaagagtgggcaagtgggaccagtttctctgtcatggtctctttaacaagtgacattggcagaagttaccagaggggtggagtgggatgggattccacacggtacagtagaccactgttacacctaacaatgaaagtgctgaggtgctgctcagaaggtgcctcgcttcctctttgtttaccaggacctgttgtcgtcagccctctaggaaccagcattctcaggacactctctgtgtcaagactagctctcagactgcatgttttgaaaacaaagtatatgctaggcattgattcggcgaggagagggttgatgtggttcagtggacaatgagagacagactgtgcactcaagaagctcaaggtagcttgtttttcaagacatttgagaaacatagaaacattatgctggactgagtatgtttaatatctctgaacccaggcagtagcaccctttcctcaatcctcatgaggagataagcagtaatactacttgctaccatctgttgaccacggaccatgtactaagcaccttactaaaactttgtatcatgtaaatagctcaacaatcctaccaagtaggcaccatactgtccctcattttacaagttaggagactgaggcaaagagtggttaagtgggtcacacaatgtgtaggaatgcaacactttgagccctctggaagactgaccagagagtccttcctcctccctttcagctgtatagcttccctcaaaggcctagaggaaagggagaacagactcaattaaaagggccaaacatgagcaaatgtttgaacagacatttcaccaaaggagaaatttgaatgaaaagcactggtcattagggaaatgcaaattaaaaccacagtaagattctctactactcctactcatcttagaatggctgaagatgtgaggaactgtagctctcacacaccactggtgggaatgtaaaatgatgcaaccattttggaaaatggtttagcagttacaaagttaacatattcctactacgtgatctagccattccactcttacaaaagcatgtattcatacaaaaatttgtacagtaatgttcataccaacaaataaagctttgtaatagtccagcactggaaacaaccgagatatctttcaagagtgaatagatcaactcttggtgtatcaagagaacaaaatactactaagcagtaaaagggaatgaaccataatataaggtacaacatggattaatcacacaaaataattatgctgagtgacagaagccattaattcttccaggcaacttgcagtcttttgtggaaaagtgggctcaggccagctgataggtagattccccctaaaggcttttgttcctggccttctgagatgctttgtttcacctgactttgccatgttcctggtggactttcagaaacatgaggccagatatccctgcccagcttttatagaaatggaatgtctggatcacagggtagatgtaagttttaagaaactgccaaactgttttccaaagtcactgtaccagaaacgaatgcaaactttcttgaataaaaaatagttccattatttaaattcttgcaaaagcaaactaatatatagtgacaaaaagcagatcagtagttgcctggaatcatgaaatgggcacaacaagggccaggaaagtaggatcaaaaaggggcacaaggaaagatttgggtatgtttatcttgattgtggtaataacttcactgatctatgctatgtcaaaactttccaaatcagacatcttaaatatgtacagtttattgaaagctattagctcaataatgctttttaaaaacagaaaaaagatcgattttgtatctggagactttactgaagttgcttatacacctaaggaattttaaggctgagatgatggggttttctaaatatacaattatgtcatctgcaaaccgagataatttgacttcctctcttcttatttgaataccctttatttctttctcttgcctgattgccctggccagaacttccaatagtatgttgaataggagtggtgagagagggcatccttgtcttgtgccggttttcaaagggaatgcttccagcttttgcccactcactatgatattggctgcgggtttgtcataaatagctcttcttgttttgagatatgttcattcaatacctagtttatggattgtttttagcatgaaggggtgttgaattttattggaggccttttctgcatctattgagataatcatgtggtttttgtcattggttctgtttatgtgacgggttacaccaataatagagagtcaaatcatgagtgaactcccattcacaattgctacaaagagaataaaatacctaggtatacaacttacaggggatatgaaggacctcttcaaggagaactacaaaccactgctcaaggaaataagagaggacacaaacaaatggaaaaacattccatgctcatggataggaagaatcaatatcgtgaaaatggccatactgctcaaaataatttatagattcaatgctattcccatcaaactaccattgactttcttcacacaattagaaaaaactactttaaatttcatatggaaccaaaaaagagcctgtatagccaagacaatcctaagccaaaagaacaaagctagaggcatcatgctccctgacttcaaactctactacaaggctacagtaaccaaaacagtatggtactggtaccaaaacagatatgtagacccatggaacagaagagaggcctcagaaataacaccacacatctacaaccatctgatcattgacaaacctgacaaaaacaaggaatggggaaagattccctatttaataaatggtgttgggaaaactggctagccatatgcagaaaactgaaactggaccccttccttacaccttatacaaaaattaactcaagatggattaaagatttaaacataagacctgaaaccgtaaaaaacctagaagaaaacctaggcagtaccattcaggatgtaggcatggacaaagacttcatgactaaaacaccaaaagcaatggcaacaaaagccaaaatagacaaatgggatctaattaaactaaagagcatctgcacagtcaaaaaagctgtcatcagagtgaacgggcaacctacaaattgggagaaaaattttgcagtatctccatctaacaactgttcagaaatcagttagagagcctctggccttagtgtctttgggctctaaccacagaaaagccacccttcagaccatgctacgtttttagagctgtgttctctgggtgatgtctataacagcactttacagcttcctcagaacaccaaagaaaacgttccccagaggcaaagggtgtggcctgggcctggggggcccatgtttcatccaggaccatgaggcactgcacagtgtttgtttgttagaggagcagaggatgctcaaaatcattagtcgttagggaaatgcaagtgaaagacacagtgagatccactccacacttactagaatggctgaagttgtggtgataatgtggggaactggaactcacatgccactggcaggaatgtcaaatgatgcaacgactttggaaaacattttagcagtttcataaaacctactctaccctgtgatccagacattccatttctataaaagccaggcagggatatctggccccatgtttctggaaacccactaggaacacggcaaagtcaggtgaaacaaggcatctcagaaggtcaggaacaaaagcctttagggggaatctatctatcagatggcctgagcccagttttccacaaaagactgcaagttgcctggaagaatggtgtaagttcttcctctagaagtagaggacgaaaatggtgcagctgtgttttagctccctcctgattggcagcatgggttcttctcccaagggtacaagggaatggggtgggatgggggtggtatatgggagtggaaagttctggaggactgccttgattagcagcaatgacaataacagctaatatttattatatgtttatcatggtctatttggatttttttaaccctcataataaccttatacagttgtcagaattatcttaccaatttatggggactgaaactgaggctcagagagacaagtgacttatccaaggctgtctagctagtaagtcctttctttttttttaagacagagtcttgtcgcactcttgctcaggctggggtgcaggtgcgccatctcggctcactgcaagctctgcctcccgggttcacgccagtctcctgcctcagcctcctgagtagctgggactataggcacccgccaccatgcccggctaattttttgtatttttagtagagacggggtttcaccgcgttagccaggatggtctcgatctcctgacattgtgatccacccgcctaagcctcccaaagtgctgggattacaggcgtgagccaccgcgcctggccgtaagtcttacagataggtttgccactcaggcagttggattccagagctcagactctcaacaataagcagaatgatgagacacaggctgtgggatgggttgaccataaacacacgtgttttgtgggaatgaggtagagtgattacacagcagatctttcccagagcctgatgagaactgcacagttaaggctggatcacagctagaccgcagtgctttcattttccctttttcccagtcttccaaatcacttcctttcaagaagccaccagcctaatgataacaataaaaataaacaacatcacttgtcaccatcatcccctgggaagagagtatttatgagactccctatttaatcttcccctgttccctgctgcgctgtggtcaagtaccaaatttggcaatgtgaagacatgcggctgacttcccaactcatgaagatgtttttctatttgtttggagagcatgatgaaaaccacattgattttttttttccttttcctatttaccacacatctgttgtgtgggtgattctgatattgtggctgctgagggttacctggcagtaaccctcagtaagaggagagggtttgtccttttccagaagtttggtgtggatgaaatagatgatgaggcagtcatggtggagccctaaccaagcattgggtcccgtgccaagtgcctgcatgcatgagctcatttagttctacatacatttagttcagaggctttagtatttatgccttgtttttctcttagtttttcatcctcttctcctattctgtttgtgtgttccaaatgtctgttttttcatacattacatttttatatcttttgaaagtactcttaagagctgtcagaagtttgaggtagtttctactctttcacttaaccaatggttagagccccaggagaaataacagtgagatcaaagaactcagaagaaccaatgggaagctttttgagcaatcagcactgaaggaatgaaattgaaagtccctacgtaattaaccatcagtggctccctactgccaatagaaaaaaaaaagttcagatgagacaatgagtggaccttctggctgtgttcttatgggtttgggatatattgcattagaataaaaccgaagtcttaaatcctaaatgaaagttactgtcagttatactgacagtgatactgtcatgtatgttgtaaatctttttgttgaaagataatttacataccatgaaatttatccccttgtatttttaaaacatctagagaactgagtatagtgatgtttgagaaagaggagacttactgcccattttttaggttacattatgggatgatactagtgtgtggtctttattacttagggagataacagaaggatatcatacaatagtacattgccatttacttgtatgtacctgacacataataggtgtccgttaaataatagatatatacatgagcataaggacagacagaaaaataccagttagcaactgtaaaggtttgttggagaagaaatcgtgccatacctatttgatttctgttctctgatggagtgaaaggctgggcagagaaagggagatacagcatataaaccaccaagttattggtcaggccttaggttctttccttgattaactgacccttcccacatgccacagcagcattggttaagtcagtcacacaattttatctgtgcacaaccgagttgtccactgaattatacctcaaagcaggccaaaaatatatatatatatgtaaaactgattgaaaagcattaagaacaactaattgccaatttgtatttgggctgtttagttgatcgttgtagccttgtgtggcaccaggcaaagactaagccacaattctgttggttgaggaaatatttaactggaagatgcttttgaatgaatgatcagctacccaggtactatttgacatacagcagtcttggggcttccatgacttattctcctatcatctgtttgcatgataaaattacaggtttccatgtaatctttagcagatgtatttgctatgatcttggaagacagggcatagcttctctggaattaagggaatggcccaggaaaaagaagaggtgcccacagataaaatggtcagttatttttatatatgtgtgcattcttctgtggtgtgcagaacaccaaattgcttggacctgtttattcccacagactcacagtcaaactggtcctgaatattaaatctgatggtttcattctcctgataaaaatcctttgtcgataaaaaatcctttgtcaagtctcctgaatgctagctaggcatacgagatccagcattattgcccctgtctacctctgataccattccgtgctatccctcaccattcatcctgtgttctagcaggtgcatctgcacacgcttgtttgaattctatggaaccagagatgtttgagcatagagaatgaccagattttaggcagttaatactgtatatatacaatataatgcataacactgccagtgaagtttggagcagcacctgtaatcgtgcatactaatatctctacagtaaaacatatgaatattcacaccaaacaggttaagtcagctttaaatggcttgatccattcagatcagattttaccatcaaatgaattgtgaaaagacttttggtatttgaaatgctttgggttgaagaagtgtggtagacctgtacttgcttttcttgaaaagagcctgtgctctcttattcatctggcctttgggcatgttgttttccctgcctggaatggccacatctccctctgcctgttgagtagcatcattactagaatcatcattgcatatactgaggatttactatgttgttactcccagcaaattctatggtcgggggggcgggggggggtgttcttattgtattacatccccccagtgtttagatgaggaaactgaagcttggagaggtcacagagctaggaagaggtagagctgaggttgaaccaaaaagtatggagacaacaaaccttgggttcttagttactacactgtccgtgtgtgcgtcttccccaaaggtccagttcaggtgtcaccttcctaaggccctcttcccttcctccaccacgtttaatagattatgactcctctgggccttcacagctgtttatgcatagctgtggtgcactgcttctcattctctgtctttcccatgagcctaaactccttgagtagttggggaaaaatgtctacttcagtgttctatctctagggcatacagtaggtagtcaacacatagtttataattaagttagtttaaagtgatacggtaacagataacaatttgtatcatcattaaaataaatagtaaacaccaaatcacaagttcaaggatataaaatttggatttacaaaagaaaaaaatactcagaaaaaaaaaggctgctcatttttatgcatggtatgtaaagaagaggaatttggggacaacagttcaagaatgggcaaggaacacatttatacttaaaaattatgacagctaggatttattaaatacttcacatgtgacagtttctctgctaggcattctgtgtataaactttctaatcctcacaacaaatatgtaaggctaattgtcgaatccctgaatggacaaaaattatagctatataagaaagagaaagatatggtaaccatgtcttagatcagaataaaaagaacaaaaggtaatgatcctaatatattcagatttaacataaattaagcatcattagaggacagtcacataaaattgcacaatagaatatatttccacatctgagagatgatggaattgaggtcaaagagattacaggctagtatgtggtattttatacccattccttgaattatgttaacatggtaccagaagtatatcttgctgtcctcctcagaactgggtgcagttttgagctctgcttttgtaaaaagctgttagaacctgaaagaaccacataacacagctgtaatattcaagagaaagtgggtcccacgaacaaagattgagattgttcagagaaatggggtggttctgattgcttaatagaaacctcacaggttggctctattattttcttgtttatggaagtttttgtgaccgtaagagctaacttttccttggtgctttagagtttattaaacgtcttatggaatttgatgctcagaataactaagtgaatcagtcagagcagatgttttctttttttcaaatgagactcaaagaaattaagtgatttgttcagtgtcccacagctaataaatgatagggccaagactcagatatgtatctgagcagacccctgagccatgtccactgcaatcttgcaatccttggttcatcttcatttactcaaattgaaggatcctgcggctggtgaatgtctggttcattgcagaagagttcctggttccttgtctctaatttccattgtgactgtgaattctccattgagctgcaagccagtgactgtcaattaatgtgcacaaaatatacctgggtaactgttttaaaaatgcaattcctcaggcccctctcccacagggtctgattctctaagtcttgctggaagggatatatgagaatctgtaattttaacatgtgcccaggtgattctaatggaaaactttcaaaaaaactgctttaagctctttcagagtagcaattatatctttacttcattgtttccgtagtgcctagcagagcaccttgtacatagacagtactctaaatttacacttgatgaatataagagtgaagtaaataaatgtaaaattaatgtaaaatgaaggaaaacaagtttgagaatcagtcagttcctgccagatttggagcacactgaggaatccctttatctccatcctttcaaataaaatatctcttggtaggtctgggtaagacatactgagaagtcatgacttggacaaagtacctggtagaatctgccaacaattagagattgtggaattcttattttctcatggaaagcaggatggagtgaaacagtgagagatcctgtttgtagttctgtgcagacaaacccagaaaccagaacgcagacacaccaggacgcaacaggaaaccacaaaggcctgagatctttcaatgtaaataggaagtcagagtttacttccgaacccacagtgccaagctgaagtgcagtgtttaatccagctctctacccagcccttccttgagcctgggcacagatgaaagatgatgatgccacctgggtaaaagcattcaaaaatgtttgttctgatcaggtcttggagtgagcttcttttgtttgtgctagtgaataatttgggacacaggtgcactttgcatttgaaagcgttaattggtctccttggttttccctgccatgatatttgaagccacatcttcctccacaaagtaattttaatccatatacattcaaaaagcacttgtcatggacagccgtctttcatataccccatctgtggacccctgggtccaggtgcagagtagtggaacattggtgatgcttaatatgtactctgtgttcattgcattgacatctgtaatctcatttgattactactattacactgggaaataattaataggatacgatcatcaccattttgaaataaggaaaatgtagtctggtagaaaacacatggatgttaaagttaggcagatctgtgttcatgtccaaaagacttaagctttcttaccagactgctttattttatgtagccagttgtttagagcattcactctgtgccaggtactggagagaaaatggtgagcagtagacctagactgtacagtgtagtggaggagatgaatactcagcaaacaattacaaaaatgtataattacagaccttgataagtgctttgctttcataccctgctgggggaagtataaattgggcagtcactttggaaaacagtgaggcattgtctgatcaatttgactgtgcacatgccctgtactctaccaattccattcctaggtaggaagctggagaaacaattgtacttgtgtaccagtaagtgcccagagacaagtaagtacaagagtattcatagcattattttttataatagctacaaatttgaatcaactcaaatttcatcaataatagcatgaataactaagttgtattatattcatacagtggtagacatacttaaaatgtaggaactacagctacatatgacaacatagatggatcaaacaattttaagtggaagaaacaagacatgaaagagatacatacagaattatttcattcatagaaaattcaaaaagaagcaaaaaagacaatgtcttttaaaaaatgcctacaaaagcactaagcttagaaaagacaagcaagggaataattaccacaaatatcaggacactggtgaattagatggcttggaattgcaggttgttgaggttaaaagatgctttcaggaagagcttgagggaactagcatttgcttctgaaggatacatgagtacttaacagtttttttaatgttcacataagttttatacactcctctgtatgtatgatatgtaagtgctagaaagcagagaagctatcagaacatagagccaagtgccatataatttgggtggtctagaaggcaaggcagtgatgtttgagctgggagattttgattaggtaactaagcagagagcctgacggggagggagtagggttgtgcatggcagtggtcaagagaaaaaatttgttcagaaagagagtacagaagaataagcagaaggaaattggcagctttggtgtggggcaagagagaagaatgctacaagtaaaggctggagaagcaaaaaggggtagcatatgctgggcttgtaagccttctgagggattttagtcttttatgtaagagaaactgaaaggttttaagcacagtggataagataattgaattacaaaggatggaaataattccagtttggagaacaaattggcaagagacctgagtggtactaggatactaggaaaccagaagaagactgggagtctgtgtgagagatgatatcatactaacttgtctcagattatggtgggggagatgagatgtcgatatattggaaagatgtttagaagataaaatcagcagcacttccttggtgtgaaaactgttgaggctgcagggcaaacacaatagaggcttattaggtatctcacccaaactcctaagatgagctgctccccagtgagtagagatatctggagagagagcagtagtcgttcaggcattccttggacagactggattcactagagagaaacatttttggtttgcactgtcagctttgtttttaggttgttttaaatattttacccttgtctcttatgaaaggtcttctcaagaagtagccatgtggacacgatattgctttggtagtaattctgccaaaaatgcctgacttgaatctgatcatgaggaaatatcagaaacccaaattgagggagattctataaaataacttgcctctagtcttcaaaaatgccaaggtcataaaagaaaaactacaggaagatcaaaggagacgaaagagacatgatatctgaaggacatgtgtgatgctgaattgaattggagaaacttttttaaaagttttattgtaaaggacatttagtggataatagatgacattctaataagatcagtagattagataatagaattgtatctatgtatacttcctgataattgtattatggatatataagagaatatccttgttattataaaatacacactgaattattgaatattttggagtaaaaggacattatgtctgccactttcaaatggttcagaaaaactacatacatatacacatatgtgtgtgtgtatatatatgttcatatatatacacacatgtatgttcatatatatatgtttatgaacaatatgtgaacaatatgtttatgtaaaacattgggaaaatctaggtgaatattatacaataattctttgttctatttttacaactatttcataagtgttaaatcatttgtaataaaacattttaaaagtgttttttaatagaaggaagtagtcatgtgaaggccatgcttatatttggcataaccatgagttaatataccactcattgtgccccatataaaatcccacttgagaatttattttagaatttaccatttggaaaagtgttgttcaatctcaaatggtgtattttcatctttccagtaataaaagctatataatggattacatttttcttctggccctggaagccaaggaaactcagagttaaaaatttaacactcaagctaaactgttgagccttctactacatagcatatttccattcttctttttgctgtaattgtcttgcattactgtttctagtcactctgtactatattatctgtgtatgtatgtttgtgggagtggtagataaaatatctcaaactctttgtattagtttcctatggctgctattgtagcaagttgccatacacttggtggcttaaaacaacacacatatattttcttatggttctcgagactagaagttcaaaaccagtttcactcagccaagatcaagtgtcaacagggccgtactccctctggaggttccaggggaaaacctgttccttgcttcttccagcatctggtggctgctggcattccttggcttgtggccacatcattccagccttgccttctgtggtttcattgcctcctcctcatctgtggtcacatctgcctctccctgtctcttacaagaacagttatgattgcatttaggccaactcaaataatccaagattgtctcctcatgtcaggatccttaatcacatttgtgggtcctttttttttctttcttttttatttttttgccatatgagtaacattcataggttccagggatttgaacatggtgatcttttcaggagccattattcagcctaccataccctttatggaaagaagtgacatttaaatgtgttttttaaggtacataaaaataaagtattaatttatttggaaaatataaagtacttctgcactctgtgtatagtgaaggaacaaagataaaagaaatcaaatttctgtttagtgatttttcattgcttttatgaattacattgaattttctattatatttcctatttggttatttctggaatagagaaatatatttgactttttttagaaagtaaattatttgttaatatgaatgaataatacctgtgagatttccaatgaaaagaagcaaagttttatacatcaaatttgcttccaaatgctaatatactaaaatcagtgctagttatgtttaatataggttgctgagaaaaatagttatcttttatggtttttaaaaagtgtatgttaatttatttttatcgtttatttcttactgacaaatgcaaattgtatatatttatggggttcaatgtgaattttgatatactatatattgtaaaatgattaaatcaagcttattgacatattcattacctcacatacttttttgtggtgagaacatttaaaatctactctcttagtaattttcaaatatacaatacatttttattaactatagtcaccatgctgtgcaacagatcttcaaaacttattcctcctgtctaacccaagcttagtacaatttggccaacatctctgctttaccccttggcaaccccaccctaataaccaacattctactctctacttctatgagttcaactttattaagctttacatataagtgaaatcgtgcagtatttatccctctgtgtgtggtttattttacttagcataatgttctccaggatcgtctgtgtcactgcaaatgacagaatttccttcttttttaagactgaatagtattttgttttgaatctatggcacattttcttgatctgttgatggacatttaggttgatttcatatcttggcaattgtgaataatggtgcagtgaacatgagagtgcagacatctcttcaacatattgtttgcatttcgtttagatacacccagaagtagaattgcctgatcacatggtaatttgtcatttttttgaggaaactccatactgttttacaaaatgcctgtactagtttacattcccacagatttttaaaaagttaatcttctacccactaaccttgctaaactttcttatttttttaaaatgtgcatgtattatatatgctctgcatgcattataaatgttacagtaatttttaggtacaacactaaatattctcatatggtttggatggtcagtgaaggcttctgtaaggaagtgatatctgtgatattttggttaggaaaaaagtggtccaaacatagaggacagtatgagctatatatacaagatcatatcatctgcaaattttgcttctctcttcccttctttatatcttcttttgctgttaatttttgtctaattgtgtttgctagggcctctggtattatgctgaacagttgtggtgataaaaagcattctcacatgcacacatatgtttattgcagcactgtttacaatagcaaagatttggaaccaacccaaatgcccctcaatgatagactggataaggaaaatgtggcacatatttaccatggaatactatgcagccataaaaaagaatgagttcatgtcctttgcagggacatggatgaatctgggagccatcattctcagcaaactaacacaggaacagaaaaacaaacactgcatgttctcactcataagcaggagttgaacagtgagaacacatggacacagggaggggaacatcacacactgaggccagtcggggggtagggggaaaggggaagggagagcattaggacaaatgcctaatgcatgcagggcttaaagcctagatgacgggttgataggtgcagcaaaccaccatggcacatgtatacttatgtaacaaacctgcacgttctgcacacgtatcccagaacttaaagtaaaataataaataagcattctcatcttatttctaatcttagagggaatgtatataaaatttttccagtgagagtgatatttgctagagattacagacagacagacagacagacagacacacacacacacacacacacacacacacacacacatttccttatgaaattgagtaaatgatcttccaaagcattcagggcaaatagcagcccatgttttaataaccctaagaattattttatatgatagtcccattccatggccatggagctctgtcactatactgtgaacttctctatggcaggaactattcattcaccattgtatccttactctgaacttctctagggcaggaaactgttcacttgccattggatactcagtatctagcacaatgcctgtaagttaggcattcactatccattcaatgaatgaatggatggatgaacgatagttaatatctgtttcattctcaaagctagcaaattctttttaagcatgagccaaaaatatcactactttccattttctttattcaatgagttgagctcattttgccgccatccttacctcctcccagcacctggtacagtcagtagtcatttgacatatgaaggaataaatgaatgagtcaatcacagagcattctgctgccagttgatagactttgcccctaaagattctgaactttatttgaactgaagccaggtggttaaagatgatttaatcaggacaaaaataaaattctactctctttaatggaataattgcttattgcattttcttcttaaagttggccattcatctccttaaagttggccactgtctttcaatttatatatgttgtccatgaattattgaaagtgattattctgaattaagccaaaattattcacaaagaattgtcttggtgtgtgactagagggttcagaattccagtattacttggagagaggggttgggtatagtggtaaacttaaagtttacctgcaaaaaaacagtgttgaatgcctgagtatggcaaatccaaaaagtaagtatttggatttattggtgaataagggagagaggttggttatcaaaaaaagagcagttaagtaggaatatgttagtagttttaaatactttatgatggctctaatcatatatgtacttcctatttcaaaaggtatttcatttcataagttagagtaacacccaatattagaatttcagtgtccagaaattgattaccttctcctgacttggaactctctgctcaaaagcctttgatgactcttcgttgcctggagagtaaaaatttatttagccctagccagcgctgtccacctgcactcctaccatacacactctctgtttcagccacatgtaacagaatgttaccatagggctcttcctatcttggaggtttcgaacaggccccagagcccagaccacctatgcagagcttgctaaaagattgtgaaacttgtgctaaacgtcaccctgaggatataaaagaggtggaagaagtcagaggtcaagactaaggaaagaggctgaggttgatgattgtatctgagagagtagagcaaaaagtgaagacaaggaaaaggtgtgtgggtccagcacaagggagccagctggggatatcttaaaaggaatcccatccataaggttcaactagaggagcagaatgatcccagagcaggacttgatcacctgaaggccaggactgaaagggagttgtgggcagaccactggacggagagatagccagctttggacaggcaccacaccctgaggacataatgaagccagataacaacgtatatgcatcaagtgagaccttccccaggcaccttgacccctgtatggaggaaccccaaaacacccagctgtccagcaggaaaaagtagaaggaggagagagagaagccagcaagtccccttcttgaagtgtgtatacgctaagcctgaaatatactgtagctgcagaagggagaattttcaattagccaaaatgggagttttaattattataatagagtgtacatatttactgctagaagctggcctgaggacttttataattgaagagtgtaggaatacagtggatccccctgaaatttcatcccaggaatgaggaagaacagttcgtggaacaaatttaccaaggagaagagaatagagctgttttttcctgcacacccataatggtactacagatccttcaataaaccagaacacacacaaggctggggttgtcctctcgtccctctcctacatcagcaaatctgtctctacgtaatcatgtaagactacagcttgctttaatagctcccatcttaagaatgggagggggagagcgaggtagaagaaaaaccttgaccttatatttcgccctcctgttcccccatttattgtctttgccacacagcttctcaagtgctgtataatcccattcctcccctcccactctctcttgagcccaatcagacatttgtacaaacttctccatgaaaataacccttgaccatttgtttcgggctcctgtgaccagggtctgtgttcctaaatccagtagtcctcattcagatcgttctgttggcagcattgggcacagctgcgccctcccttctcaaaacccctcacttgcatgtagttgactctttggtcccattgtctaattgctctccatcaccagtttctaaattttggaaggcgttaagcctctgcccaagacctcttccctgcccatttccccttgcttcttcagtgacctcattaagactcaaagctttaagacaccatctgtagagtatgacctccaaacatatatctccagcctgaccctgatatcctaatatatttaatcacctactcagcatttcttcttggctttctaatagatacctaaaatttagcatgtcaaaagcctaattcctctcagcccccaggaaatctcctctcactgtctttcctagaacatgaaagaacaattctattcatacacttgcctatgtcaaaacaccttgaaaacatccttcatccctctctttttctcatattgtgctccagtaaatgctgtcagttctactgatggaatccaccaatgtggaccacctagttcaagcagttgtgctccctctcttggtttattgacacagtctcctgactgtctccctgtttttaccactgggccctggattctgttctcacagcagccagggtggcctcttgaaaacttgcctcagattatgtcattcctctgctcaaaacctttcaataattttgcatttcactgagaattaaagccaatgtccttaaaaataaaagatctgttcctcttacttttcagctctcatcttctgtcccctttctcactgttcacaccactgcagctgccctgattctttgctgttcatgtaagatagcaagcacacctctgccacagggcctttgtacttgctcttatctctccacctgcatcactcttaactgcatgcttcactcactcactcccttccagtctctgctgtaatgtaacctcatcattaaggtctatccagaccaccctatattaaaataacaacacttgccttcactcactgcttaacctctctatccttctttatttttctacacacagttatcgtcctacgctccactggactgtaagttccatgaagacagaactttgttttttcaccactgaatccccagccccttcaaagtgccttgcatgtaatagactctcacaaatagttctcaaatggagggtgcttcctaacttgctttagcctttccacatgctgttctttctggcaagagttgcttccctttaccccccgccttgttacaccccagccccaagtgagcctgttagaatcctgtgcatcctctcagactccagtttcatacaacctcctctgtgacaccgcgtgagtcagatttaattcctctttccccagaactcaaagttttcagttttattttgctttaatcaagtttgtacccttaaccactacattgtgtgtctttcagactcttgttctttcttgattttaaggctttagagatgacaaattcagcaaccgcaggtccttctcatgttgtagaattgtaaagtagctgttttttaactgcatgcaactgtatgaatcctaaacctagaattttcaatccctctattctaccgcatgtattttcatttctccttctttttctactacttcctcttcatcacaaaaaaagtcccaagcacatattatatgttattcattttcttcaaacatctttcacttaatagtttagagaaaagcccatctattccattgagtgacctttcctatgactatagaaagtggtcagtttttctgtcccttggcctgtttagcagttgaaatgcacctgacagtttgtattacaaagctaaatggtggtggccagtaaggagtttgataaacttttcatgtaatttatacataggggaaatgacactggctgttgagcacatgaagtcattttctttcttccctgaaatgctttgggggagaagaccaatcagtcatcttagtgctgcacctccatagtgagatctgcattaggtttttgaccaagaagacagtaatattttatgacaaaacttggaaaagttaaaaattcacagatgaacaaatgctttttctcattatttatctttttattctttcctatttttattccctgagaccatttgcatgaggggaaatttaatcaggatccctagttgagaacatttctattggagaaaatggaacctggatatcaaattatctcacaacttcttctgagtgacatacactgaattttatcttaaatagcttgtttagaagctattggtcaccagcttaaatagcaccttttcattataacattgcttctgttgttgcattcataacattttatttgctaaaaatgtattaactgtgtctctcccatcagttcttgagctttggagggctgtggctgtggcttattcatctctccatacccaaagactagcatataatagacatacagtaaaaatggaaagactatattgagctgcagtctaccctgtccaattaaaagtcagtggacatttgttgaataactgctatgtgccaggtattttgaaatatttggtgttatttaatctttatagtgaccctaaaatgcattgttatcccttagttatagatgagagaaagtacataagtggtttacccagctagtaagtagcagacctgtctttgaatgtaacccatgtaaagcaaaattttctgtcctttctcctttattagagcttaagtgatctttcagggaccgatatgtttagctatcaactctgtaataacatgaaaaatatttatttagctgtgatcatctatttgataaattgtcagagtgataaacccaaaaggagctttaaagatcattcagcctgtaatcccaaggtggaaagatcacttgaggccaggagtttgagaccagcctgggcaacatagtgagacccttctctcttaaaaagaaaaaaaagctggatgtggtggtggtgggtacctgtagtcccagctacttgggaggctaaggcaggaggatcacttgaacccaggaatttgaggctgcagtgagccatgatcatgcccactgcattccagcctgagaacagagcaagaacttgtctcaaaaaaacccccagaaatcatccaattcagtattctaatttcagatgcaaaaattgagtcccagaagggaaaaggtcttggccattatttcttctgtcagttggaatcatgttattcttctccttttgcactgtccttacagtaattacttttaaatccttagcaagtctgattatcccctgcatggtatggcctgtgatgacctctccagcctcacgttgcactactacccctcacagtttctgtccttcatctgtggcatagaacacactctattctctgcttcctgtccctctgcctatagcacccttccctctactccttctcctaagtcctacttacccttcacatttagctcaggcatctaatatcctctcgctggaagctttcagactagattaggtggtgtatctatgtgcatccatggtacatacctgtcatggtgcgtatccttctgtgtttgttgttagttaactggcttatgtcttccttgctgtgaattccttgaggacagatattgcggagcattcatttctatatcaccacggcctcataaagctcctcacacaaagtcagctttcaggaaattttgaaagaaataatcactcacttggattcaggtctgaagtgaggcaaacattagagatgtgatggtgttgaatactcatcgtttttgatattttgaaggctctcccatgcttgaggatccaaaggagtttaccattttgtaatgccacagatgtgtactggtgtctgtaatgctcaggtcccatccttgagcttcaccaggaacatcagtaggaagatctggcacaggctatgtggagagcctcctcaccccatgctgatgatctcatagtatctggtcactgccactaaggaaaaataaatgcctgcaggtccttttataccatgatgtaactaactataggaagtgtccctatgcaacatctttcatcttacctgaatcaaagcttcaatgaatgaagttctcttcggcccatcatcctgcaagaaactggtaggatgatggcattgggaagctataagggtgattctgacttctctgaaatgacatacattccttgtcaatattatgtcagcggaaaacttgctagccttagaaataaaaataaaggtcttatttttacattgacactttcaatctaggtaaacttgaataattcatttgatatttcagaggcttcatttcttcatctaagaacatgaggatcttttctatttatggaggtatcttgaggattggttgaagtagtgagcatgaaaggtctctagaaaaccttggttgtttagacatgttttagggacattgaaatggactgcgcatggaggaagcttcatggggggcacacctgaggggcatttcctcaatgggagagcacctttgcccttcacaacattcacacacccctcctgggtattggtgccaggctagtgccctgatctgagtccacctctgaacagtcaccctcaccaagataccccgagccaggagagccagtggagcacatctaagccaaagatgtcaaagagagtgaggagtgagaggtccaaattcaactggagaccctcaagatgagacctgttttgaatgagagagagatgaccgtgcagggtggaagcaggtctgatgcagctgacagctaaccactgctgctcggaagtgtcgacggctcaccacttatgtgttggcttttgttcctggactactcaggtggtttaaaagaccaggtgaaattgaggcaataatgaatagcttaccaaccaaaaaaagtccaggaccggatggattcacagccgaattctaccagaggtacaaggaggaattggtaccattccttctgaaactattccagccaatagaaaaagagggaatcctccctaactcattttatgaggccagcaacatcctgataccaaagcctggcagagacacaacaacaaaaaaaaagagaattttagaccaatatccctgatgaacatcgatgcaaaaatcctcaataaaatactggcaaaccgaattcagcagcacatcaaaaagcttatccaccatgatcaagtgggcttcatccctgggatgcaaggcttgttcagcatacacaaatcaataaacataatccagcatataaacagaacaaacaacaaaaaccatatgattatctcaatagatgcagaaaaggcctttgacaaaattcaacaacgcttcatgctaaaaactctcaataaattaggtattgatgggacgtatctcaaaataataagacctatctatgacaaacccacagccaatatcatactgaatgggcaaaaactggaagcattccctttgaaaactggcacaagacaaggatgccctctctcaccactgctattcaacgtagtgttggaagttctggccagggcaatcaggcaggagaaggaaataaagggtattcaattaggaaaagaggaagtcaaattgtccctgtttgcagatgacatgaatgtatatctagaaaaccccatcatctcagcccaaaatctccttaagctgataggcaacttcagcaaagtttcaggatacaaaatcaatgtgcaaaaatcacaagcattcttatacaccagtacagacaaagagagagccaaatcttgagtgaactcccattcacaattgcttcaaagagaataaaatagctaggaatccaacttacaagggacgtgaaggacctcatcaaggagaactacaaaccactgctcaatgaaataaaagaggataccaataaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagctcatatggaatcaaaaaagagcccacattgccaagtcaatcctaagccaaaagaacaaagctagaggcatcacgctacctgacttcaaactatactaccaggctacaggaaccaaaatagcatggtactggtaccaaaacagagatgcagaccaatggaacagaacagagccctcagaaataataccacacatctacaaccatctgatctttgacaaacctgacagaaacaagaaatggggaaaggattccctgtttaataaatggtgctgggaaaactggctagccatatggagaaagctgaaactggatcccttccttacaccctatacaaaaattaattcaaaatggattaaagacttaaatgttagacctgaaactataaaaatcctagaagaaaacctaggcatcaccattcaggacataggcatgggcaaggacttcatgtctaaaacaccaaaagcaatggcaacaaaagccaaaattgacaaatgggatctcattaaactaaagagcttctgcacagcaaaagaaactaccatcagggtgaacaggcaacctacagaatgggagaaaatattcacaacctactcatctgacaaagggctaatatccagaatctacaaagaactcaaacaaatttgcaagaaaaaaaccccatcaacaattgggtgaaggatatgaacagacacttctcaaaagaagacatttatgcagccaaaaggcacatgaaaaaatgctcatcatcactggccatcagaaaaatgcaaatcaaaaccacaatgagataccatctcacaccagttagaatgccaatcattaaacaggaaacaacagatgctggagaggatgtggagaaataggaacacttttacactgttgttgggactgtaaactagttgaaccattgtggaagtcagtgtggcgattcctcagggatctagaactagaaataccatttgacccagccatcccatcactgggtatatacgcaaaggattataaatcatgctactataaagacacatgcacacatatgtttattgtggcactattcacaatagcaaagacttggaaccaagccagatatccaacaatgatagactggattaagaaaatgtggcaaatatacaccatggaatactatgcagccataaaaaatgagttcatgtcctttgtagggacatggatgaagctggaaaccatcattcttagtaagctatcgcaaggacaaaaaaccaaacaccacatgttctcactcataggtgggaattgaacaatgagaacacatggacacaggaaggggaacatcacacaccggggcctgtggtggggtcgggggagtggggagggatagcattaggagatatacctaatgttaaatgacgagttaatggatgcagcacaccaacatggcacatgtatacatatgtaacaaacctgcacattgtgcacatgtaccctaaaacttaaagtataataataaaaaataaaagaccacgtgaaatgagcaggcttgggcaattcaaagcctggaaaaaaagtggtagagagggggatttggggaagagtagatagacagaatgaggtgacacattgaaggacttcttagagaaatgcatttgaggaagaagcagccaagatggccgaataggaacagctctggtctacagctcccagcgtgagtgacgcagaagacgggtgatttctgcatttccatctgaggtaccgggttcatctcactagggagtgccagacagtgggcgcaggacagtgggtgcagcgcaccgtgcacgagctgaagcagggcaaggcattgcctcactcaggaagcacaaggggtcagggagttccctttcctagtcaaagaaaggggtgacagatggcacctggaaaatcgggtcactcccgccctaatactgtgcttttccaatgggcttaaaaaatggcacaccaggagattatatcccgcacctggcttggagggtcctgcacccacggagtctcactgattgctagcacagcagtctgagatcaaactgcaaggcggcagcaaggctgggggaggggcgcccgccattgcccaggcttgcttaggtaagcaaagcagcctggaagctcgaactgggtggagcccaccacagctcaaggaggcctgcctgcctctgtaggctccacctctgggggcagggaacagacaaacaaaaagacagcagtaacccctgccgacttaaatgtccctgtctgacagctttgaagagagcagtggttctcccagcacgcaactggagatctgagaacgggcagactgcctcctcaagtgggtccctgacccctgacccccaagcagcctaactgggaggcaccccccagtaggggcagactgacacctcacacggccgggtactcctctgagacaaaacttccagaggaacgatcagacagctgcattcgcggttcacgataatcccctgttctgcagccactgttgctgttacccaggcaaacagggtctggagtggacctctagcaaactccaacagacctgcagctgagggtcctgtctgttagaaggaaaactaacaaacagaaaggacatccacaccaaaaacccatctgtacgtcgccatcatcaaagaccaaaagtagataaaaccacaaagatggggaaaaaacagagcagaaaaactggaaactctaaaaagcagagcacctctcctcctccaaaggatcgcagttcctcaccagcaatggaacaaagctggacagagattgactttgacgagttgagagaaggcttcagaccatcaaactattccaagctacagaaggaaattcaaaccaaaggcaaagaagttgaaaactttgaaaaaaattcagatgaatgtataactagaataaccaatacaaagaagtgcttaaaggagctgatggagctgaaagccaaggctcgagaactacgtgaagaatgcagaagcctcaggagccgatgtgatcaactggaagaaagggtatcagggatggaagatgaagcgaatgaaatgaagcgagaagggaagtttggagaaaaaagaataaaaagaaacgaacaaagcctccaagaaatatgggactatgtgaaaagaccaaatctacgtctgattggtgtacctgaaagtgacggagagaatggaaccaagttgaaaaacactctgcaggatattatccaggagaacttccccaatctagcaaggcaggccaacgttcagattcaggaaatacagagaacgccacaaagatactcctcgagaagagcaactccaagacacataattgtcagattcaccaaagtcgaaggaaaaaatattaagggcagccagagagaaagggcgggttacccacaaagggaagcccatcagactaacagcagatctcttggcagaaaccctacaagccagaagagagtgggggccaatatttaacattcttaaagaaaagaattttcaatccagaatttcatatccagccaaactaagcttcaaaagtgaaggagaaataaaatactttacagacaagccaatgctgagagattttgtcaccaccaggcctgccctaaaagagctcctgaaggaagcactaaacatggaaaggaacaaccggtaccagccactggaaaatcatgccaaactgtaaagaccatcgaggctaggaggaaactgcatcaactaacgagcaatataaccagctaacatcaaaatgacaggatcaaattcacacataacaatattaactttaaatgtaaatggactaaatgctccaattaaaagacacagtctggtaaattggataaagagtcaagacccatcagtgtgctgtattcaggaaacccagctcacatgcagagacacacataggctcaaaataaaaggatggaggaagatctcccatgcaaatggaaaacaaaaaaaggcaggagttgcaatcctagtctctgataaaacagactttaaaccaacaaagatcaaaagagacaaagaaggccattaaataatggtaaagggatcaattcaacaagagctaaccatcctaaatatatatgcacccaatacaggagcacgcagtttcataatgcaagtcctgagtgacctacaaagagacttagactcccacacaataataatgggagactttaacaccccactgtcaacattagacagatcaacgagacagaaagttaacaaggatacccaggaattgaactcaactctgcaccaagcggacctaatagacatctacagaactctccaccccaaatcaacagaatatacattttttccagcaccacaccacacctattccaaaattgaccacatagttggaagtaaagctctcctgagcaaatgtaaaagaacagaaattataacaaactgtctctcagaccacagtgcaatcaaagtagaactcaggattcagaaactcactcaaaaccgctcaactacatggaaactgaacaacctgctcctgaatgactactgggtacataatgaaatgaaggcagtaataaaggtgttcattgaaaccaacgagaacaaagacacaacataccagaatctctgggacatattcaaagcagtgtgtagagggaaatttatagcactaaatgcccacaagagaaagcaggaaagatccaaaattgacactctaacatcacaattaaaagaactagagaagcaagagcaaacacattcaaaagctagcagaaggcaagaaataactaaaatcacagcagaactgaaggaaatagagacataaaaaacccttcaaaaaattaatgaatctaggagctggttttttgaaaggatcaacaaaattgatagatcgctagcaagactaataaagaagaaaagagagaagaatcaaatagacgcaataaaaaatgataaagggaatatcaccactgaccccacagaaatacaaaccaccatcagagaatactacaaacacctctactcaaataaactagaaaatctagaagaaatggataaattcctcgacacatacaccctcccaagcctaaaccaagaagaagttgaatctctgaatagaacaataacaggatctgaaattgtggcaataattaatagcttaccaaccaaaaagagtccaggaccagatggatttacagctgaattctaccagaggtacaaggaggaagtggtaccattccttctgaaactattccaatcaatagaaaaagaggttatcctccctaactcattttatgaggccagaatcatcctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgtaaggctggttcaatataggcaaatcaataaatgtaatccagcatataaacagaaccaaaggaaaaaaccacatgattatctcaatagatgcagaaaaggcctttgacaaaattcaacaacgccttatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctgtctcaccactcctattcaacatagtgttggaaattctggccagggcaattaggcaggagaaggaaagaaagggtattcaattaggaaaagaggaagtcaaattgtccctgtttgcagatgacgtgattgtatatctagaaaaccccatcgtctcagcccaaaatctcctcaagctgataagcaacttcagcaaagtctcaggatacaaaatcaatgtgcaaaaatcacaagcattcttatacaccaataacagacaaagagagagccaaataatgagtgagctcccatttacaattgcttcaaaaagaataaaatggctaggaatccaacttacaagggatgtgaaggacctcatcaaggagaactacaaaccactgctcaatgaaataaaagaggatataaacaaatggaagaacattccatgctcatgggtaggaagaatcagtatcgtgaaaatggccatactgcccaaggtaatttatagattcagtgccatccccatcaagctaccaatgactttcttcacagaattggaaaaaactactttaaacttcatatggaaccaaaaaagagcccgcatcgccaagtcaatcctaagccaaaagaacaaactggaggcatcacgctacctgacttcaaactatactacaaggctacagtaaccaaaagagcatggtactggtaacaaaacagagatatagaccaatgtaacaggacagagccctcagaaataacaccgcatatctataactacctgatctttgacatacctgagaaaaacaagcaatggggaaaggattccctatttaataaatggtgctgggaaaactggctagccatatgtagaaagctgaaactggattccttccttacaccttatacaaaagttaattcaagatggattaaagacttaaacgttcgacctaaaaccataaaaaccctagaagaaaaactaggcattaccattcaggacataggcatgggcaaggacttcatgtctaaaacaccaaaagcaatggcaacaaaagccaaaattgacaaatgggatctcattaaactaaagagcttctgcacagcaaaagaaactaccatcagactgaacaggcaacctacaaaatgggtgaaaattttcgcaacctactcatctgacaaagggctaatattcagaatctacaatgaactcaaacaaatttacaagaaaaagcaaccccatcaaaaagtgggcaaaggacatgaacagacacttctcaaaagaagacatttatgcagcaaaaaaacacatgaaaaaatgctcaccatcactggccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctggtataaagacacatgcacacatatgtttattgctgcactattcacaatagcaaagacttggaaccaacccaaatgtccaacaatgatagactggattaagaaaatgtggcacatatacaccatggaatactatacagccatgaaaattgatgagttcatgtcctttgtggggacatggatgaaattggaaatcattattctcagtaaactatagcaagaacaaaagaccaaacaccgcatattctcactcataggtgggaattgaacaatgagaatacatggacacaggaaggggaacatcacactctggggactgttgtggggtggggggacgggggagggatagcattatgagatatacctaatgctaaatgacgagttaatgggtgtagcacaccagcatggcacatgtatacatatataactaaccggcacattgtgcacatgtaccctagaacttcaactatagtaataataaaataagaaaaagtaaaaataaaaaaataaaagagaaatgcatttgaggcaaagcctcttttcctctgtgtagaactgatgatggggtaaaatagaagaaaccacacatatacaccctgatgctgatctagagcccagtagctccagagagctagggaaggccccactctgtgtgggacatttatgtggcctgtgaccacaagaaccgtcagcagcagaacaggtgatgagcatttgttgagtgaatcaaaacagaaatgaaccactgtgcaggttcagctgggttcccctgaatgcatccttgagagggtcctcagtgtgtttgtggacatctagttacaaggcaatcaacatataaatggggatcatcttcccatcgccttcaagaaaaacagaattctatttctgcatgtcatgaagggttctttaggatctgacacatacctgcccttccactcagaggtctgacattttattttcacatctgctccgtggctgcctgtctttgggcaagttacatgaccctgctaatcctcagttccctcatctttaaaatggggataaagatacctatctcaccggcttgtgataattataaaatgagaaagtgcaaataaatccactgtcttttcatcacacatatgccaatccagcatttgtgatttttaaaaattcttactgtatagtttacctttcagccaaaccatgccttcttcaagctgatattatactaagaacttttatctttattgaggtgcttatcagaatatcttgccattcttgcattaactgttagatatcccaactgcatgggaaacaaggacaagcacagtatctttttcatctctctttttcacaggacctgacacatagaaggtgctcagctgaatgtttgccgaagggtcatgtgaagtgtctctgttctggagaatcttgattcccaagagccccagataattcctggcccctactctcctatcccatattaggcagctactctgtgtcagaaactaagccaggggctctgcacaaaaggctgtagttcatagctctgcaaccctggggggcagctattatataaacttcttacaacaattaacacaaatccctcaagtgtaaacatctgatgtctctttaccttcaacccactagggacacaaattgagaacccagcaaccctcatctggcatggaaaacttaagacctggatttcttccacctgcacctgctgcgtttgtagccatcccctcccctcttccagcacctttgttgtttgtatcttaccaggattaaccatactagtctggactctgaactcagaaacatgtagattaaacatttcctagcttaaaaaaatagagtgcagaaagttaaatagttagctctcacatgttgattatttactatgtgaaggcagtatgtagggtttgtctaacattgcctccaattttcccaaatatccggtaaggtgaatattcttgtctgtcttttacacgggaagaagccaagattcaagagggcctcataacttgctgcatggatctgtgattcctgacctgggtacaccccaacactgcttcttcctggcaccaggcacccaaggaatcagttccactagcccccacgcctcagcaaccagcactaggcatggaggggtgcttcctcccaccaaggctgagtgctcagtcacaccctatgagagcaagccaatgaaatggaaaaatagctcttactcctgactctgacatctgccctgcaggtgagagccaaattctcaaattgccaggccaatggcaaataagcccacactatgcacagagggtatcaacacaaagagggttctgtgggaattcacacatcctggaagccaggctgaccctggtagacagtttcattttatcttgtctcagccacatgatgagtggagagagagaaggaaagtgcacagatctccagaaatggggtttgggttcactcttgagaatacccctgggcagtactctgacccttgggcccctctctgtaaacacacaagaacagctaaaatgtctggaaaggggaagggctggttccactgatgcccctgcattcattgagtttcctgcttcccaagtagctgagaggcagctggatataaaaggaacaggctttggagtcagacccagatcaaatccccattctgctacttggtacctgtaggacaatgagcaaggctttgaccttctgtgagccatggtttatctgtaaactaaaggaaatggtagattatcatgaaaattatagataagaatatgaaacagcacatagtagctgcttggcaaatgttagttgccttccctcccttttcccccactgcattcatttgtaatgcctttttttaaaaaaaaatgacagtaagagcaattataattggcacaggttgctttatgagctaaatatgttacagatcaataatacacaatctctggcctggcgcggtggctcatgcctgtaatcccagcactttaggagaccaaggtgggcagatcacaaggtcaggagttcgagaccagcctagccaatatggcgaaaccccatctctactgaaaatacaaaaaattagccgggcttggtggtgagcaactgcagtcccagctactcgagagactgaggcagaagaatcctttgaacccaggaggcagaagttgcagtgagccgagatcgcgccattgcactccagcctgggtgacagagtgagactccatctcaaaaaaataataataaaaaataaataaaaaccacaatctctatttaagccactctcacaggactgactgtaccctatatcatgtcatatatttgacagacagttgcttttcttccttttattcttctaaagaagtccagatgagccccagatacaggttcataccctagatagcctattccaagggttaaaatcaggcctgcttcacatcgaaggcattttgttatgatctgttcataacaaaagctgcctcctggctgttgcctgcagctgaatactgttactctgaagccatcatttcatttgtttctgattgttctgcagtgtttacataccttacatattagcgtgatcttttatagagtacaggcagaggttaagccctcccggatccactttccctctgagggctctttcttcttttttactgtcccttgcctctgtgttacaaaccatttctcttttatagaaattcatttaaatagaaaaacaatttttaagtgttttcttttttttttaacatgaggctcacttaacatttttagaaaatgttgaatatggagaagagggaaaagataccaccaaaatgtgtgattttttttttcttttttcctgacataggaaaatcccattacctctcttgaatttaccaagggacatattccatttagggcatagaaggacctgggctgcctccagacctaatgtggaagaaggtgctgtctgcctgctatttccttgcttctccttatttcaatcttttttttttctccaaaaaaaaaaaaaagtgacttaggaaggatatggacttgtgagtcagatttgggtctaagtcttggttctgccctatgtgtaatcccaggaaggaacttgagttgattttctgaagctcagtttccttttccattaaaactgggagtgactcaggcttgcctagtatcttagctggaagaatgtgtgtgaaactggcccacctttcacagataggtcaccctgctgattgcagtggcttccaggcacccaggcctgggaaagattcacaggcctagtccagacctggcaggaaagaggctgtgagcagttctgcctgccgcagatgtgctggcacatgtaccgccgtgtgctgccccaggtaacatatcaggcagctagggaatgtaggctttcagaccctctctcttcagttctcttctgctgacttcctcccatccagccatcatactttcttaatcctctcatcaatcccctttgttatagagaagatggaagggttaaattccttcaccctcatcacttccactgatatttgataaacacctctcagttcataatacttttgcactcaagcaggggagctacccaggtgtctatggaaagttttgaattctttttgcctattcagtttagtcttctcattttctatctggccagaaatggagaaagtgttttgaaggtcaggattcttcaggtctagacttgtagggatgtatcctgaattcctctgagctaagcctgagaagcacaagtgggttctattgggaaacacttccaaaaggcaatgattgatgcttatgcacagaaattctgacttttagtaaaagatgcttggatataaatcaagcaggactctccttgcctttatacaatatgcggtaaacagggtaaatcctcaattttacttatgcccactgacagatcttacaagtagaaattaacccatctgagtgatcgtgttgattctttctccctcttctctagagccattataacctctgtaccctacttcagaattctaatcaagatagtgtcaagtcttttaaaaaaaagttaaacccccacatgagctccaatccataaataagaaactcaccctggcttgtatggaggtgatgatattaacacaggctacatttctctgggtcactgaatgtacccggcactgtaccaaggccagtaatagactgtgccacatttaatctttacagatctgtaagagaggtcttatttgtcccatttttcagatgaacaccccaaagaccaaggtcacacagcagagactctcggctggagactgccctcaggcatccttttaacggaactctaaagtctgcaggagggagccatttttcctaccagccagtttagaatcaaaaaagagcattggttttgccgtattagagaactaattcataattagtactatgctcactcctggaggatttgacagaaatagaagatatggttctgactcaggatccacctcactacgtgatgtcagagcaacagagctaagactgcaactgatgagtattgtgcagatggagcacgctacctcctcgttagctctctcccctgcacccactctgccccacccactcctcctcccttgcgtgatccatagaatagaccaatatgtgtttacccaccacagattgtttggattgtgaaaaatgcatgatataattttatatctttgaaggcacacagctctcagagctttcaaagctgaaaaccagtctgggctcactggagccagttaggcatttgtatatagaaggccaagtgtggcttcttgtctataggagagagaaaatgtggaggaacttttggaaggcttcagagtttttttggctattctctctctcttgcaaagcaatctgggtgcattaactataaatgaatgagaaacatatggattaaattttatctgtgatcacatatgagtttcaagaatgataaagaataaggaattcagtgtttaaggagtccagaatactttgcaagtaattcaggatattgcaggcaacatttggctgcctccctctatccaaatttgaggactgtttggtagggtgacagacctgctcagtgccctccccacccactcagattgctaaacctcaggagatacctgtggataggttttgtgtgtatcttgttttgctgagactgaaataaagagattgggtttctaggaaaggcaaactctatgagaacactcttaaccactttgaaacccccaaatagaagaggaaaatttggtaagcccgatctttattaaccatgtcttgcttacagataatattagatgtgttttatatcctattattgcccttaatgttagtgtcattgtcctgttaatgataatggtagccatgtcctgcacttgtgtagtgatctaatttacaaacaggtacacattacctgttaatacacattacagatgtatttgtagagatgtacacttacaacatatgcagagtatgttatgacaagctacaatacaggaattacagagttaagtgaagatgcaggcaggagtacctaacccagcattgtggtagaagtcagggtttatggaaggcttttcagaggagataacattgagttcagtcctacacatgttcgtttgtttgtttgtttgtttgtttttgagacggagtctcaccctgtcgcccaggatagagtgcagtggcacgatcttggcttactgtaacctccacctcctgggttcaagtgattctcctgcttcagcctcccaagtagttggtactacaggcacgtgccaccacacctagctaatttttgtatttttagtagagccagggtttcaccatgtcagccaggctggtctcagaactcctgacctcccagtgatctgctggccttagcctcccaaagtgctgggttatgcatgttcttaaaagaatatgaataagtaagtggctgggtgcagtggctcatgcctgtaatcccagcactttgggaggccgagacgggcggatcacttgaggtcaggagttcaagaccacctggccaacactggtgaaacccatctctactaaaaatataaacattagctgggcgtggtggcatgtgcctgtaatcccagctacttgggaggctgaggcaggagaatcacttgaacccaggaggcagaggttgcagtgagccgagattttgccacttcacttcagctgggggacagagcaagactcaaaaaaaaaaaaaaaaaaaaaggaatatgtataagttagctaggggaaagcgagagggagtgccctctaatcagtgagacaagaatttatgaacactaagagttgagaaagaaaatggcacaaggggaatttcaggttcacttaagtctgaggcctagcttatgatgggcttggtgcaataaaaatgatgggggcagaggattgggaaatgataacataggggatttcaggagacaaaaaggtaaaagctacatcagacagtcccatatgtcgtggcaagctgctcaaggactttagtaaggagaatgatagaattaaatttgtgtattagaaagatcattgtggtggaggtatgaaagattctctgagtgacgcttaagagagtacaggatggaggacactatttgggtcagggaaacgagtttaatccagtttcatcacccttgtaataatccaagcaagaaatgatgaagggctggactaacgtagtggcaatagttggaaacaggaagacttgtgtttgaaaaatatttgacagagcaccgtgacctactgtggggcagatgagagcgatgaatgatcaggaagtcaagaatggtatcctgagacagagatacttctgacatgtcaaaaatataacgtgccatccttcatcccagagctacagaacaagacatgtcgattagccatccaggtcaaaggttccatgtggagctcaggagcaaggcctgagtgtgggataaaaattgtcattgcacacataggactggatgagctgaccctaagagatgtaggcagtgagatgaacataggagagaatccaggagggaagagaaagaagagcctaccaaagagacgaagctaataatgagtagaggctggacctgcacccagctctttggacaccaaacttttccaccgtcccagaaagttgcagaattaagccatctgtggcttaacatgccttgagagcatactgtgtcctaggatctttatacacattaccccatctaggacttagacacagctctgtggttaatgagatgatccccatcgacagataaggaaactgagtctcaggtcagcaaatgacctaaccagaaatatccaagtttgtcagactcctaagtctgtgctcatgttactaaaccatgtttctgcctttaagataagatatggctcctcactatttcctgggagaggcagacattaacagctatttacaattcaatctgagaaatgtagaaataaaggtgaatgctgagagcccccattcataaacaaaattctctatgcttttttttttttttttttgtaccatgtggtgatctaggagttggctggattgtgtataaatggtttttctctagtaagacgatagcaccgtccatttggagggtgagatgagccaccatggaaatacccggtcccacacatgcctgtggctaccctctaaaattcccaacctggccggaggcactcaaaacaaaacctcctgttccctcccaggacgactggcgcctggagcctgccttttgcccctgccagaggcttaggccagcctcggagtgatggcgttgcagggaggcagaacaaacggagctggagcagctccccactctgagcccagtcatctctcccagaagaggtgtgagcaggcttctgggctttgtcaccacagggaaactcggctgacgggcacattgccttagatgaaactaagccaatggcatgcactcatggagccagcttgagcatagacaaaaagagaggcaggagcacatggaaagaggcttctaatcccagctccatcatttctgatctttatgatcctgggcaatttgcttaccctcttcatgcctgtgtcttcagctataatatgggctgactgtgtttgactctatagactgtcagggtaactctaagtctgaatgcaaatgtacacctacaagtcacttgatatctgagttatgccccagcccatactgaattccaagtccccctagattataaacttcgggaggacggagactacatcacttattggctctgatgtctgtctttctatatcttttcatgtttaaaacagtagtttgaaatcagtgtgtatccaataatatttactgaatacttaatcagctaatgtaagatgttttagatagtagccattaaatacaactcatgaagttgacagaaaaacccacaataatcttggccacaggttatggagcaaagcaagtactaggggtactaccaacagagcaaagtaagtacttcaagaagccccaggagttagcccaagacaatcccatgaagcccaggccatgtgagggcagagtctgtgttgaaatagctagctgaagagttctgattgaccagctgggctagaacaactcagcttcatgaaatcttagaaaacctcaaagacaaaagagatattaaatatttctagtccaatcaattgattttatagctaaggagagttagttatagagagagaaataagttggtggttcataatttggatcctgaaagccctcctcttctatttactagctatttgacctcctgcagcttctatttcctcatctgtgaagtaaatataataataggacctctctcattgggttgtcatgagtgttaaatgtgataatatatgtgaagaacctagaagagtctgtagcatatgataaatgcaaataactcttagcaatgactattttattatttctatatgatttattattataattgttaactgatttaaaggctcatttcagtgggttttttccccaaccataattgttttaaaattggatttttgagaatcagtaggatctgttgatgcaaaactatacccatccttcaaaccatgcgatcttttatttaaagtaaaatgcagaactttatatggggccccctgaaatcaaaatgtgtttacagcttcatgactctgagccttgtctacatgactgtttctgcccgggctgcccttcctctctgcccaagcaagtatgtcctcctcgttcaaagccttgcttcaaggtggccatctctgtgaaatgctcactcttttcccaggcagtgagttattccttcctttgggctcgtactgcactcctctcttacctttttgtagcacttgccatgttttgttgttatttttttatttctacctggctgccctgtcagattaggaactccctgaggtaagcgaccatgccacttcattagtagtagtagtaatagtaatagtaatattttgccttattgttatagctttattgagctcagtgtctgacatacagtatgcaaccaaagtttttattactgtttttgaagtttttataatgatatttatatcagacacaaagagtacaccagatgtctaagtacagtttaaacaaaataccaaaatgaacaccagtattcccaccaccaaacctgtgaaagagaatattgccaataccttttaagtgtaagtttttaactgtgtgagtaaataaatgttacttgttttcttaattttgcttagtgttttagctctttgaggtaattttgaatcttgatttgaacatgtcccataataagctatttttccaagtgttagcatctgaaaatataagcttttcttctgtatcatcttctactccattattaagcatattgattaaaccaagaccaaggacaaatctagagacccctttacatggttgtgattactattgcctgtggttgttcagccagtcacctgactattccatcatacaagcctcatttcaaggagagctaacgtttatttggtgtttaacatataataaaccattgatatgtgacagcttacttaatctttacaaaagtcccccagcattcatgcattcctcccattttggagttgaggaaactgaggctcagaaaggctaccttacgtaagatcgcctagctgagaattgggcagagtcaggactagaatcacgatgggcctttgtcccgacccatagtttctcttctgttgttcactggtatatcagggaacacttaatggaaactttttagaaatgaagattccctaacctacttgtcatcaaggccagaaggttatgttcagtttgagtaagtctgtgttggctctaatggcccttgctttctgctcttcaaaacagatgaaagactcaaagaagtaatggtagcctaaaattaagactataatttggcagagacaaatatagaacctgatgcctgactgctttcagtttttgtaacactgggcatgttatttaactctctgcctcagtctacatatctgtacaataggaataataacagaatttttaagtgatttaatacctgtaatatgcttagaatcaggcctttactaagtacacagtaagtctcaactattgttgttgttgccaacagtgccgttattactgggaagtcagtgtcctgcatggacacctgtcatcaatgtagtatgatgagctccccttctttagggtcatggagcagtctccaggccaagacagccatcagcatggaaggggctttcacaaaaagatttttaaatatttaggtttgttgcaaaagattaaacaacacataagtacacaagtgtacattctttctctctctctcaaaacaaactaggaattcctagattcttctaagaacacagggtttgagagtgactagaagtactctttgtttccttgctttacacaggatgtctgaggagaagcatgtgctattccagatgagtgggcacaaacagaggtcaactcaaaactttctccctggacagagccaagcaaaaccattctctgacatttctgagcagcaaagcagcaaagccacaatcttctaatgaagtcttgctgcagctgatgcagtaacatccccaaattgtgggacaggggatggggagaagggaggtgaagtgtatccttcctaagcaatttatgcatacaagtaaagagcattatcatagagtttgaggtcaacatctgcctcagttgaaatcccatcgtggtcatccatgtactaaccatagacaacttacacaacctcttggggactaatctgtcaaatggggccaagagttctggaggcaaggggctgcaagacacagaaagagatgacttggctttggctctacctgtgcaaaccctgggtcctaagtggtaatgaatatggactgcctcattcatctcaaagaagctctgggacttaggaaagcaatttctagaattggcacgtgataaaattttcactgggcaaagaaaggcagagtggtgaaaataagtaccagttagtatgctctccttgtggctggaacattcaccatagctcactcgtgcattctttctctctcatacacacaacactcacactcacccacctgaataatttccatgcatgttttaaatcttaattcatgtaccatttccttggagaagcattccctgtcacctagactgaattaggtacctcccttgtgtgctctcttactaccttttggctttccctcatttacttctcacagttggtaattacatatttgtgtaatgatctgattaatatttttcttaaggtagccagttgccccagtttggctgaaactgaggggttttccagaaggcaagactttcagcgctgaaactgggaaagtcctggccaaacctgcgtaattgttcactctggtctgcttccctctcaagatcggatgctctttgagtacaggcactatgctcttgttcaccatttatctctgtgcctggcacagacctggactgggaactcaggaaacatctgttaaccagtaaagaagtaaatgtatatgttaatctaagctgaacttacttttcttatgaaagcctatcttttttctccctgaaattattctattttgatgttaaaatatcccttttgaaaaactgtccttatttgacaaaatttaaagttcacaatgttatgctgtttttgttttttgccttccttcccccccttcccattttgtggttggaaatcctactgatttgaggaatcacttgtttagtaaagagagaaccggggtagctgaggtcaagacaaataaggtctgtccccatgctaaaatgctagtaatcacttctgtatcctctgggcctagcacattaccaagcacatagtaagggctgagtaaatatttgtgaaatatataaatgaatagattttctgcccagcctcaagacctgctggaatacaacttgtatgcctaactcccttttcttccctaccctctagctaaacatttctgtgaccataaatgtgacttcagcattccttactgctgaatagatgagaaacatgtaccactgcagatgaatgaacacatggtctatccccacccgttctagttcatctctttaaatgctttccttactgttgaagggactgctatggtctgttaaaaaataataataataataaaataaaaaattttaaaaaaatggcactatcttgattactgagagcacctctcttacccacatggctttgttcaagctcctccctctacttggaacacctgtttcactttagcaaaatcctactagtcttttcaaacttagcttatgtccctttctctaagaagccacctctgtacccttccacttgtcaaaagtaaaatgagaacaagttagggaaaaatttgaaagttttctatcttacaaaaagtaccaattgccatcagcaagacttcaagtggtaagaagctcaccttacggcagttacagtgcagtttatgaagcattaaggagaaagtattttgacctttttagtcattggctgttatgtattaacatttttttttcaggggaaacaggactgtttaaactgatttgtctatagttgattgatttaattttcctgaatcatgctgacaaggacctaaagcttatgttttaatttcatcaaatcatgctgacagggagataaagcttatgttttatgctttgtttataatgagagctagcaactcagggaaatcagaatgacttaagttttaccacttgactctgggcagttggccttggggtatatatctaaatggcggcctctatctttgtataatctttagtacattcctcacctcctgtgcccatccacaatattttgtattttgtctttaccatctcatgaaccacactatattctatttgtctatttttttgtatagctcctccactagatgggagcttcttgaaagtaagaactctgattcatctttgtgtccccagcacccaatagggggacaggattgctattaggtagcagtacatatttgtaaaaggaaagaaatctatcagttattatagtcccccaaatgctaagttacagacaaatagaaaaccttagtgacaaacaacagtagacatttatttttgctcacaagtttgttggttggctaggtgagtctgatgatctgggctagtcaatgctggtcacctacaaatatttgctgatgttacctgggttctttcatatatgtgggacatcacctgagacaactgaacagactcagctctgttgcacatctcctgtcacccagcagccttgtagggcatggtcttgtggccaagtttgaggagcgaaagacagaacagaagcacacagcccttttgagacctaggcttggaaaactgacccagtgtcacatctgcctcattctcttggcaaaacaagtcacaagactggcatagattgaaggggtagggagatagacccacatctcaatgtgaggagctgcaaagtctcattgcaaagagtgttgacacaggaagggtggagaatggggaccacctttgcaatctctgccatagtgagggagccaacagggaaacaccttatcagtttctttccaaaatgaccatttttattaccttaacatttaaatgaatttatcaggaaagtttctaaaaaaaggagccatggcctttcttgggagagagtgacttccccaccataaaaggcattcaataagaagctgaattccatggtcatagaaatattaggaggagaacccttcccctacccctgagagtcaatgttttcacatattttccatctttctttccagatcagcaaagacccgatttttgtaccaggcgtctgggggccttatttctcagccatggtacctgggttctggctgaatgaaggtggtcagagcgttactggaaaattggtaagttgacactttctcaatagggtcatggatgtttttatgtcattgattagtccattttgtcacatgacccatatacccaatatctggaggatttgcagacccctgaatcggggtgtactttctcttagtgcacagcctaacatgtcatacacatgcagcatatattgcttaaggaagaagtgttacagcaggcagtgatgaccagcccttcttctcacctgatctttccttacatcaatccatttttctcagagtgatgagaatgatattctacttagagaaaacgacatgttactccccagcccaaatccttcagttttccccatagccccttgagacatggctcagataatattctggctgcattatacacttcatggtctatcccctccagtcccacacatgtgcctgtaatttacactaggttgctctcctcacagcttctccatgcctcctgtcattgcacttctctgtccctttatacaggcttctttccctgcttggggagttctttaccacctcaataattttacttgtcctttaagatccaactccagctcttagcacactctgttattcttattggttactaatccccttttctagaacactctgagttccttaaagacaagggccatgcggtacacagtggctcatgcctataataccagcactttgtgaggctggggcgggcagaccacctgaggtctgaagctcaaggacagcctgaccaacatggtgaaacctcatctctactaaaaatacaaaaattagctgggctcgatggcaggcgcctgtaatctcagctactcagatactctcctaagacaggagaatcacttgaatctgggaggcacagattacagtgaactgagaatgcaacactgcacttcagcctgggcgacaagagcgaaactccgtcttaaaaaaaaaccccacaaaataaagacaagttctctttgtatccacctcagtgccaggttcatagaaggtacttaatacaaacttgttgaattattaaggctgtccaataggggagagagaagattcataaaagtgagatgagtgctgtaacagaagtacacggtacagagttggcacaaagctaggttaggaaactctttacaggggagaaggcattggtgctgagccttaaaagataaataaggacaaaccaggtaaagaagggtacagatagtctacttggtaggaaacttgtatgggaaaaaagacatggaagtgaaaaataacggctaatttgagggtaatggcaaatagtccagaagttcagctgtggcacaaactattcttagaaaaatggcttacgataaaagttagagagtagggcagagaccacatccctgtaaaacatgctaaggaattgaacttcgtctagcagaccaagaggaaccagtgaaaggttagaagagtatgtggacatgttcataactcagttgtaaaaatctctgcttagaagccatgagggtaaaggcctgaggacacatggccagaggcagggagactagttttagtaggttagtcaacagacaaaaagccacaaggacttgaatgaggacagtaataatgatgactgggaattgaggtcaagagattggcaggcttctgagagatcaaatgtggaatacagagaaagtgagacctaggctcagttacacacactcacatttactgttaaattggaaatatctgcttatgttatgatgtgatttgcctaccaactcttctaaatgttcagccaattggaaatgatcttattcaaagctggatgtatatgcaaatatctgtgagtttacatttcttagtataatcctattttatacatgactgcctcaaattctctttcaaagtaaatggaagcataggtgggtagatggattcaaagggcatgttctgtacgttactgttgtgccaggctacagaaatgaattaaatgaattggacctcatcagtccctggttttaaggagctcatacttggatggggaatccctgagtatgaaataaatcatgtttgattggtctcagtaaccagtgctagaaaagttgagaaggaagacatcatctatggctacagtacagtagaaatgcagcccactttatattctcctatttaaacttgtgctatgtacttagtcaacttattttattttactttcagttccgggatacaagtgcagaacctgcaggtttgttacataggaatatgtgtgccatggtggtttcctgcacctgtcaacccatcatctatgttttaagccttccatgcattagcaatgtgtcctaatgctctccctccccttgcccctaactccccaactggccccagtatgtgttgtccccctctctgtgttcatgtgttctcattcttcaactcctgcttatgagtgagaacatgcagtgtttggttttctgttcctgtgttagtttgctgaggatgatggcttccagcttcatccatgtccctgcaaagagatctcatgcctttttatgaaggcatagtattccatggtgtatatgtgccacaatttcttaatccagtctatcactgatgggcatttgggtcggttccatgtctttgctattgtaaatagagctacagagttccaagatggccgaataggaacagctccagtctacagctcccagcatgagcgatgcagacgaccagtgatttctgcatttccagctgagatactgggttcatctcactggggcttgtcagacagtgggtgcaggacagtgggtgcagcccacagaccgtgagccgaagcagggcgaggcatcgcctcacccgggaagcacaaggggtccaggaattccctttcctagccaaggaaagccatgacagatggcacctggaaaattgggtcactcccacacggctactgcgcttttacaatggtcttagcaaacggcacaccaggagattatatcctgcgcctggctcagagggtcccacgcccacagagccttgctcactgccagcacagcagtctcagatccaactgcaaggcagcagtgaggctggggtaggggtgcccaccattgctgaggcttgagtaggtaaacaaagtggcctggaagctctaactgggtggagcccacctcagctcaaggagacctgcctgcctctgtagactccacctctgagggcggggcatagctgaacaaaaggcagcagaaacttctgtacacttaaacgtccctgtctgacagctttgaagagagaagtggttctcccagcacagggattgagatctgagaatggacagactgcctcctcaagtgggaccctgaccccctcagtagcctaactgggagacacctcccagtaggggccgactgacacctcatacaaccaggtacccctctgaaacaaagcttacagaggaaggatcaggcagcaacatttctgcaatatttgctgttctgcagcctccactggtgatactcagggtctagagtgaaacgccagcaatctccaacagacctgcagctgagggtcctgactgttagaaggaaaactaacaaacagaaaggacatccacaccaaaacccaatctgtacgtcaccatcatcaaagaccaaaggtagataaaaccacaaagatggggaaaaaacagagcagaaaaactgaaaattctaaaaatcagagtgcctctcctcctccaaaggaacgcagctcctcaccagcaacggaacaaagctggacggagtatgactttgacgagttgagagaagaaggcttcagacgatcaaactgctccgagctaaaggaggaagttcgaacccatggcaaagaagttaaaaaccttgaaaaaagattagatgaatgtctaactagaataaccactgcagataagtccttaaaggacctgatggagctgaaaaccatggcacgagaactatgtgacaaatgcacaagcctcagtagccgatttgatcaactggaagaaaaggtatcagtgatggaagatcaaatgaatgaaatgaagctacaagagaagtttagagaaaaaagaataaaaagagacgaacaaagcctccaagaaatatgggactatgtgaaaagaccaaatctacgtctgattagtgtacctgaaagtgacggggagaatggaaccaactgggaaaacactctgcaggatattatccagaacttccccaacctagctaggcagaccaacattcagattcaggaaatacagagaatgccacaaagatactcctcgagaagagcaactccaagacacataattgtcagattcaccaaagttgaaatgaaggaaaaaatgttaagggcagccagagagaaaggttgggttacccacaaaaggaagcccatcagactaacagctgatctctcggcagaaactctacaagccagaagagagtgggggccaatattcaacattcttaaagaaaagaattttcaacccagaatttcatatccagccaaactaagcttcataagtgaaggagaaatgaaatactttacagacaagcaaatactgagagattttgtcaccaccaggcctgccctaaaagagctcctgacggaagcactaaacatggaaaggaacaactggtaccagccactgcaaaaacatgccaaattgtaaagaccatcaaggctgggaagaaactgcatcaactaacaggcaaaataaccagctaacgtcataatgacaggatcaaattcacacatagcaatattaaccttatatgtaaatgggctaaatgctccaattgaaagacacagactggcaaattggataaagtgtcaagacccatccatgtgctgtattcaggaaacccatctcacgtgcggagacacacatagtctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaaccatcctaaatatatatgtacccaatacaggagcacccagattcataaagcaagtccttagagaactacaaagagacttagactcccacacaataataatgggagacttaaaccaccccactgacaacattagacagatcaacgagacagaacgttaacaaggatatccaggaatagaactcagctctgcaccaagtggacctaatagacatctacagaactctccaccccaaatcaacagaatatacattcttctcagcaacacaccacacctattccaaaattgaccacatagttggaagtaaagacgtcctcagcaaatgtaaaggacagaaattataacaaactgtctctcagaccacagtgcaatcaaagtagaattcaggtttcagaaactcactcaaaaccactcaactacatggaaactgaacaacctgctcctgaatgactactgggtacataacaaaatggaggcagaaataaggatgttctttgaaaccaatgagaacaaagacacaacataccagaatctctgggacaccttcaaagtagtgtgtagagggaaatttatagcactaaatgcccacaagagaaagcaggaaaggtgtaaaattgacaccctaacatcacaattaaaagaactagagaagcaaaagcaaacacattcaaaagctagcagaaggcaagaaataactaaaatcagagcagaactgaaggaaatagagacacaaaaaacccttcaaaaaatcgatgcatccagaagctggttttttgaaaagatcaacaaaattgatagaacgctagcaagactaatgaagaagaaaagagagaagaatcaaatagacacaataaaaaatgataaaggggatatcaccaccgatcccatagaaatacaaactaccatcagagaatactataaacacctctatgcaaataaactagaaaatctagaagaaatggataaattcctggacacatataccctcccaagactaaaccaggaagaagttgaatctctgaatagaccaataacaggctctgaaattgaggcaataattaatatcttaccaaccaaaaaaagtacaggaccagacggattcacagccgaattctaccagaggtacaaggaggaactggtaccactccttctgaaactattccaatcaataggaaaagagggaatcctccctaactcattttatgaggccagcatcatcctgataccaaagcctggcagagacacaactaaaaaagagaattttagaccaatatccctgatgaacatcgatgcaaaaatcctcaataaaatattggcaaactgaatccagcagcacatcaaaaagcttatccaccatgatcaagtgggcttcatccctgggatgcaagactggttcaacatatgcaaatcaataaacgtaatcctgcatataaacagaaccaacgacaaaaaccacatgattatctcaatagatgcagaaaaggcctttgacaaaattcaacaacccctcatgctaaaaactctcaataaattaggtatttatgggacatgtctcaaaatagtaagagctatctatgacaaacccacagccaatatcatactgaatgggcaaaaactggaagcattccctttgaaaactgtcacaagacagggatgccctctctcaccactgctattcaacatagtgttggaagttctggtcagggcaatcaggcaggagaaggaaataaagggtattcaattaggaaaagaggaagtcaaatttttcctgtttgtagatgacatgattgtatatctagaaaaccccatcatctcagcccaaaatctccttaagctgataagcaacttcagcaaactccccggatacaaaatcaatgtgcaaaaatcacaagcattcttatacaccaataacagacaaagagagagccaaatcatgagtgaactcccattcacaattgcttcaaagagaataaaatacctaggaatccaacttacaagggatgtgaatgacctcttcaaggagaactacaaaccactgctcaatgaaataaaagaggacacaaacaaatggaagaacattccatgctcatgggtaggaagaatcaatatcatgaaaatggccacactgcccaaggtaatttatagattcaatgccatccccatcaagctactgatgactttcttcacagaattggaaaaaactactttaaagttcatatggaatcaaaaaagagcccatattgccaagtcaatcctaagccaaaagaacaaagctggagacatcacgctacctgacttcaaactatactacaaggctacagcaaccaaaacagcatggtactggtatcataacagagatatagaccaatgaaacagaacagagccctcagaaataatgccacatatctacaactatctgatttttgacaaatctgacaaaagcaatggggaaaggattccctatttaataaatggtgctgggaaaactggctagccatatggagaaagctgaaactggatcccttccttacaccctatacaaaaattaattcaagatggattaaagacttaaatgttagacctacaaccataaaaaccctagaagaaaacccaggcaataccattcaggacataggcatgggcaaggacttcatgactaaaacatcaaaagcaacggcaacaaaagccaaaattgacaaatgagatctcattaaactaaagagcttctgcccagcaaaagaaactaccatcagagtgaacaggcagcctacagaatgggagaaaatttttgcaatctactcatctgacaaagggctaatatccagaatctacaatgaactcaaacaaattcacaagaataaaagaaacaaccccatcagcaagtgggcgaaagatatgaacagacacttctcaaatgaagacatttatgtagccaaaagacacatgaaaaaatgctcatcatcactggccatcagagaaatgcaaatcaaaaccacagtgagataccatctcacaccacttagaatggcaatcattaaaaagtcaggaaacaacaggtgctggagaaataggaacacttttacactgttggtgggactgtaaactagttcaaccattgtggaagtcagtgtggtgattcctcagggatctagaactagaaataccatttgacccagccatcccattactgggtatatacccaaaggattataaatcatgctgctattagacacatgcacacgtatgtttattgtggcactattcacaatagcaaagtcttggaaccaagccaaacatccaacaatgatagactggattaagaaaatgtggcacatatacaccatggaatactatgcagccataaaaatgagttcatgtcctttgtagggacatggatgaagctggaaaccatcattctcagcaaactatcacaaggacaaaaaaccagacactgcatgttctcactcataggtgggaattgaacagtgagaacacatggacacaggaatgggaacatcatacaccagggcctgctgtggggtgaggggagtggagagggatagcattaggagatatacctaatattaaatgacgagttaatgggtgccgcacaccaatatggcacatgtatacatatgtaacaaacctgcaggttgtgcacatgtaccctaaaacttaaagtataataaaaaaataaataaaatattataatgatggtaatattaattgtaataattgtagcttactgagtatttttttgtgagagggatttatagacataattctgttaaactttgaatgatagtcataattacaatgcctaatattattttgaaggcttgtttccaatctcagttccaagaacttttcatgtattatctaattaatattctcaaaagtcctatgatcatacctatagatacagtcattatctgtattttatagttaagtgactaaaggtagcaattacagcctggagagtctcctcacccaccagtgatggccttttaatatgttttatttactactcacctttccttaccatttactaattcttgtttattctcttgtaaattccaatctctggttttaaaatacatcattgtcacataggacatgataagaaaaagttgcatcttttttattcccgcttgcatatgcacatcttctctaataagccacatctgaaggtgtctgctccagtagtacattgtccatggtttcaacgatgccacacagtcataaatacaccacctaaagcataagagacgggaagtgagaaaacagagaaaaaggaaagtaaaggagaagaaacaatagaaaaaaagagaaggaaaagaaatgaaaaatatattaaaaaccatggattttaaaaaaagatatttgtctcatttttacaattaaatgcagatcttccattacaaagcaattatttcattctaagtatgtgaatagatttgtatttttaaaaaaaatcttcatctggttatcctcagaatgaaggaaaagaaacaggacaggatcttttgatatttacttcttcttagaaaacacatactcccttcctaaggatgattgattttagtttcatcacacatcaaggcctgtctcatgcttgccgatattctcttctgaatagttgtgcaaaaaagcattgctttttccccagactttgtccacagaacactgaccccgtgcagttcctacatccagatactgaagcttatttccagctggaccttggccatcaccctttccaggtgctcttgtttgtctcacgtggagtgatttttattggggatggcattgggtaaggaaggctaagacaagttcctaagccactgctatggtggcattgactttctggaacaattgtgcttggattgagtcacaaggtcacaatgcaacaagttactatgtgctcttgggattttaggatgtgtacattgtgagtgtctatctgcctcctgcgtcattgccaaggctgggactagcctcaggatgtcacctatggaagacattctgctataaatgggtgtatggaatgacttgcagtgtgcacagtgtagtacagattatggagataatgatttcatgccttcattcattcactccttccatcgcgttacagagatttcctgagtgattccactgggccagccaagaatacggtcactccagtcatccaccatcaaataagaaagttggatacagaactgatcattataatttattgtaggacataaaaatagatagtacaatcactatagcctactggaaaaatagaggctaatactgagtacctattatgtaccaaatatttttaggcccattaggatttggtatttcatctgatcttcacagcatgtgtatgtggtcagtgttgttatattagttttactgatgaagaaataggctgagaatgtcaaggtaatctgatcaaaatcttacagttataagtaggagagccacaatgcaaacccaagctggccaccagaggcccaagatctttccaaaactgaatctgacttttgtggaggtgcatttctgagtttttctttcagttctcttgtagacttctttgagaagcaactgttgtccgttaacatgacattctctttaagtgtcttgaaacaaatacagttggcaggctttgtaaggccatgggagaaaaataattaaatacaataaattaaatacaatatctgaaatacatatatagtagatgggcctaagagctgactggagatgacaaaagtgtcctcagtgagaatgagacttagactgggagacttagagagaaagagagagagagagaatatgaatgagaatatacactgaaaaaattaacaccctcagtctctcaggggcatgggagacaatagccaaaggtcaattagcattgacacgatctatgtacagatgtaggtgtgtccccagcatttcacatccactaattataattacttcatggatacaaggactaactctgcaaaaacaaatgcctccctgttcccttctcccgccctggcttttgcttattttttgtatacccacctggattgctacacaacttcctaattggcttcttgcctgtaatctttccccctctaatccctttgttgcattgtaggtatagaagtctttctgaaacagttatgagtctgtcacttgtgatagctcttcagttgtcattagaataaagtcttaattctttagagtgatgtttatttatacagccagtatttacggagtgcttactatatttgaggtactgttctgagtgagaaagtagcagtgagtaaaacagcctcttctgcactctcctgcactccaccaagactcctgtacccttctcaagcttacattctaacaggaggagacagataatacacaaaaaataaataaattccactttatggtataagttattaagacaaatagaggaggtagcttgtgagttcagatgggaaggttgtagttttaaatagggtggtcagggtagacctcactgatgtgacagttgaacaaagaatgaggaaaggaaggaatttagctattttgaaacctgggggaagaatataccaggtcaagggaacaaccagtgtaaagattctgagagggttgcttgcctggggtattatgggaatagcaacaaggtcacaatggatgcggcagagtgaaccaaaatgacagttgcagggaacaagttcagagaggtgatagggtctacattattggccacagtaatagtttttactctcagtgaaatggaaaccattggagaataatgagcggaggagtgatgtgatatgacaggttttcaaagaatcattcttactgctgcctactgtgttgctgattgttaactggggagtggaagtagggggagggaagcacagaagtcagaaagaggctattgtagtaagccagctgagtgaggaggatgatggcatggagctggtaaagaatggttagattttggatatattttgaaggtagagccaccttcaaaccttgaccttgaccttcacaccctgatggattaagtgtgaagtgtgcagaaaagagagaggccaaggcttgaggaatgtagcattgctattaatgggtgaaggtggattcaatgttatggagtcagagggaggaaggagtcaagaattactacgttttctgatggtagtaactgatccccaaagttgaccctccattatcttccttcatcttagtaaagagtaccatcatttatatttttattaaagccaaaaaataaaataaaaaattaggattaattcttgactcttcctttcccctctctcctcacatctaatccatcagtaagtcctaagggttccacctccaaaatatgttgccaatccatctctcttttttcttctcttttcttttcttttctttcttccactcctagcactgttgggcaaatcaccgtggcacttttcctctcctggtctatgtaaagtatattttttgtacacagcatatagttgggtcttgcttttcaattttatgatctctgaattttacttgggttgtttagatactttatataaagataaatatgatttgatttacatctttcattttgttttttgttttctgtgatcacttctgtctttccttcctgacttcttttggattaaatgactatttttcaattttaagaattcaattttaagttatctattggcatcttggctttctacacatctttttgcattattttttaatggttgctctagtaattataataaatatcctaaacttttcagcctactttgaatgcatattatgatacttcatgaaaggtataaatacccttcaactgtgtagttctacttaccactcctatcccagctcttcacgctgtagtttgtgtgtgatatctacatatgctataaacccaataatgaaatagttgtcatattgtttgctttaaacaatgtattagtctactcttgactaccataacaaaataccacaggttgggtggcttaaacaacagacatttatttccttacaattttggaggctaaaagtctgtgatcaaggtgctggcaaatgcagtttctggtgagggctctcttcctaacttgtagatggctgccttctgtgacctcacatggccttttctcagtatgtgtatatgaagagaaaacggttgtattccttccttttcttataagaacaccagttatatcagattaaggccccactgtcatgagctgtttaaccttaattacccccgtaagagccatatctctaaatacagtcacatttgggattgaggcttcaatatatgaatttgaggtgaacacagtttagtccatgtcaaagatacataaatgttttaaagaaattctgagaaataaaccatagtcttttgtatttacctacataattactatttttattgcttttcctttctttctgaaaatttgagtttccatgtgatatcttttcccaagcctaaagaacttgtcttagcctccgtctcaaaaaaaaaaaaaaaaaaaaagaacttgtcttagcatgtcttacagtgcaggtcaactggcaaaagacattctctctattttttttcaatgcatttattttatatgctgccttgaaagatatttttgctcactatagaattcttgatttacaggtttttttttccatcagcaccttaaaatgttagtattttctattctgacattattatttcttataagaagtcaaccattatttttgtcattctttccctttatataatatgtcatttttttcctctggctgctttcaaattttctcttaatctttggcttttattacggtatggcgtggtcttctttggattcatctttcttgaatttgtaagttgattcctttcaccaagtttgggaaattttcagcatttaatttttttttgtttgtttcttctccttgctctcttccctcttactgtgactccaattccacatatatggtacctttggctattgtctcccatgcccctgagagactcagggtgttaattttttcaatatatattctcattcatattctctctctctctttctctctctctaagtctcccagtctaagtctcattctcacgaggacacttttgttggtcatctccaatcagctcttaggcccatctactatatatttatttcagatattgtatttaatcaatactattacatttgtattttaatagtttgtttctttgctgtttcctctctgtttaataactatgagaatatttttcttttacatccttaagcattgttaaaatacctactttaaaattcttatcttctaacgcctgtgtcacctcagatttggtgttcactaagtggcttttctcttaagtatggattacattttcctgttcctcaatatgtataatgatttggggtcatattttggacattgtgattgatatattctagagacactgtattatttctgtttctcttttgagtattgattttttggtttagcaggcagtttatttggctgaactcaaacttcaagttttgttactctcctgtgatgaacatgtcctaaaatctctgttgcattattttagccttagctggactacttctggtgttcccatgcacatgtaattgagagatcatccagaaattagggtagcatttataggcacagtgttgcattccctttctatggctctctctttctgacatcccctccacaacttacttcctagctactatggttgccttgaactctaacctctcatttcttaatcagaaagactgtgtatttctatctgagtattagttatcttgcatgccactgactggggtccacccatgggcaaaaatgtataaaatcaggaaacacacaaagtactgttttttccttccttgtgtctactcctctccagtttctacctggttttggccactttccagtgtcttcagagaactatttgctgtattttgatcagcatttttaattgttatcaaaatgtgtctcatcattcattcattagagatgtcagcattgctctaggcactgaggagtggaaaataatgatgctcttgctttgaaagagctcagagtatagggtaagagacagacatataactaaggattgtaaaagaacttgatagatgctacagtagagtaaggatagaaaatatctgtgccttatattcccattgccaacctgtgatctttgtctgcatttcctattctccatgcctggtcatctccctgtcctttatacattaccaaatttttcttaacttttcatcatttttctctccaaatcaaaataatttttatggcctttgatctaataaaagtataaactcttatgacattcaagacacactgtctgccttcgccctctttattcatccttattttcaccagtttactaattctgtaatttaacctacagtaatcctatgaccaatgtatgcacaacacaaatagatacaaatgcaaagtgtggtaagtgccaccaaggagaagtacatggtgctatctgtgtttttcctgtggttcactcatcccacatttattccacaaacttttattaaccacccatgttatgccaggcatgaggctaaaccagtccgttaccattcaaatcatatatgtctttccattttcatgtctctactaaccagcctcctttctgtcatgccttgcctctagccctttactcctccaaactctacctatttatggcctctcagctgaagcttcacctactccaactgtataatgattgccaaatgattgatctctcactttgtgctgctatgcatcataactatttcttatttttcagtgtatctccggaacctaggtgcacagttcctggaggcacattaggcatttagtaaatactaaataactgcattcatgcttacaccacacatgctaggttctagctcactcctggaagctcatttaaatctctcttctctgaactcctaaagcacttcccataaaaattagcatcaaatcaagtaatgcctctaattatccattactgttcccagcgagtttatcttgatgctctcagtggattgcaaactcaggggatccaaagtgtgatgaggatatgcttcatcacagtaatgcaaagttgaacctgaaggagataaatattcaataactgcatgagtttttttttttcattgaaatgaccaatgtctttgatatcattttgaaacatttccacaaaaactgcaccaatggtattcaacaacgtatacctggaagttcagtagacaatatgacgtggtggttaagaacaaggtcttaaaatatagagactgcagtttgagacctagatttgtcgttactttactgtgaccttgggcaagatattcaatctctttgagctcagtttcctcatctccataatgaagaatagtatcttctccataggagtgctataaggaataaatgaaatagagtaatgtgtgtacaatgcttaagttagtactgatgtatgggaaatgagtcagtatatttcacgtgatatcatttatactactgttggcactatagtagtgtattagtccgttttcatactgctgatacggacatacctgagactgggtaatttatacagaaaaagaggtgtaatggacccatagttccacatggctggggaggcgtcacaatcatagcagaaggcgaaaggcatgtctaacatggcggcaggcaagagggaatgagagccaagtaaaacaggaaaccccttatgaaaccatcaaatctcatgagacttattcactactacgaaacagtatgggggaaactgcgcccatgattcagttgtttcccactgggtccctcccacaacatgtgagatttatgggagttacaattcaagatgagattttggtggggacacagacaaaccatatcaagcagacacacttaacttcctagaaatcctgtttaaaaggaggccatggaagttcaaaacagtttagtgacttgcacaaagtcactcagctagtgagactcagagccagaacccaaccctggcctctgtgtctcctgaacaaattatcttctttacacagccctagctctcaggaaacatgctcagagagcctatccctgtgcagccaaaagaccaaatcttttccttgttggaatgaaaataaatctatcagaatggttgttttagcatcctagaaactcaagtaaacattcagaaaatatacagatgaggttcaggaactcaagcacggtgttgcttgggtgtgttatggcaagcagagtaaatgcatggagaaacatttctgtccctgatacatatttcatactattttgtttagagccaccaagtggattaaggaataagatcctagacctgggatttcaaatgagaggtgattatctgcagagctcagacatttctgtccttggagagctgtgtttcccatgtgatgattgttcagtcaggagagtttctcctgacaggtctggggcatctcaattttttttaactgagagtttcaaaaaatttttttaatgagggttttttcaaaaaccctcatcatagtctctttcattcagcttctccattagtaagacacagtgagtaattcaaggtttgacattgcccagggatgacagcctagatcaagaaggggaaatgatgtgatccagaaaaggttggtgcttttaacactcagaccccccccatttgacataagttacccttccttctcattcttgggcctgttgctaacctgcttctaccagtttagccttggaaatttcatttctgtttactcttctctctaaacttctttgttttatgtatttaagaggctagcagtaggttaaatcaaagctaaatttcttttagctgaggcactcttgctacattggcattttaatgttcttggaacccgtatggacaaagagttgaaagaaacatatactcattttaatataaatttttctatcttatacataaattaaagaagctataaaattgacccatgtctcttatttttcagatagaccacatggtacaaggccatgctgcttttccagaactacaagtaaaggccacagccaggtaactgctgtctctgttccctctaaaattttccttgtgtgactgtattgagagaattcacgttgggcagttgggtgattttcagatcctacagacaatgaaaatgcctgttagtgcttgaaagatagtcacctggatgatccagaagatagatgtattaattctttaaatgaggtaagagaacttagagaacctagagataccccaagaatatacccagggactatagataagaaactctgatgtagaagaaggaccatggattctggagtcaaaacttcttagtttcacatcccagccatactccttaatagatacaggaccttgagctagttacttaacctctttatgcctgtctcttcatctgtaaaactgaagataataactgatatggagtgatttctagaatattttgaagcaagctgagtgcaaaaaaaatttacgatatactccctttcatgtaaaaagaaagacataggaaaatacatgtgtatctgttcatttttgcaaaagaaatataggaagtggccaggtgcggtggctcactcctgtaaccccagcaccttgggaggccgaggcgggcagatcacgagttcagagatcgagaccagcctggccaacatggtgaaaccccatctctactaaaaatacaaaagttagccgggcatggtgatgtatgcctataatcccagttacttgggaggttgaggcaggagaattgctcaaacccgggaggtggaggttgcagtgagcagagatcgtgccactgcactccagcctgggcaataaagtgagactccgtctcaaaaaaaaaaaagaaatacaggaagtttaaaccagaaaataataagattagttacctacagggggtgggtaggaatggggtggaaagaatgtgggaatgggaccatggtagtaggaagaaatgacacttctctgagtatacctttttatataactataactcttagaattattgtcatgcctcatgtccctgataccccgataaaataggtgatagataaccaggatatatgtgtatgttggcatgggcaaaatgaaatgcacacagtaaaaactgaacctactgtattacaaagggggttgggaaaagaaaagaaaggaaaagaaaaaagaaaagaacctaagtaaatttgggaaagaatattttgactatatgccatatggctaaagagaaaaataaccatacataaatattatactctaattggtaaatctgtttttcataggtgtatatgttagctatagtgacaactctttatgtgtatgctacagttgagtgaagaaatcaatatattgtggataataagagccaggttcctcacaaatgggaaaaggagaaggttagaatgaacctcatggtgtcaatatcaacttatgattttatatatatatatatatatatatatatatatatatacacacacacacacacacacagctggatataaatataagtaaatatagatatgtatattcatgcatgaatatacatgcatatactccctaggtctctctgctgagatggcttggaagcaatgacacgatagtagcaatgtgtgtacctagctcacaggtactgtattctaagtaccattctcccatttctccaataaaagtaatcaggacttcttagaaagatggctgagtctacgctgcggcagtaaaattatggtgccagaaagaaaaaagttactcaacaaggaattgtcaaggtacattggaaccaactttaagaatctctcagtggcctactcaggataaaataaacagtaatagcgtaaagtaagtccataagtaaataactttgtaagtaaactactgaagaaggaaataaacgaggacgaaatgacaggtcttcctcttcactgtcaggacagtagccttacaattaataaatgtagaagaaataatggaaatagataatcaacattaggtaaacactacagagataaatgttgtaggcaagaatcattaatggatgctaaaattagtgagtaaaagtgggaagcaggatattttcataaacccagaggatttcagtacaagatactgagtaataggaagaggaaaataataactttccagtagtatataagtatggcagacaccaccttacccaagtgatgaaagtaaacaacaccagcaataacatgtagtgatatcatgtatctccttttatgaggcaccgataaagatacaacatcatttctgccatgttcttgcccaaaatgattaaactcagtgtaaatatgggaagcatcagacaaacctagattgacattccacaaagctattagccagtttgctccaaaggaaaattaagaaacttaaatactgaagaactgtcctagattggaggagacttaaggaggtactacagctgtaagcagtatataatcatggattcaactctggaccagagaaaggacattggtggaggaaaactgttgaaattcaaatagagattaatagtattgttatttatggcaatttcttaggtgatgagtaaaagggaactctgtgtattatttttgtaacttttgtgtaaatctaaaattattttgaaataaaaagtctaaaaaataatgaatggattttcatgctgataatgcttagttgtcaggctgtttaagtaaagtaagatatttttatagaattatcagagaaacccatgtagctagctagcacaggacaaaagagagatagtctaaggtggccactaatagactctgaagccaaattgcctttgcctcagctttgtcgcttattcactttctgtttctgggctatttacttaacctctgtgccttagtacctcactgtaaagggaataatagtaaacatttcataaggttgttgagaaaattaaatgaattagaataatgggtgatacagagtgatgattaagagtcaggctgtaataggtgttcaactaaaaaaatggtaatgataaaaattactgttggggaacatcacacaccgaggcctgtcgtgggatggggggataggggagggatagcattaggagaaatacctaatgtaaatgacgagttaacgggtgcagcaaaccaacatggcacatgtatacatatgtaacaaacctgtacattgtgtacatgtaccctggaacttaaataaaaaatgaataaataataaataaataaataaatgattgttgtagttagtatattagacatttccattctactaagtgacttacattctaataggatcagcacacctacacagagcagaataaatgaatactgtagtaaaatatacgtagtgtgttatcaggctgtgtagaaaaggaggactgattttgacaaggagtttaagaaaagcttcataggcattcccttctaggagtctttagttataatgccattgcaattagtcattaattacaattaccattgagagggattatgtcacataaccttaccaactagcatattagtggcatagagaccatataacctagaaaagggattcctaatttcggatcatcaatgaacctctttaaattgtgtactgttctgctgattacataattctgcatgtatttctgtgaagggaccataacggtcattattttcttaaagggtttaagcatttataaaccactaagccaaagaaaagagcactaaatttatagtctggagacctgaatccaaatctcagctccaacatgtatcattgtgtgaaacccattttcttcattataacataggatagtaatggagaatcaacccgaaacacctctaaggatttattttgagtttagaagaggtaatatatttgacggggccttgtaaactgaattgtgacaataatgatgatcactactactctgttagtccattcttgcactgctgtgaagaaatacctgagactgggtaatttataaaggaaagaggtttaattgacttacagttctgtgggctgggcaggcatcaggaaacttacagtcatggtggaaggggaaacaaacacatccttcttcacatggtggcaagagagagaagtgctgagcaaaaggaggaaaagccccttataaaaccatcagatctcatgagaagtcactatcacaagaacagcatgagggtaaccacacccataattcaattacctccaaccaggtccctcccacaacacatgaggattatgggaactaaaattcaagatgagatttggtagggacacagccaaaccatatcaactactactattactactaatgattgtaagaggaggaagtttggtggtggttgctatgggttcaagcagcatacgtcagtcattcataccttgcctgccttcttatggaaagcatggaggaacagcaaggacagggactgtgaattagagtccttgagttcttgtacctgttctgccctgaatgtctcaatgactactagattcttcatccataaattacaataatgataccctacttacttcattttacaggcattaataggatgaaagcaggtcacaggaatgtctgtatatgaacattttagtgtgtaacacaaacttactgaatatttagttttgcaatgacatactctaaacttccagaactttcttctatagataaacttcatttgagtagcttctgttgcaaatcataataaaaagaagaaagaatttatggattaccatgcaaactcagagaaacaacagtatcgggtggttcagaagcagcaacttacagaactcagtgatggagtcagaactggatttaaatcccacctcttttcacataacttcaaacccacttccagctactttcctgtatttctccttctgtttagagtggagtttctccaaagcatcgcctgtactcttggtctctacttctccacttcctactccttccttgcccactgcagtttgaattctgtcaccatcagccccctgaaacgtttcatattaaggttatcagtgacctctattttgctaagtccataggatgttttttattcccctttctttagttctcagcagcatggggcatcagtgatcactttttcctccttttaacattctctttccttgactttctggaatgtcaccctgtctgttttctccctatatctctgattcctccttcctaaccacttttcttgagtttatagtccttttcttgaccattaacattaatttttgtcacagctagcttcctggccctcttctctctttgccatctcttccaagatgatctcagctatgctcttgacttcatttctgtctatattttgatgactcttttatgtccagcccagatacttagtaggtattcagtaaatgttagttcggtttccttccacttttcttttattgtcttacaaaggaaagtgcatctgtgtcttattagatctatgagtacaatattctaaaactatgggaccctttatgcttccggtcttagaaagaaacaggcatagctgtttttgaaatgaagttagctgtttggaagagtggacaaatccttctgaatcaagaaccatgtgtctcttttactatgacttggggctttctgaaaacagcaatgcaggtcacccctatctcagagcttagggtcagcaaatcctgtttgaaactgtggaaacaagtgttgataaacagattgagtattttatactcttgatttacaataatcctcttaggccccatctctgaagagaagtgttttgcaagcttataaattaagtaaacaagaactggatgtgcccgtacatgtaactggtaaccaaagtttctcttcatgtggggccaaatttgcagatatttcactctttagcagagatcaccttatgtcaatcataaattttgactcttttcctctaaacttgattctcttagaggttcttaactaacagtgtctctgaattaggttctggtgacaacagggtttagtgagaacattttggcataatccacaagtgctagattcaaggttggcagcaaagcaaaacttaaaatccagggtctgtggcccatctgtctgatgagtatcttttgagcatttgtgatacatgaatgaaccaagcaaacaaagtctttgctttcataaaaatatacacacacatacatatataaacatgcagtacatacatgcaaatatgcatactatatacatatacacatatgcatatatacagatatagccagccattgataaatgctctaaggaaaattgtagataaataaggagatatagagcattggtttcaaagcccttaatgttgtctttgttgtgctagtgcatatttttttcctcagcctttcttttttcctactttccctgaatttttctgttattcctctgaggacagctaatttttcttgatctgatttattcctcaaacttcttttgcttttgtaattcccataatcccactaaatatcaatttcttaaaattcactagtcctctatatcgcgaatcgcagatagattaaaacttcccattaaaggctgtacaaatccccctcaagcaaagaaagggaaaaaaaggacaataacatttattaagaatctgcagtatgtttggcactgtgcttagtgataatagtttcacgtatattatctcatttaattctagatgaggaaatgaggattattgggagctctcaaacttcacttctaaaaatttttctctctttccattctgctcttttgtattgagagtccccttttagcctttatgactttttaaaccttggaccgtcattctgataactggggtgttgagtctatcactgaatatttacttagccttccctgagctaggacagtcagtgtgataatattaacacctttcattcccccatggtatacaaagataatcagtaaattcttgatggctctgagttcagaaagatttcttacagaaattagctggatattattatacatttctttttttttttttttttctttttttttgagacggagtctcgcactttcacccaggctggagtgcagtggcactatctcagctcactgcaagctctgcctcccgggttcacaccattctcctgcctcagcctcctgagtagctgggactacaggcgcctgccaccgcgcccggctaattttttgtatttttagtagagacggggtttcaccgtgttagccaggatggtctcgatctcctgacctcgtggtctgcccgcctcggcctcccaaagtgctgagattacaggtgtgagccactgcgcccgacctattatacgtttctttggtttctgttttgcatgcaaataaaagaaagtgctcagggcattggggtcttctctagaagaccaagggtctgtgctgatttaggacataaatcctcttattttctacctcccaactggttaccagtagctcagcacagtgcctggtggcataggggcatgtgtagggaagtcataagatgcctgttcctttgccctgtccccatcttctgtatattccagcatgtctggaaggctgtgtccatctgaagggttttagatggtgtgggagtaataatcaaggttgcattgtagaagaaccaatcaggaaagagtacagaaagcctgattggacattcttagttgagttgtctttggacatctaagaggaggcatttgaagagtggttggatacttgacctggaactcataagaaagaaatggacaggagttaaggtcatatatttggaagtcctcagcactagatggtaactggagcaatgagaagaggttaggatcatccaagaggagataaagagtaagaaaatggtgaaagacagtagatctctggaagacgtcatatgtttaatgaacaagtgaagaaggagaaacagccaaagaggagggaggaaaatcaagagagaatagtgtttcagaaacaagagaacaaatgaggaaggagtggtcaaatgatgtaaaatgcccaaaatgattcatcggcattaacaacaaagagggtattgttcctcatggtagtaccagtttcagtagaatggagcaggcagaatgcatagtgtattgggttaagaagtaaggaactaggccggttgcagtggctcacacctataatcccagcactttgagaggctgagacgggcggatcacgaggtcaggagatcaagaccatcctggccaacatagtgaaaccccatctctactaaaaatacaaaaaatttagctgggcatggtggcacacgcctgtagtcccagctactcgggaggctgaggcaggagaatcacttgaacccaggaggcagaggttgcagtgagctgagatcacaccactgcactccagcctagtgacagagcaagactctgtctggaaaaaaagaaaaagaaaaagtaaggaactagagacaggcaatatggaagcttcttttctaagactttctcttgttggtagaaaaggcacaagtatattttgttataccatgtattctgattttttggtttaagagtatgaccaccatactctctgggcagcctgtgaacccatagaattaggtgatttatggagagggagaggacatgagagatttcagggatgttgtctgcatttaagatcacaagcaataggtccgaaaaaaaaaatcttctttgattcttggatttttaaaaaactagaaatgagtttcttatgatggcaaagaagaggaaactatttattgataaacctgtcattttatagtgctcagggctctatgtttaatcttcatagcagcctttaagtagacagtattagccccaatagcaaaaaagcaaataggctcagagagggtttgcctacctgatcatccagctggtacgtggtaaagtcactttatgattattgaaactatattttcttcatgatacccagtgggatgtggacagcaaaagtttctccttttgagacaggatatatcaacctggggttcatgagagagagggtgagcgatccacttgggatcacagttaatatgtgattccctagctagaagaaggcaggctgccatttgagaaggaactgataaaacatgcaaaatgacacaaagtcagaaccaaaaaaggcatcatgcaaggttaaaattatgtgaataatgatgtgtattagttagtttaatgtcttccaagtgcatttcattttgaatgatatactcagatagcacacatggtaaggtataattgaaaaaacatgtaggagaatggctgcattcaaagaataaacatacagctgcaaggaggttaggagtcaaaggggtaagcatatgccccatccctcagggatctcattagtgcatgagtggccatatatgtagaggctaaatgaatctcactgtttgcaaagacctgcagtaaatgagacaatgacgaatcaataataattaggcctatacgttcttattgacccagatgtctgaaaccaaatgccctgctcagagattccttgagaggcagaatgaaaagatttatagacatgcgtttccaaaaaaaaaaaaaaaaatccctttactttaagaacagtggctattctgaagtggaaagtcgcaagaattagtgcagactcttgacttctggctagaaaagatgttctcaaggcttttcttgtgaatgtgattcctgttggaccaggagcagagagagcaaagagatggaaaaccaggaggttatcatattcgtgttcgctgatacgttgttctggctgtaccttgtatggaggcttcagaggatcctttcctgaagccataatagaatcattctaaaacagggtttgtgtttttagggctttgataaataatttctgacctaagatacagaaagtccatggcttcagaatcacaaggagaagggtttaaagctggactcagacctgtctcttcacctcttgaagcatctcctctgtatgttagtggtacctccccaactgggcagtgttggaaggtctggtgtacatttagggaatggcaactggtgttaactgtagttgttaagccttttcccagtaatatcttattcctcctaataagatctaaggaagaagatttttgcagatgagaatgagctattacagcaagaagcaaataaactgctggtaggtagggcggttgggctgccctcacctccaccctagtacacatcacacgcactcacacacacacacatatacatgcattcacatttacacactcactcatgctcacacagagcagctttgcttttctatatttttacattgaatatttacatacaatttttgtttaataaaggagttctactggacgggtgtggtggctcaagcctgtaatcccagcactttgggaggccgaggtgggcagatcacgaggtcaggagattgagaccatcctggctaacacggtgaagccccgtctatactaaaaatacaaaaaaaattagccaggcgtggtggcggacgcctgtggtcccagctactcgggaggctgaggcaggagaatggcgtgaacccgggaggcggagcttgcagtgagccgagatcgcgtcactgcactccagcttggtgacagagcaagattccatctcaaagaaaaaaataaaataaaataaaaaataagtaaaggagttctactggtaaatggggaaaaaaagagaatttaaaaatcaatgctctactcattggtttgtttccctacaccaagtacaggaaacttttggcaacttcatgggatccatgggatcactcacccaatcacaaactagaactagaaatcactgagccttccttctaaaacacttttaaaatgcaaagcataaataatgccttaggtatcttagatattaacctcctttggatattgatttcctatacttttttttctgccattatacaagccatgtttttaacctttaaagagacttccaaggaccccagtgggaagtagcacagatgccaactactgcaatatccactttcttttgaaatcattggttcagaacttttagaaagcagcatcttttaagaggggaaggttgaccagctttcatctttgtgtcatgtggtgtgatttaacccggtgaggtaggtgttattaaacctattttatgagtgggaaaattggaggtcagaggttaagtcactggcccattttaccgagctaggagaggtagtatcaagatttgaactgagtagtgctctcatgcccatcatcttctctccacctcctcttcacctgaacatgtaaagaatgaaggagttggtttgactccctcattctacacatgaagaaactgagacttaaaaaggagaaaaaaaaccaggcgaggtggctcacacctgtaatcctagcactttgggaggccgagatgtgtggatcacctgaggtcaggggtttgagaccagcctggctaacatggtgaaaccccgtctctactaaaaatacaaaaattagctgggtggggaggctgaggcaggagaatcgcttgaatctgggaggcggaggttgtagtgagccgagattgcaccattgcactcccacctgggcaacaagactgaaactccatctcaaaaaaagaaaaagaaaaaacgtacacaatgtcatctggtgggtttaggttgaaaatcaggtctctaactcctgatcctaactgcatttatgacattcagtcactttacttagcaaaatcctatcctgagtctgggaacttataatttctctccatttatcaactcatcatcattattacaattaggaatactgattttaataaattattgacatatgaccagtactgtacagtttacaaaatactgcgccttcacatacataatcttctttgatcttcacaataaccctatgaggtaagttggacagggattatgatatctgtttttacagatgagaagagggtggttcagaaagtttgaataactttctcatggccatacatctactaagagtaaagccattcctggatccagtcttctgactccaaacctttctactaggatgtggcacctttcttggtgatagtacagtgtgatttgagagtacagtgggctagcttctctgaagcttttaggagcctgcttactttcctggatctggaagtacaaatggtttctttctatagaatgatttgctccctgaccctatcccccctttaaaaataaaattcacttctcttccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtaagtaacagctagtccttgcacatgggtgaaggcaggccaaagggctacaaagtttggaagaagcaaagtgaggaaaaaggaaaagaaaaaaataaaacaggccaacagccctctggctttgtgcagatgcattgctgttgctgctccctgggatgagctgctgaaagttttcattgtttctgagccaaccttgaaagcgttaaaagcagcatttcctagttcagctactgctgcctctttgtcctgtggagtggctaaaagtcatgcctatgtaattttggcatttatatcagtttgtaaagtcaaattttccagctgcatctttaggttgcccagtaaatcagtagtaaatattaccacccatggtcttgctggccacagccacacatctgcctaggctctgagtcagggctgttcagattctacactaatatagttaggatttcagattaaactttggtataagtaaatgtaatttataacttatgttggaaaataaatcctgctcttagtgccctttagggtcacttcctctgtggatattctaggctctcctagaggggccagatgaacttggtgggagaactctcaaccaccccagttgagatataaaagtaataacatcttagacaccaggagaatcatgtttgaggtgtgatgaagcaggttaaaggtagaggaggggccaggtgaggccacaaataagaaaataagccatgaatgcaggaaccaggaaaatgtcatgaagctgagaaggtgagtgtgaggtacattaaggcagagttcagaatggaggctgtaaacaaggcaaggcttatgcaaaggaagccgcgtaacagtggagcaggcctgatggagtcaagaattcaagactcaaactactacaattttgtggttagttttattgagattgttttaaatatttttatgatgccagcaggaagacctgaaatttattttcattacctagttgacatgatcaacttctattactaaaagggagtcatggtgaaaagaaaagaaaattagacatgacaaaggttatgttgatctggagtccatgaagcatgcctacacaacaaatcatgagcttggtgtccttttttatagaggcagaagaataatgtccagagagggccatgtggcaacagaccgcaactagaaagtcatactttcagataaccaactctctctgtaaacagggggtaggggaagaacacatttcatatgggtacagaaataagtgtcttaattagagacaaatatctgaagccaaatagagctagatatttaaaatgttgaagcagttaagaagcttgaccagtgttttaaatgaccccaaaacaaagcagtgttgcatagtaaaatggtcattgctctggaggtcatttgttgctttagataaaactgacctaggagccttccctagccaatgtctgtcatacccaaattcagtacccagcatgtcaggcttcatgtctcccagtagcttttatccattttttaaaaccaatcctgacatccaagacctaagaattatcatcagaaggatattctaatacagttgacccaaatgcagaatgaaattccaaagaaatcaatggagtgttctgaagaattctcatatcatgagaataagtatgtatgcaccaaaaggaacttcttacatggggacatatgcccagttgtatctaaaaatcctgggtatgtttacttttttaaaaagttgtatgtttgttcacatacctcatatatcacttggtagttcttggcaatgattccctttataactgtccttgggttaggctgcaatggaacagttatcactccatgaatttgcatcacaacactggaaggagaagatgacctaaataagatagaaggaaagcaattctgagctaaacacttcaccccaaatctccttccttcagtccagttttggaaaacatcaaaataatgaccctgaaattcttctgttatgttatatccttttgctggaaactacgatgatgcctatctccagcactcattcagcaaatattaattgggttcctattgtatgccaggcactgccgtagatatgagtaagatgcaacaatacctaccttcatggagtatgtttaaagttgggagtgggcgagtgcttgaaaaaatgttaataggaactagcaggataattccaataaagcaagatccatgtacaatttcttcttttggcccctaaaacgtttccctggacacagagtaagtgctcagtatatgcttatttataatttataggcaacatagagataataaagaggtcatttgttgccttagataaaacaaacatatgaagaatttaataataccaaatgaattaagtggctactgacactgactatccatatcgtaagtatttaataccaatattaatttccaagtaaatgaagataaactccaattgtatcataattatgagactgtttattcatcaaacaaatacaggccctgttacagttgttgggggatataagagtagctagacacaatcccagccctcaggaatatcaccatctttgggaggcagacaaaatatataaacagggaatggaaagatagtattaagctccagatgtccttcactgtccagagctctccagatgcatggaagacgattgcccaacctggtcccagcggtcaggaaagctccagacaggaagtaacattgacactgagtgaagctgggaagggggtttgaggccaagggaatcatagtatgtgcagtattctagagggaagagagcatggcatgtgaatgtctacaattttggctccttgtatcattgtctaaccaatgatagattgcctttagcattttatcttaataataaaaaaagaaaattttctcggatttctcagagaaccactggatatctgtatattccggctttggcagcgttgcactctcccagttctctactctcccctcaggtgactcttttcttgcattgttaaacatttacccattcactgtgtttttattgaatacctgctatgtgcaggcctgtgctaaacccaggtaatacaaagaaaacagaaaagtacctatcctaagttcacataaaagtaggggaggtaattattgtacatgtgtgtatgtgtgtgtatataatcattttacagtgtgatctctgtaataatcagtgcaagctgaaggagatgctcaatacatgtctgactttgaaattgtttttatgtggcattgggctagcaaaccctgatgcagcctttttctgcttctcttgaaaatatttgtaaaaatgcaaaaaagtcatgaattcatgcaggccttaggaattaggatggtgttcaactaggaaaactagaattggtattcccaattatatgatgaatgcaacttgtttgataacatcatatatgacataagaacaaagtcatgtgtgatccactgtggaaacagtttggacctcgccaccttctgctcccttgcataaaagcacaaggttcttttaaacctgaaaacagcatagctattcctctactttactgctaatggttgggttttttgttttctttttggaaagcagccagtgagtttaaattcctagatccccccacaaccctgttcccagccactctttcagttcattccatttgaaaactgccagctcaagaatccacccaagcaggaagtgtgaattaggaggaagggtgatggcttgcattctaagcatctgttaatggggcagatgtaggaaaggccttagtagttctgtaaacttgggaggaagggtgtagtttgcactactagttctaggctcggaaagccaggcagtgctgatctacctcagtccaacaaagctacagaaaataaaaactgctgtactctgccaactggcatttagctgtagatctgaagagacaaatttaagtatacagtgagtggggataagagcaaatcacggctgtgtgcggtggctcacgcctgtaatcccagcactttgggaggccgagccagttggatcatgaggtcaggggttcgagaccagcctgaccaacatggtgaaaccccgtttctactaaaaatacaaaaattagctgggcgtggtggtggacgcctgtaatcccagctactcaggaggctgaggcaggagaattgcttgaacctggtaggcggaggttgcagtgagctgagattgtgccactgcactccagcctgggtgacaagagcgagactccgtctcaaaaaaaaaaaaaaaaaaagagcaaatcatgtgtactgtatgctgggaaatactgaacatgtgtacctgtctagttagcgtaaatgttgaaaaataatggccccttagaaaaaccattacatacggctggacgcggtggctcacacctgtaatcccaacactttgggaggccgaagcggatggatcacgaggtcaggagatcgagaccatcctggctaacatggtgaaaccctgtctctacttaaaaaagtacaaaaaaattagccgggcatggtggcgggtggctgtagtcccagctactcgggaggctgaggcaggagaatggcgagaacctggggggtggagcttgcagtgagccaagatcacgccactgcactctagcctgggtgacagagtgagactccatctcaaaaaaaaaaaaaaaaagaaaaaccattacatacaaagaaaaaaataccattgtgaacacttaaaggaaagccctcttgaaaattatttactactgaaaccaaaagaaaatgttagagaactttgtggtatattcaatggaatatttttaatttttttttaagagacaggatcttgctctttgtcactcagactggaatgcagtggtgcagtggcctaatcagaacccactgtaaccttgaacttctgagctcaagcagtccttccatctcagcctcccaagtagctaagactacacaggcacatgtcagcatgcccagctaatttttaaaatatttttttgtagagatggggtctcactctgttgccaaggctggtctcaaactgctggcctcaagccgtcttcccacttcagtctcccaaagtgttgagattataggcatgaaacactgttcccagccagaaattttgtttcaaggcatatctctatgaaataggccagaaacttattaggaaagaacaagttaagatgaaaggacaatggaatgagaaaaagggggaaatggcaaagaccacaagacaactaaaaatgcaatcaaagaattaaaacctacattgaaagcaatagggagtataattttcactgaagaaaataagatcaaggctgtcataagacataacatatgttttaaatttactctataggaaaaacattttgaggataggagcaatggcttatttactttttaaaatatcaacagttcttaggtcagaagctggcaccaaataattgccttatggtcaaacagttatttcaatcactgtttgccaaatgaggaatgaacagtgacctgcccaaagtcacaaagccaagaagtggcagcgcttgccttttaggatgcaaactctggactttgcaaaacgcatggaggactattaagaaagggagtttaaacatgcattatacatggtttcatagtgaaccatgttccttaagctagtccttggctcttctgttcttctgaccaccaaccttgtggcttgtcctcccacttttaccctaaccatggtctttggatttaaactctgaccctgtctcttctcagtaaggtactagtttccttcccaccctaactgactcagatttaaaaaaaaatagccactcgtggtttgacctggttctaatgccttccacactaggtgcctaccttggtaagtaggaacaggacataacccaggaatctcttccttatgcttgatagtatcattttctttttgttctggtaacagttgactcctatcatgtgactagctgtttcatttttcttttgatgatacaatatcagcctgaagcactggactaaagagaggtggaggaggtgggggatgagcagcctaatagcatggctggactaggtaccccactatgtaaacatttctcctttccagttgataaatgaagcacagaaaggtgagggctacacatacgattatttaaaagaagcagaatcttaagtaataacagtcggtctcaaaacagtaagcgctgatgattttaggttcattaaaaacaagacagacacgcccccccccacccaaagaaaaatgcttacttttaaagtaagaaaatgacatggtcacacataaaggtagatgaatataggccgggtgcggtggctcacgcctgtaatcccagcactttgggaggccgaggcgggtggatcacgaggtcaagagattgagaccatcctggccaacatggtgaaaccccgtctctactaaaaatacaaaaaattggctgtgcgtggtggcacacacctatggtcccagctactcaggaggctgaggcaggagagtcgcttgaacccaggaggcagaggttgccgtgggctgagatcacgccactgcattccagcctggcaagacagcgaggctccatctcaaaaaaaaaaaaagatagatgaagataaatactcaccatcaggaatagttgcatgttttagggatttttttggtggttatttttattttaaatgttttgttgaatggtttttaccactgcaaagcagtaaagagggcccaggttttgaaatcggacttatgtttgaacttgtcttgaagatataccagtgtatgacctttggcgggttaactctgtgcagctgatctgctcatgaggaagcaggagtggcccaggcttctttgcagggtcactgtcagcgccagacagtaggtgttggcacgatggacagacagcacaacaatgcccttgaattggcagctcctgcttggtggcctttacttgcatctttacgagatggccagtaggatcctgtgtggcttttgaaccctgagcagccagccgtgggcctcccactttagccccagaactgactggactcaccagcccaaacaaccagccagagaagcccaccagtcccttggtcctcacagaaagcaagtttcatacagctcttgagattgatcttctttgttcaagtccttggccctcagtttcctcatcaatacaacaggaaactcaaatgtggtgtaccttatggaatagctagcattgtaggaattttcaaagagtccttgccgtctggtatatatgagcagtttctattcacaaaaaattggcgtggcctttgttttgtggtgtttgggatttttaaaaattattttcctgaaataaccactcaaccactcaacaaagcaatgaccttggagacatatcaggccctgaaaacacaccaaatgcaccctattcatcattggttgaaacatgttttctctgcttcatgttaaaagtacagaactacccagaacaaaaagtgattttctgcttctttgaagagctgtgacttctaacatcagagcgtatgctactcaaactgctggagaggttgaatgctgctccaacaactcttcaaagcaaacacagagatagtgtgtatgtgggagaccaggagagagtcagggaggaagcactgggagatcttagccagtttccaagggactgaatcccagctagctgtaggcatcactaaacagatccagatgtggaaggagtcagcaactcagggtatctgcaagagctcaatagagagcagaggttgcacccctgtggcttttccgatagggagatggatgatagagctggaagctcatgagctaattgaagtagctttcaaatgatgtatttataagctttggaaacacatggtctctttgatatgagtttgtggatgtttttgctgttatttaacactgatttattcggactttttttttacatatttttgcttatgaaaaatcaaatcctataacaaagcttaatatcctcagtgtctttacctggttttctgattatatatatataatcacaataccaaattggtgttttccaaattggtcacaaattttactgaatatatatatatgttttactgaaaatacatattttttatttgtatatttatatataaatttacatatttatattttatttaaaatatgtattttactgaaaaaatatatatattttactgaagtgactaattcgccagctggtattgtgatttttaataggtaccatttttcaggcacctgatgcaccaggcaccatggtagatgctttccatgtatcatcaacaaccttcacaacaaccgtgcaagacaatgttgttgtcccatttaaaagaagagagaaaccgaggctcaaggagtttaagtagcttactcagaggagaaaagggtataagtggaacgggaaccagtcaattcaaacctgggtcaatgacattctttggggaaaaagaaaaataaaaaactagatctttgtcattactgttgttttcattgcttctgctttgtttttaatgtgcctggcatctttctttttcattttaatgactttttaaattctatcacagaatcagactttcctttcttactgctcctttatctttcctatatacactaaacaacaagtaaaaccagggaatggactatgggcaggagtgtttcccaaggtcatgtggcatgataaaagactgaggggcgaatcaggtggaatctactgggaaggtccaagacataaacaatgcaaaggaactaaggccagaggaccaaggatagagtccattgtgtataatcttggtgtgcagacccaagacagggttagacaacagcaagtatgggccagaagagttgtacagaccagcttcgagaaacagtatatgagcatatcaaaatggcttagacttaaaccctcagaagcaaggcaaacaaggtgtgaagggcctttgggtaaacagcaaacaaagtagtgttgtgtggtgtagaattcaccaatagagtaaggtcatgaggggcagtgtccatccatcatttttgcttgctataataaattacacaaatctagtggcttaaatttattctcttacagttcttcaggtcagaaatctaggttggttctactggttcctccgtaaccaaagaaagtgttcacaaggccaaaatcaaaggttttattggaaggttctgggaaaaatctgcttccacactcattcaagtggttgacctaatttagtcccatgcagttgtagggctgaggtccctgtttccatgttaaaggtcagccagtgatccttctcagctttcagaggcctccggcattcctgggcccaccacccctgccaccatcttttttttttttttttttttttatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatcgagtctatcattgttggacatttgggttggttccaagtctttgctattgtgaatagtgccgcaataaacatatgtgtgcatgtgtctttataacagcatgatttatagtcatttgggtatatacccagtaatgggatggctgggtcaaatggtatttctagttctagatccctgaggaatcgccacactgacttccacaatgtttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttggttgagttcattgtagattctggatattagccctttgtcagatgagtaggttgcgaaaattttcacccattttgtaggttgcctgttcagtctgatggtagtttcttttgctgtgcagaagctctttagtttaattagatcccatttgtcaattttggcttttgttgccattgctttttgtgttttagacatgaagtccttgcccatgcctatgtcctgaatggtcatgcctaggttttcttctagggtttttatggttttaggtctaatgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttttaggtatgcggcattatttctgagggctctgttctgttccattggtctatatctctcttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtctttggtagcttgatggggatggcattgaatctgtaaattaccttgggcagtatggccattttcacgatattgattcttcctacccatgagcatgaaatgttcttccatttgtttgtctcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattggataccctttatttccttctcttgcctaattgccctggccagaacttccaacactgtgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctgttgagataatcatgtggtttttgtctttggctctgtttatatgctggattacatttattgatttgcgtatattgaaccagccttgatcccagggatgaagcccacttgatcatggtggataagctttttgatgtgctgctggatttggtttgccagtattgtattgaggatttttgcatcgatgttcatcagggatattggtctaaaattctcttttttttgttgtgtctctgccagggtttggtatcaggatgatgctggcctcataaaatgcgttagggaggattccgtcttttctattgattggaatagtttcagaaggaatggcaccagctcctctttgtacctctggtagaatttggctgtgaatccgtctggtcctggactttttatggttggtaagctattaattattgcctcaatttcagagcctgttattggtctattcagagattcaacttcttcctggtttagtcttgggaaggtgtatgtgtccaggaatttatccatttcttctagattttctagtatatttgcatagaggtgtttatagtattctctgatggtagtttgtatttctgtgggattggtggtgatatcccctttatcattttttattgcgtctatttgattcttctctcatttcttctttattagtcttgctagcagtctatcaattttgttgatcttttcaaaaaaccagctcctggattcactgattttttgaagggttttttgtgtctctatttccttcagttctgctctgatcttagttatttcttgccttctgctagctgttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtacgttgtgtctttgttctcgttggtttcaaagaacatctttatttctgccttcatttcgttatgtacccagtagtcattcaggagcaggttgttcagtttccatgtagctgagcagctttgagtgagattcttaatcctgagttctagtttgattgcactgtggtctgagagatagtttgttataatttctgttcttttacatttgctgaggagagctttacttccaactatgtggtcaattttggaataggtgtggtgcggtgctgaaaaaaatgtatattctgttgatttgggggtggagagttctgtagaagtctattaggtccgcttggtgcagagctgagttcaattcctgggtatccttgttgactttctgtctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtatctctgcacgtgagatgggtctcctgaatacagcacactgatggttcttgactctttatccaatttgccagtctgtgtctttcaattggagaatttagtccatttacatttaaacttaatattgttatgtgtgaatttgatcctgtcattatgatgttagctggtgattttgctcgttagttgatgcagtttcttcctagtctcgatggtctttacattttgacatgattttgcagcggctggtaccgattgttcctttccatctttagtggttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatcagccgttagtctgatgggcttccctttgagggtaacccaacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttgcaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacgtagttctcgagccttggttttcagctccatcggctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagagacgctctgcgttttagattttccagtttttctgttctgttttttccccatgtttgtggttttatctacttttggtctttgatgatggtggtgtacagatgggttttcggtgtggatgtcctttctgtttgttagttttccttctaacagacaggaccctcagctgcaggtctgttggaataccctgccgtgtgaggtgtcagtgtgctcctgctggggggtgcctcccagttaggctgctcgtgggtcagggttcagcgacccacttgaggaggcagtctgcgggttctcagatctccagctgcgtgctgggagaaccactgctctcttcaaagctgtcagacagggacatttaagtctgcagaggttactgctgtctttttgtttgtctgtgccctgcccccagaggtggagcctacagtggcaggcaggcctccttgagctgtggtggactccacccagttcgagcttttgggctgctttgtttacctaagcaagcctgggcaatggcgggcgcccctcccccagccttgctgccgccttgcagtttgatctcagactgctgtgctagcaatcagcgagattctgtgggcgtaggaccctccgagccaggtgtgggatatagtctcgtggttcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggcttgcgcatggtgcttgcacccactggcctgcgcccactgtctgggactccctagtgagatgaacccggtacctcagatggaaatgcggaaatcacccgtcttctgcgttgctcacgctgggagctgtagactggagctgttcctattcggccatcttggctcctcctcctgccaccatcttttaagccagcaatgatgggtcaaatctttctcatgctttgaaccactccgatttctatttctgcttcatctctcctgtcttcctcttctactgtgtcgcttgactgactcctctgcctttctcttctgcttttaagagctcctgtgattactctggatccaaccagagaatccaggataatctccctattttaacgtcatctggctattaaataattctatctgcccagttcctttaaagcagggcctcagttagtgtttaattgaataaccagggtacagaatattgaggggacatatttaggattctgcttaccacattgtggtagcacagtcatctgcatttctcaaatgtggataggatttaggcaatgccaagtgttagcctagattccagacacttactgacacctctaaatatttttggtaagatgtgtccccctttctcttccaagcgggtgattatctcagacttgtcctccaatgtcccttttccctttagaggcttcctataaatctttctctgatcctcctcattgccttgtccatcagctccaccttcattattgactgagcaagcagagcatttctgcctctccattgtgttctggaaagctttcagtgaattcccctgagccttggatacccccatcaagctctgatgaccatagaaaaatctcaggacttgtgaatcccattttcttgtcttttgtaatcttttgagatcccttgggaaactatttttaagccttttttttcttgctaatatgtataaacacttcaattcctttaacaactaggaaggaaaaagtgtaattgctaatacatttattaataatctcaactattttagaacctatgaacctataatttataataccaaggtttagagcagtcatttccacaatttattgtgcattaggactgtggtgaaatgcaaattgctggacccacaccaaaggttcagtaaatctagagtaggatcccaggaaacctacactcgactaggatcccaggaaagagttgagagaggtgccgtagtttagacagctactaagttgcaagatttaaggtgaagtccagggtggacagtaaccatctgtctcttctttttatagtgaatggaagtgtgtaggttgataagtactaaggcttcctcaaggagttcttgcaagagtccccccactctgtgtccctgggcactcaggggcttctccatactcctgcatgcctgtacctttaacattatggtcccagcgctgatgagcaacttctgccctggcttccctacactgaacagtcactagtctccagtgcccctcattaatatcctcagtagtacccacagcatggtgaaggagatacgttactcccatatcccagtaaatgaatgggattgagcctttcatgcaattcgagagaaagagaatgaacacttattaagagaaacggaaagaaaatgaatacttattttacttttgtaagtttactttacgttctgggatacatgtgaagaacgtgcaggtttgttaaataggtatacatgtgccatggtggtttgctgcacctatcaacccgtcatctaggttttcagccccacatacattaggtatttctcctaatgctctccctcccctccaccccaccccaccacaggccccagtgtgtgatgttcccctccctgtgtccatgtgttctcattgttcaactcccacttatgagtgagaacatgtggtgtttggttttctgttcctgttagtttgctgaggatgatggtttccagattcatccatgtccctgcaaaggacatgatctcattctttttttatggctgtgtagtagtccatggtgtatatgtgccacattaagaaaatgaacatttaaatgccacctctttgcacagttggcaccataagagttacaggagtatgtagctcttgtagactcagtacagcttactgaaaaaagtaattcactttgcaaatgatacctcatgtaatcctcacaaaaataatttgaggtattatccctttttttgtggatgaaaaaattgagctcatagatgttacaaaattcatatagtgtcatgcagctaaattagagaaaatgtcaatatttaaacccaggtgccttcctctaaagctcattgtttcaattggcatacaccgctaacctcgaaaatcccaatatttacataagtgctttatattcataatctaggaggttaaaattaggcaatgcagttatttgcattgttttggccattatatatagttttcatgcaccctaatattaattgtaagagctttctcttatagttctcttcattacacaatatccaaaatagataaaatgtgcttacccttgcaactctcacatcgggcttccctacacatttgtctgtctcgcccaaacattcaaaataggcacaggcacatcaataaacacactccttctactcatgcttcctctccacttcctcttgttggaaccattcagcctccagctagggaatcagttcatctggcctatcctagccttttcagccatttcaaagctgtgcctctcccaggacttctttggcactcccagggcactgtcaccacctcccttcgaagacagctccccgagggtcctttgtagcctctcaagcagtcttcatggcactccttgcaaagttccgtcatgggttgactgggctgaggtccctggtatttgagagaaaattaaatggacttaacgatcatctgcatatcagatgagatgtcaaggaaacaaggacctcagaccacagtgtctttgcacttgagagataaatatctttcactaagtcacatttcaataccatggctctagtgttagtggtgagggaatactggaaacggttgtatgagaattgtgtttgtggcttcccttttgatactgaataccttctatattatgatccatgcaagaaatctcttctagaatttcttcccaggaataattttgtctcccttcaaggatagctatgttttatttatcagaaaaaaagctatttcaccctcatgtgtccctttttgccatagctgctagcaagctcaggatttaaatttagtgctcaattacattgattatatcattctcagtttctggggaaaaaaattatcctcccgtttctgctctatgatttctgagctctggaggcactggaaatttagagaagggtccgtgatatctttttgcatgaataccaatgctttttggaaattctcgtggatatctgctggggattaaggaagttaaatccagctatgtcacaccctttcttctctcttatggattcttactaattgagaaggatatcagaacccattacattatcagtattattatacaaagcactggggttcctaataaatattgttaggggaatgcatcttatatacaaagtcatattttacccccactcccaacaaaaatcatccaaatctggtcttcaggagtgggtcagccacacagaggatcatggcttaatcctcttcccattgatgaccagagagaggaagccaaagggaggcagcctcctggacaggctctagaacagtgcactaagccatggcccagcaacttccctaggagacctaatagcagaggtgctgttgaggccaggccagtacaggagagacagagaaaccgtgtgtgaatggtgttcatgactagtgatcattgccaggaccaccgcatgctagcatggtgcaggcagctcgcagaaagtgttcagctcagggatgttcagctcatgactggtgttcatgactagtgatcattgccaggaccactgcatgccagcatggtgcaggcagctcacagaaagtgttccactcagggggctatgaccaggctgaaatcctgcttactctgcacctttttataattcatactcccagatggggtgcctttttcaaactcaagacaaaggctctatatgaggtacagggacccttccttttaccctattctcataaaagccacttctctgatgagaaagggtaagtttagggatggtggagggcaggtggcaacatggagcaagtaactaaaagtgttcttccagtgttcttttctcttggggcatggtctcctcctctctgattgtgtgaggagctgaggcagtaaactttgtccacctgtacttgtagaatttaacaaagaaggataggacataaggagagaaagtggtgtctaaaaggtgaaaagaagcattgaattgtcactggttcatagttcacagtgctgagtgaattgtcactcagcaaatattaactgagtgcttactatgttccaggcacagcactggacattagagctttggtgagtaagacgagcaaagaccatcagaacacctacattctggtgtccattctctgtgttcccttaggcacattatttcctcactgtgaaataaagttccataatgtcagcattgttcatgttctctctgagttccagaattcttaccatatgcttaggtctctgggaaactttgtgaaggatgttctttcacagttaatggcttaggatgattcagcgccagagttcttctcgtgtctctcatttaaattttccatcttcttgtgtattaaaaaatcaaagccatcattctaatctgattgcccaattatttgccaagaaaaactgtcagcaggtagctctactgaatgtaggaatccccgcatcaacagacttagataaataattcagcatagctggagcataggatacagagtgaggagggacaagagtaaacactggagaagaagcaagggcgagcccaggaagaagcacatgagacagtgaacgcatttctactgtgaaatgagggcaatggggagaacgttttacagggagtaacacgatcagatttgcatttaagaacagtcgatctagctctagtatggaaaggagcacaattagaaacagtgagatttgctcagggcctctgtcagcaattaggaaggacataatggtggcttgaattaaggaagtgaatgacagtaaggatcaagaaaaggagatgcattcaaaagagatttgggagatcaaatgtacaaaactttgagactgcttaaatatgggaagacaggggaggtcaagaaagatggcttctggccaggcgcagtggttcacaactgtaatcccagcactttgggaagccaaggcaggtgtatcatatgaggtcaggagtttgagaccagcctggctactaaaaatacaaaaaaattagccagatgtggtggtatacatctgtaattccagctactggggaggctgaggcagcagaactgcttgaacccaggaggtggaggttgcagtgagccaagatcacaccactgcactccagcctgggagacaaagcaagactctgtctcaaaaaaaagagggttcccaagtttcctggtttgggtaactgaatggtgcctgtgcactgtcataagccaattgcagtggggttcagggtgaaatctggagagagtaattaaatggggccagagaatatgaaggaagggacctaggtagaccactcagctcccttattttgatgcaaaccgcatgtccatacctggttgagctcaggacaacacacaccataggaactgagtaaatgaatgttggtgaattaattttataatgtgataatctaaagtgaactatggtgctgatgcccacaaaagttgggctcggcttgaagaacccagcagccctcaccctttagaaatgtcccaagagaacaccttgatgagtgggagacatgaaagcaggactgtgagcaagtcctgatggcatacaaatccggcatcctgttcagttctggactctctcagagattgacatactccatataaacatccgattctgattgactttaatgggatccccttgcaacccacagattctaagttatcccctagtaggtataatatttgtaggagacatattatattaccctggattggacactgaatgctgttacactgaagtctgacagtagcagaactcaaaacaagatcatcttgtactagaatgccactgttagtgttgatttcttgtaagccacagaaaataggtatttgtaagaaaagaaaatgttttaaaataaaaagtatttaattatcgtctaagaaatatcaaacataatcttcctgtggtatttgttttgtttttgtttaaggtcagggtattttctcttggggaggaagggatagtttttcccaggtctggagattaaacaacttaataggcatttcacgttccgctcacaaaaaggggatttgcatatgaacttgtttcggcaagaaaacacatctgaacgtatttcatgggaactatctttatccacggcagcttcttttgaccatcttcttcttttcttcccttcatgcctgcaggtcaccggattgaaactgtctcaggaccttgatgatcttgccattctctacctggccacagttcaagccattgctgtaagatactgtaatgccatttttaaagagacttagagccatcagtatactctaggccactggctccccaagatacagcacatgcttttgtgacagagattcttaattaaaagattgtttgcaaaaaagagattcttgtatgtctggaaggaagtgttgatgaaaggcctcacctgctttaactaataacctcacataacaaaaagctgaaaggagttaaaatctgtgaagattatacttgtcatttatctaatttgtcttctaaatttaattaaatagaagcaagcaaacagatgctatgtatgcttgcattaagaaaagttgttaagaatgtctgatttataaaatacattatattgttcactttgcaaaaggattcatgataggggtcctttaaatagtaagcttccttagaacatgaaagtgtttgtttttagataattagctgcttaagtgaggttaggatgattagggaggaagaggggaatttaaatctgaaatgttaggagtttctacactaaagataaatcaaaaatggaaatgaaatcctaaaagcttaaccattgtctaaagaatcttcttatctagaggtggctatggatgggctacaagagggttctaatcctgaaatcacatccagaaggttgtgtgtgtgcatatattacaaagtgcattttaggagagtagatcatggtgttcggggtctcacagcaggtatgtaaccgaaattaagttaatccagtgaggcttagccacttctgaaaagagaataggaattaacagaaaggaaaaatcagtttatctaattttaattcaaaatttatttttcagtaacacctgttttaagcaaatatgtttaatgctatacgtacatatatgatattcaattattctgtttcttcacacaactgttttcataactttattcctttaaactatatgtatatttattcacaccaccaacagaagtgcttttttaatgctcagatttgtccatgcaccatgtatgtgcaataaagaatggaacctcccagatagtaataatactaatactgaagggatataacttctttaatgcaactacatagaagtatggaatcagtcaacttgattaaacagcccttttagattctacactagttttactatatcttcctgaagcaattttcttattggtcttaatagcttggccaattcagtgaaatcagtcaaatatctttatgcatggaaacttggtcaaaagcacacaattctgacatctgtaaaaatgtaggaaatgaacagtaagatgaaaatagagaaaaaaagtgtgcatcagtagtaaagataattatttagctgtcctgttttataataataatgatgattatgatgataataatgagtgaattaagagggtgttttgtttttgtttttgtttttgtttttgtttttgtttttgttttgagacagagtctcgctctgttgccaggctggagtagagtggagcgatcttggctcactgcaagctccacctcctgggttcaagcgattcttctgcctcagcctcccgagtagcttggactacaggcgcatgccaccatgcccagctgattttttgtatttttagtagagatggggtttcaccatgttggccaggatagtctggatctcctgacctgatgatccacccgtctcggcctcccaaagtgctgggattacaggcatgagccaccgcacctggccgagttaagaggtattttataggccaggcgcggtgactcaacgcctgtaatcccagcactttgggaggccaaagagggcagatcacgaggtcaggagatcgagactatcccggctaacatggtgaaaccctgtctctactaaaaatacaaaaattagccaggcatggtggcgggcacctgtagtcccagctactcaggaggctgaggcaggagaatggcatgaacccgggaggcggagcttgcagtgaactgagatcgcgccactgcactccagcctgggtcacagagcgagactccatctcaaaaaaaaaaaaaaaagagagagattttatatgtgccaagcactgtgctagatacattacacacacctgatttaaccttactacgtagatattataattcctattccacaaactagaaacctaaggctctgtgtgattaattaacttgtgcagggccatatagcttgtggcagaggtgggatttgaacccccagcattctaaaacaaaattagacatgtgaagtacagtcatctgctacataacgttttggttaacgagggacttcctatatgatggtggtcctataagattatgatactgtatgtttactgtaccttttctatgtttagatatgttcagatacacaaatatttaccattgtggtacagttgcctacagtattcagtacaataccatgccgtataagtttgtagcccaggtgcaataggccatactatatatagcctaggtatgtagtaggctataccatctaggtttgtggaagtacactctatgatgtttgcatgacaaaatcacctaacaatgcatttctcacaatgtattcccatggttaaaggacatttgactgtattgaggaacttttattttcagatttgttaatgttattgtataaaagagtcatagaatgaatagcttatattgaaatgaataatcttggaaaatcagagtggtgtgatattcccccttttgagcacatgctaagaggaggacatgaaggatgaggcaaacaggagggaccaaggggcaccatcacatagtggtaatgacagttacctttcgtcagacacgactgtgtgccaggcaccaaagacggtgccttgcctactggtagcttaacactgtaaccctgtaagtaggtgggtttgttctcattttacagacaaggggaggaccatttgccgaggtcaaacagctagagtatggtagttggaatctgaacctttctccatctcactcccaggcttctgctctttccactttaccatgctgcattttcctttgatctgtttgtaaaagctacatgggtgaaataagctttcagatattcctaagaatcgtttttacttaatatatattagaaaatatcattaatttggccaggattgtctcacagaggttcctttcctggtaagagtactgcagcagaagtccagaaatgtataaatgaggttaaacttaatgcgggcaggagaggggaagaaaaaaagccagctacattttctcaagtaccacacacttggaaaatcaatcttgtatttaatgggccgtacatgtattaaaagctatcatatttattctgtccattgtcttaatgacctttataataccatgaaaggaaggcattttaagacagagatttttttcaataagccttttttgtggagtcaagtgaattgtgaggggttcagtctgttttgcaaatgtatctggatgtgctgatcttttaggcaaaaaaatgtgcattttaatgaggtattctgataacagatattttcccataatgttcaacttgggaaaaaaaaatgttgtttcattagccctgaatattgccggagcacttatttgttgtcggtcaactgaaagttaagcaaatttctctctatatatagtcatatctttgggtgctgttttgtaggggtgaaatgaaattaaagaggattgtaatcaagttaacttgggactgtgcaaaaccctccatgaagtaaaattctctcttgatcatgcttaattgaaagacctgtcaaccacccggtttatccatagcctgttcatctatagttttctttgcagaacagacccttaaaaggtactatttgcatttgaagtctcttgatttgcattcggttctgtacattcccagtggaatagcctaattttaatttaaatttctctgtgaaaacattttttccagaaaggtgagcacaaaatcattttcacacaaagccctttggtggggcatttcagtagggtggagtattacacagattggagtctgggacaccgaaagggaaggtcctctaaggaaccgccagactgagtgggaaattccagccgacaataccacatgggggagagacaggctgtctgtcacagcccctctcgagggagtgcctctcattcggatcatttctttccttttcccaggaaatgtgctttgttttattcttgtctcaggcctgctaatcgcaagcccctaggtccctggttttagaaatatcaaagataccagtttttcctgacatttccatacaaattaggagacagcaattctcccattccatacagactgtattgcttagtcaaattatatatctcctaagtggagaaaacaatatgcaggtttcacatttgccttaagattagagatgctattaaagtgcatagcagagtgcctagcatatagttgataaccagaagaactctccttgtatgcacctttcgtgagctggacacttctacaagttttacctttgctgcctacagcagcagacttgtatggtaggtattactagatttcatcaagcctaagaccacatttttaatttttttgcatgttgacatttctgacaatctatagaatttttaactaaatgaatatgatactattattcccatggcaaaaaaaaaaatggcaattgagttatagaaaggttaaggtacaagaaatatgtgaaatgcctaaatgccagcctgggttttttgaattcaaaactcatgctcttagctactacaattcatgccgttagagcagactggggttgcccagaatccacaggcatcaaatgatccatgatggacttcaggcatctgtagacctcctgaaattatttatagtactattttgtatgtgactttttttttctggggaggtcagtaggttttggcatattctcaagggggttcatgaccccccaaaaagcttaacaaagaacatctgggaataatcagccctagttagtatgtaggatctggccttatatggcacaacatgtttgaatttttttaaacacactacatctgtagattgtttatggaggcccaggttttacctaatccatatttttaccagattcatgaatagcttcaacaaaccctcaagacctctgggctagaactgctgtgccttttgctcctgaactgcccctgtccctcatgatttatgccaaaccaattaggatttcatgtcctatggttcccagatcaccctctgaccactcctgtccccaggttcccccatcccctggggtgacagctccccagacagccttgtcaaaggaggctccatttgccctctacccccaacccccctaagacgtgaggtcagggcagcatcctgctgacttccaaaaccctgttccttttttttttttgagatggagtgttgctctattgcccaggctggagtgcaatggtgtgatctcggctcactgcaagctccacctcccaggttcacaccattctcctgcctcagcctcccaagtagcttgcactacaggtgcccgtcaccacgcccagctatttttttgtatttttagtagagatggggtttcaccatattagccaggatggtcccgatctcctgacctcatgatccgcccgccttggcctcccaaagtgctgggattacaggcgtgagccaccgcgcccggcccaaaaccctattccttaccttggctaaactccgattcttcttgccctcagctaaaacacctcctctccctcactacattcctaggtttcaacctgaacaatactgtcacactttcactaaaaaccaagatattggctcatgccttcttcttggtggctgtgccatctgtggagacacattgtcctcccagatccttgactttcttatctcttctgacttctcttccctcctttttagcaattcactcccaggtctacacttaggactgtgacatctccccagattgctcaatctctaaacatttcaaagacttgctacccaccaaaaaatcctcttcctctattttttctggagcccctttctcaaacatcaccatgtggctgcccccttatggccacatcacagttcatctttttgtttttagtccttatcccaaataaattttgattttcgaactctagtttttgaactttcaagtaaattaagatttttcagatgttcaactatcctatctaaaactgaagaattctacattgagattcacttccataactctaaggcaataatggtttttactgagtttaatgaacttagcaagacagacatgaggataatgcatattaggaagatattaatgcacaagaactgagacacaaggctgaattgaaaatatggtgaagccctgaaacaaccagggaatggatttggctcagaagtctccttttagagaaccactacctggtttcaggcaatagcagcggtaattttagcccttagccaccctgaagccttggatctcaccttctttatgcagttagagccctctttccatgattctgctgctggattttttggtgctttttctaaggaaaaagcctttagttcccatttagtaaaggaagactgaccaagataccattgactctgtttcagagtactattgcaatcactgctaatacagggcctgggctatagtagacactcattaaatatctgtttgaatgaactatgttaccattaactgtgttgacattgtcaactgtttttgtcagtgttgtgtaactactgatagaagcaaatggtgtaattaagagggttttggaatcagtcaggcccaacttgaaattcccactctgcgatttaagtaactgtgtgatcatagacaacataatctctgtgagtctcagctttctgagatagtgtatgtagagcttagtacagtgtctagcactgagtagacatttaagaagtgttccctagtgtttacttttgtgactatactgatgctatcttctgcttttcctttcaagttggggactcgcttcattatagaagccatggaggcagcagggcactcaatcagtactcttttcctatgtggaggcctcagcaagaatcccctttttgtgcaaatgcatgcggacattactggtaagtctgggaaagaggagagaaggtcactttttggcttggcagcaaatgggcatggccaagttctgggtgaagtgagaataggaggatatatgcggtatgccagattattagaataatcctgaagtctttatattcacaatggagaaagtgacttctatgacgtctttatatgcatgatggagaaagtgatttctgtgtatatccaaccattgaataatggtgagaaataacacgagagaagttggccaggactagatcttaattcaagcatttacacaacagttttgaatacctcttctgatccacacattgtggagaatattgaagatacgaagatgaataggacatgatccttgctccccaccacccaggaactcacagtctattgaggaagggagacagcaaacaggcatattaaagatagtatggcaaaagcttggcgtgagaaaagtacggggtatcatggaaacatagtggggcaccttgtctggtttgggacctaatggcagctcagggcgtgtggtctggaagaagtgataagaaagctgtcttgaagaaagaatgcagaggctggatgctataggatctgtgggtatgattgcagactgggaatttgagccctaagaccctgagatcctgtgattccttctcagctcatcagaatcagggatcataatagagatgcagggaatcacaaataatgggctgagctctttgtgatatcagcagacagtgggggagaaggatccttagcaagcccctaggacccaaggaaggggccccattggcaggaggctttctgttgtcgcagagagtggcctggacctctgtctctctggacctgataccctcaccccttttactccttgcccctctagtgtctcctggggactggagacccattctctcccaggacccatcactgggtggccaggtaccaccagggcagggcaaggggagggaaagtggggaagggttgtacccatcccatagtcccaactccagcctgataagagcccacttgaccctacctccatttatcattatcctttgctgtccctcatcccctactttcttacctctgacttctggccaggtcaaagtccctgccccattatatcctccatccccctctaagccacacagattcctgcagatgagagccttgtctaacacgatggacgtaactgatctttgcacatcatgagatgaaactaagtaagtcacttattcccagcttagagataagcagactgagacacaagtctgaggacagtaagaaaagcatacagtcagccgggcacggtggctcacgcctgtgatccccacactttgggaggccgaggtgggcggatcacctgaggtcaggagttcgagaccagcctgaccaatatggagaaaccccatctctactaaaaatacaaaaaaaaaaaaattagccaggcgtggtggcgcatgcctgtaatcccagctactggggaggctgaggcaggagaattgcttgaacctgggaggcggaggttgcagtgagccgagattgcgccattgcactccagcctgggcaacaagagcaaaactccatctcaaaaaaaaaaaaaaaaaaaaagcatacagtctaagggcagaactattgggatgtgaagtatagaaagtattaccattaaccaagcacctactatgtgtcagtgtgaatcacgctgtagacacttaatcctcccataccaccaaaggtagaaatcggtgcccccatcttacagacaagcaagttgatgggtgggtaggtgaattaaattggctatctaaagtcaaacagccagtatggggcaggaccaatattgtaactgtggtgtgtcggggcccaccgtccctttgtactgtactgctgacccaggtttcttgacttttctgccaagtttgtaaccagttgatgatgacgccactttcctgagatgtccaaaaccctatagaagtgggccgttcaaagcagaaggaggaaagacataaaaagagcccagattgccttataattgtcctcaggagaaaaaccataacattttatctaaaaatcagctggctagttcagataacattcaagcttaaaatttgatctgtgacattccaatttctagacttctttttttttttttttttttttttttgtattttttggtagagacagggtttcaccatgttggccaggctggtcttgaactcctgacctcaagtgatccacccgccttggcctcccaaagttctgggattacaggcatgagccaccgcacccggccccaatttccagccttctgatagccaaaaaacttcctatctggatgcaagaggaaagatgaaagtcagctttggagaacacagtactctagaaaatgggaaacagggcctcccagagcagaacagctagctgtgagtgaccccggcactgactccgcgctgcagccctggactttgtgaaaatgggtcatcttccaggccctacatccctgggctgactcagaagcacggcggggagtgcagcggcttcacagaaagttctgctttggaaactgttctcctctaggctgttgaatgaaaaggctgttaatcgttatttggattccgattgaaactggaccttttgtctctaactatggaccagttacagttccagacaaagagaccttttatttagcctggaattcctctgcctttggaagcctgtgactgacaagtgatggcaaagtgcatctgcctttgaatgctttgggttctgctaaactcattaatgcatcagataaaatagttcacattccagccaaagctgccctcttcctctccttcacccaggactcagagaaaagaacacatttgcatttgtccctgtaaaaggcacgtacacaagcagccagtatagaggtagtgtcattggtgcctttaaacattgtattgctctagttttcctacaaagacagttagggaggactgtagacctggaacatgattctcagaaatgcatgtgaaaaacacattcgaatttgggagatttttttggagatagtgtggaacagtggaaaaagcagatcagctctgtgactttgggcaagttactttacctctctgagcctcagttccctcttctgaaacaaacaaaccaaaaaacattatcatctccctcatgtagatcactgctgaggaataaatgcttgcgagtttgtgagcatcaaactctgtgcctagtccaagtaggtgatcagtaaatgtcaattctcttattccatctaggaagccccatgccaaaaagaaagaggggcatttgagggaaaaaaaaaagcagcttattattttgaaagtgaatctttgccatgttgagaacagcctgctctgtacaagcagggagagcggggccttgccagcttgggaaatgctgtctacatgaggaggaagaacctccttgtaccctggtcatttggttaactgtggtttcaagaaatacttggtatgtactaagtaattgttaagtttcccccactgacttgggactaaatgttccttcttctaagttttattttttagtactggtagtttcagtaggggtttccctcttctggtcttactcattattttaattatttgttctttcatttattcactcaaaagcattctctgtgcacaccagtgtgccaagccctgaggttggcacagggatgctaagaagaacagtaatgtccagccaagaggttctttataaaacacagaaaaagtgcccttggtcttatgaccaatatccagagtgagtagagtggggacccagaggacaaaatgtgtcggtgtcagtcaggtccaggcagggaacagatacacactccagttaggttaaccggagggaagttgaatagtcagtgtacagagctgtgggcagggtgctggaagcccagacaaccaagaagtaccttgggatactaacagtgtttccacccctgggctcacaagggtgagggtagggagcaggcaatctgagcctggtgggatgtgtgaagagggcagcccagcagaagcttagccaaggatgaaaccagagggcaggggcccacagctgtgatccccactggccagtctcccaggctcagagtaggtggagggaggaagggaagaggtgggattggtcttagaggcaaatggaagcagtggattgatttcaccctgggtaacaggtgtgaggagagacttcagaagtaaggtaaactttaagaataacaactaatgctaatttagtgctttctctaagccaagcaccattttaagagccttattataatagcagttttaattctcacagcaactctatgagataggcggaattttaaccccatttttcagatgagaaagctgaggcacggaaagattaggtatcttgcctaggatcacacagctaagtcagtggggaagccaggattcaaaccctggcagtctgggttcagagcactttgggcagcaacttgagagctgataggggattcaccaggttcactcacatctctggttcgcaaggggaggggcctgtgagtagttcctccctgctcacaactcagggagcttttggcagggtaggaaggcccgggaagtgaatggtgtttggaggcactgtcttcaaaaacgtcccaggtccatagagaaggcttgatggtcatagtcgcacacccatctgtatcattcctaggattcttcaacggcttgcagtgctctctcctgctggtgtcagcacagccctgtagtgtggcctggcatctgtccttcccctctggatggttgatgggaacctttattgtcccttccccacttatccagtttttagtccaggtctagtacatgcatagaggcttcacttgccatctacctgaattctaacagtagcagccatcatttctccagggcttactgtaggccaggaaatatgctaagcaccaagtgtgtgccctctcattaagcctcacaacacacctgtgtggtacatcttatcatcatccccattttacatttgggatgatccccatttgcatttgggaaccaaggcttaaagagtgtaagtgacttactggacacagagctagtggaaccaggaaataaactcaggtctgagcttctcccagcattcccaccccacctgacaccatgttggcaatgtcttaagtcctggcccagttgagagctggtattcctaaattctctggggtgtctgtgggaatttactcccctgccctttttctctgggtagctggaggaaagaattgagtggggaagtaatgggatgtagagagagtgtcttctcagacaagataggaaaagaaatctaggctttgggaaaataactcttatggcttgagtagaagacagtttttacaccacaagtttacctctgtaaagtttgctgccatctcccgattagcagactaatctatacattatagacctaagaatcctaaattatttctgttaatcttaaacctaccatgaaccctcaacctctgggcattggcatatggagggctcctccctgcctggtggactcctgctcacccttcagatgcctgtttaagcctcatctccaccgtaatctgtgatgaccgctaccccagaaatgtaagtgactcatcattcagtcacttaccatgtgctagatactggtctaaatgccagggattccgcagtagtcaaaacagagtccctaccctcaagtagcttaagtttttggaggggagacagacattaaacaagataagtaagtaaaatacaatgttggaaggtgggatgaagcagttaagggggtaaggagtgttgagggaagttgtaattttaaatctgatggccagggaaagctcagtaggaaggtgatgtttgcggaaacacttgaaggatgggccggcaattagcatgtgggcatctaggaggaagtgttccagacagggaacagcatgggtaagggccccgaggcacactcaggaagcagcaaggaggccaggactacgtggctggaaggagaagaggaggatatcagagagggagaagtggggccagatctgggagggagagccccttgtcagccactgtaagggctgtggcatgcaccctgagagaggggagaagcccctggagggatgaatcacaccctctcttgctatctcctttcccttagcacatctcagttagagaaccaaccccctccgtagccttcatctctctcatccatttccctctgaaacctgaatagcagggcacagtccgattcatctcagtattccctcggccagcagagcgcttaataaacatcagtggatctgaacttgaatcaaatggcaggtagcagcttgcagaagcctgaaaaacctgggcactgaggtctcgtgagttgatatatatggtgttggttcccttgggctcttggctactgcaccagcaggcacaggcagtgaaatcttttagaaccaaataatcccaaggaataaagaagggaggactgcagggagtcgggcggggggcctgctgctgccctgatgtcaggtgtttttgccactgcggctgcttgttggctcctcacactcccctggctctgctccctaaccaaggtgtggccttgtcctgcgcaggcatgcctgtggtcctgtcgcaagaggtggagtccgttcttgtgggtgctgctgttctgggtgcctgtgcctcaggggatttcgcttctgtacaggtatgtgaagaccagggggtgggctgtggctcctcccctgtctgaggccatccttcctcttgacagcagctcgcattttacaaaatacacacaggatataattaagaaatgataggttccagccagggaaagcacaaacacttctagcctcagacatatttattgcagttttcatttgacttggcctcggttcgtgttggtcgttctgtttttcagttgttttttttctttcttctttaaaataccttttaaattattccttttaaatttccccttgaccacttttctttgagcacatgaaacaggtaaggctcaaaacttcagtgtttcatgtgtatttcagatttttatttgcttatgtcaacctcaccattttctaaataccttgaaggcctctatcaacaagagacacaaatgaaactgtcagtatgaaataaaaaaggaattaaaagggaaaataaggaacaaagatataggaagaaggaaacaatttggtggctgtgattaaacacataatttggctcagagcttcctggcaggcaagacaaaaaagaacacatgataaattgcataattcttactttcaaaaagaggaaacatactagtttctggtgagagggaaaacttttcctcccaccaaattgcgaaagaccttgcacacatggggctttgtggagaggttttgagtgctaaaataatacaaggtaaacaatgaatgtggtatggaagctaagagcatacaggctctggcattagaccacctgggctcaaatcctagcttgattacctaccagctcttgtggcctaaacagtcttctctgtacttccactcctttatctgtaatagtaattgacagcgcatcgtgagttctgtgtgtcaagcatgctcatttagtccctgcaatagctctattatccccattttatagttgaggaacctgaggcataaagaagttaaataacttggcctaaatgaaacagctagtaaatgccagaatcaagaagtctggctcccacttctcaactgaacgttcaagagatatttgttcagcaaagcagcagagtccaaatgacttgcccatggtctcaagcttaggactacaagccaggtatctagtagctcagtaattagagctttgtttattgtgaacctcttatgttccagacactatgctaggtgctttttgtataatcttcctaatacctataacaatgcttcatgagccacagagattgggccatagagatccaaaatttaagggtacactattgggaacagacagatgtaaaagtgtgatgctgtttgtactgcattttggaaaatgtggtacactacacactatccaagcctctgaaactaatgactgtgaaatctccctcacaaggaattaaatccactcatgaattcttgtggattctgagtgagtctttaaacaaaggtggtatagttcagttctcgactttttctggatagtctcgtcctttctcaaaaatagcacatggagatatttgttgttgaaatatcaatgaattgtcaattattattttagtgtatcagctgacggagatgttctcacaattaaatatcttgcccttcctgcggcaaattataatagttaaaacaggggggatgcttactaaggttctgcagaggttaccctgtgttgtgaactgaatatttgtattcctgcaaaatttgccctgaccctcaatgtgatggtatatggaggtgggtctttgggagctaattagggttagatgaaatcatgagggcaggagcctagtctgatgggttatgatggtctgatgggcccttatacaaagacaccagagagctggcttgttctctctgccatgtgaggacacagcaagaagtccatttctataggccaaaagagggctcccacgagaccctgacattgctggcaccctgatctcagactttgagcctccagaactgtgagaacatagatttctgttgtttacccagtctatggcattttgttatagtagcctgagataagacacctcatttaatcttgacagtcatcctgcttgcaggatgcgtgtttttatccttctgtgataggaagccaagcttcagagatgttttaagtaatttgtccaaggctacacagaaagggcagaagcagaattgaaatgaaggtctctctgggtctatatcttatcctgtcattctttttctaatttgttcgatttgttttttctttaaaaatattttctggcttcttaagtgttcagtggtgtattttctgaaaagaaatgccataggtcacaaatcaggagatagtctgtagctcaaacagagaatagcctttcaagatgaggctgctatactagatacatcataccatgactcatggcttcattgatatcttattcaaaactgggatctccagctccaaaggaattccactcacatcttcccctaatgggaaactgagcttaattccacactgacatcttgactacatgagatttgctgttagtcttctgtaacagaatctaagatatagtagatcagatttggaactgatgacttgagtagcagctgcaaggctcacagcattgtaaagacaagctcatgtctcctattcaacccaaggatgtgtgtgcctgtcctgatcgttttcaggagacacaatctagtaaagggagccaccagctgagagagtcctgaggtcttatctgtcatcacttacctgacagactccccatagtctggagctctgtgcttgctttactgtcctcagacgatgtcacttgttctctctgggtgcttgttttatttgtctgttttatgtattttttttaatgtttaaataagaattgccacccatatgggactatcgagataaagagcctttgaaagttccagtgacctctcaggtgtaatcaatatcattagaatgataaaatatttggaactgctttggaaatgaaaatgcatgtagacttggcgtcatttgctcccctccaaagaagaggggccaacctttgtgccccaggtctgaggaccagcttcagattctggcaaggtgaggcaaaattgaattgctttctttctgtgattcatattttcaacctgaacttcaacacagtcttttctttgaacttcagggaccctggcttggtttgcagggtacctgccttcccctccttaagaaagttgagcaattcctgccagcacctcaactattccagcaagtcagatgttttatcttctcatggaccacacatctggtggttagatggaggatttcacttcttatctagataggccaattttggtagactcaaccagagtcacctccttcagatgctgggaaggctgggaagaatccagaggacccagacagtagaggtaggaaaaacttttatgtgcttgaggagacagggttttcataggcccctgaatggatgattttcagccgggggtagagtcctatacctttcttgggtgataccaatggatccacagctgtagattttacttgtagcttttgtagactctgtgtatctcaattctgggagaattttatcaggggaagggagactggatggaatattctggtgggcccttaatgaaagattggccaacaacaagatctattgatattgcaaattttgaaacatgctgacaattcctagcttccttcttttgttcttttatccattcagattctccttctcttagtttgtctctgtctctcttcccttgtcctttcctgctctctctctccctttagacatctaaagtcttcttactatttctttgtcaaattcggatctcacaaaggatactgacatagccattcgttcattctaaagaatacaatgactaatactatcttaaagagttgcccctctttagaaagggtgttttccttttagtagttttcaaaactgtgtctttactaaagagaacagtctccttgtggacaagtattcttgaaggcaaatcatgatcagctttatatctgcggtttaatgaaaaatatggaatcaagccacagatatgctgctctcacagtaaaaatttagctattgaataagtgggaggggacacaaagaaggcagttcacttcccctccctttactcttaggaatgtggaatccctgcagtcttgacctctgtgacctttctacttgatccctcccccatcatcagtagagtacaaaatgatcctctgtaattctgaatatcttggaaaacaaataattataattagaagctgagagtgttccataacacttctctaggctcccaggtcctggaaaatcaataaactggaaaaaaactaagtttatgaaatatcactatgcttacactttctaagcacagacagttaaaagattctaagaaatacaaggacaaataaataaaacaagaagcagtttcaagtcgttgtgagagaaaactcaatcaaatggcaaagagacagcaacatgaaatggctctccactttctgtttccttcaggccccctgcagatgtcattagctttctgtaatttcttatcttcaggggcagtttttattcaagtctatttagacaaaacaagctttaattccagcagtgctatttgtcttgaaccaccaccccccacccttgaaaaaaaggagtggaggaagcatctgaagcaaaaatcagtaaaaggagacagtgacaagagatcaaaatgcattcagcagtcattttaaggggagtaccagtgtaaagaaaataagcccttggaatcagccaattaatcacagaccttccttcctcccactgtgtgagtgttgccacccctgtaaaccactgactccatgcactctcaccatcaactttccctgtcacgttccagacagactcctgtgtcttcaagaccaatacatgtaagtggccagttgagagctgtgattactcaccctttctgtaatgtgtgcccacaagataaaccatccatgctgaccgcagtggtctacccttgaggtcattccttgcaaacatcctcattgcttagctgaaacctctacttctgttctttttcatgaaattcacttcatttagggccagttatactcatcacctgttatgcatttcagagcctatgatttttgtatataacatgtctcccattctattttattttgtaagagtcaactttctgtgatttttttttttagctctatttggctttctgtcacgataaataacagttttgctatttgcaaaataaagctgattatcattattttagtttccagaggttagaaaaaactgaaataccgtagatgttcagaagtatgaaaccatcccatttctcggtgcattcaatttagtttacttgcatttttttctttgtctggaatactaacatttcatgttcattggggacaaaaataagaaaatttaattaagatgagtgaaaatatgaaaacattgatcttgttatcctaaaataacctattttaaattatttacttattaactatttaatattatggtttctattctcttagtctttttgtacatattttaaaatcattttatacttttaaattacaaaatgtattatacaatgcataaagttttatctttttagacctttttcctatactcaaaaatatgtagtaaacttctttatttatcatttttgtaggctgcataattttctacctaatagaatatattatagcttatttcaccagtcctccagacttgaatatttaggttttctccattgttttaaagaatgctgcaactgacatctctgttactaaatgtttgcacacatcctaaattatctctataaaataaaattagaggcatataattgttcaggcaaaaagtgtgcccagcatttagggttctgatacatagtaataatttatactcccatcagtagtgtctgaaaactcagggtttacatttcttgtatataaggaatctcttgccatggattttagttccattttagttctatttagctttcatccccaggcctcttataatcctacttatttcacatatggtcctgatattatcagcttttttttttagtagccttttgccctttgctgcttaagcatgtgtttctggatgagattctgattcctaattaaatagattcagattactgattgaattttctgagtatcctgtcccatatgtcagtgtccctcagaaagtcaacagaaaactttggaatggtataataattaataattgaaagaagaattcaattaagaatatgaagttggccctaacattcattattcttattgccacacctggttaacaatacattctttttttttttttttaagagttttttcgacccctccagaaaaaaaaaaaaaatagaataaaacaaaaatagatcaggttctgattaattataaaacctctggtttcaatccagtttgcagaatgataccatgggtataaaagtcaaaacattagctgaaaattgtaattttttaaggaaattatttcaatataagatacacatcatttgactctcttgttccttacagagtgatccaagaacaggacctgttactttccatccattgtcatttcatagaccccttgaagcaacccagtggttggtagcagcaatctttgtgcagatgaggactctgaagctcagaaatgttgtataacttgtttaatacaaagcccacgctctttgtattccatcagaccatatcctgtagatacatatacattgctagggaagtacactatggcaactgagacacctctcacaaggtggtatcgtttataaaaaatagcattatgtatttgtcatcattgcttggttgagtgtccaacacagaaataaaaataagcagggtgccctctttggcatggaaatattctaattcatttccccagagaatgaccatactcaccagtattattttgctctacttgtttgcttttaatcataatatatgcctgtttactttttgtagctataaaaaggtagataaaagaagcactttaggtagatataaaaagcactttaattaagaacatgaattaaaagatacttcaataatgaagtacaatagattaaggaatactttaatagattaaaataacttgaattaaaagatacttaaatgctattgttattaacacaaaggtttaggctaacaaaacgcattttcccaaatatctctctcacctccccccacaatttttattcaggaatgtaagaattgggcttttataaaagcaaccaagggctaaacatctactaagttcttagaaactttgaaggattacagaactctctttctataataaggtttacctgtttgacttgattttgttcaagatggcatttcatactggtgtaaacctaaacaaaaatgtgtaagatttatctcatagaaagacgtgcctgtaagtaattaattcctcactctaattactatttatgcctttactttttattgtaaacattcttgttggaataaactagaaataggttttttttctttacactaaaataactcatgaatagcaatgaaatccatgctgtataatattcaaatgagagatcaggaaagacaaggcttttagttaaatcagtaatattctgtgatggggaaaattgccttgaaaaatacacacacacacacacacacatgcacacacacacacacatacatactactagaaaaagtttgaggttcgattcagagtgtggaaggtacagtgtcttaaaagagtttcagttgcagcatttaggcagatgatcaagaatatgcagaagaaaacaaaagaaatcataattatagtttcctaacagaggtatttgatcctctgcagtgaaccataaaaaactagcgtgggatcagaatcttgagtagcatgtatttaattgtatgcatttcaaagaaatttgaacattttaaaaagttacaccatatgaaaaattgtatataaagacattttctataatattataataattttacaaatgaggaaacagggttagagagagtaagtgagttaccaaagccaatggctagaaagtgagagaggcagaatccaagtactagcctgggattcccaaaccaaagactgttcagctcagccacaagtggaaatggattcttatggggctaagtgattaccattactttaaaaactagtatcagaaatagatgacaagaatttaaatgtatatcaaaatatccctttggtaaatgttagtgtcctcacaggtaaacagagggcaccctcaaatttgagtaatttgagagggtttaaaagagggactgtttacaaaattgcagtcatagagacatagagaaatcacagggagaatgtgaccctcgggtttgtaacagctgggcctgtagaggcgagggaaaagtgcagttactggatgcccagaacagagggctgtgtggagactgcacagtgaccctggaagaaaagggctgcactgttaaccctattctccctctctctaatctcctgcctgcctcaccattggctggaatcagaatcagagagcaagggaacctgttgatgtattctgtagaaggccacatctctaagctcagaggagggtgggaaggaatcttcagaagcacttggagacattcaactgagtcacccaccctggactattcagagcggtctgcagactagagggcagtctctaaatggtttgttcagatttgctatgaaacaaggaacttgcatcagaatgtaaatcaattatgtcaccaagtgtactgtttagttcagctgtcattttattcatagcaagatgttctcaatgaaggaaccggtgtgctggcttacatcctggggccaactcctttcaccacagatgggccctttgaatagcactaaactagattccttgctctgtaggtaatgataaaaacgctggaatccctttccttgttttgattttcctaccttaacttctgctaaagagaagaataacgagtatttttctgtacctaccctgagcctggcactgtgctaaggtactttagatgacatttaattcttgcaagttagattattcacttcatctttacagacaagaaacagggccagaaagtttaagtaatgtgcctgtggtctagcaagtgagagagccagcactcaaattcagatcttactccaaagtccatgcccctcactgtttgtaggctatcccaggactgtgcttaaaattatctgacattaacaccaagaaataaagcagggttgttgggggattgccttatatggagacctatgactatgttctgtatacatatgctatgcatgattcctgggaatagataaaacccagctccccccaaatcagatggcactgtttgtgaatacgatgttactccacgttacaaggccttgtccagcccagccagccaggtcagagatgaattcagtttgtttctaagtggctgttgtctgttgccatctctttttaaacctgggaggtcaggaagaagatagggagaaagaattcatgagagggatgcatttccttagaaatgttattaattggctgggcaaaacaagagaaggaaataaaatagctgctccttactaagtaaaggcatcttcttcccttatctcattaaaaattaaaagcactcttggtttaagtagggcaaattagtaattaagtgctatataatgaacttgtataaacagaatattgaaggggaagccaaattaatcactctgctggcttgtttttgcccccattaatgcaccttttactcaggtccttcctgtgataccaggatgcattttctgctctcctctgctgctggagattgggtgggctgtgatagttgggctgacagatgacagtggactagatctggaaaagtcatgtgtaggggcctcgatggccatttcattttttaagccaaggctcatcagcacaagcctgcatgtgacgggaacagccttagacagtagcagggcaaggaagaattagacacaatgtcggtacccaaggaattcccagtctactggtggcgggaggttgggcacagatggatacagttatgaaaaagtctaaggtgtaatggcaaagactatttccttggactcaaatcttggctcagccacttaccttgggtgagttacttagtttctctgtgtctcagaggcctcacctgtgaaagattccattgcaattactctgcaatggaatgatggagcatttgaggagtgacttccactgtcttaagagggctgggaaagtcttccagaagaggcaacctttggctggtgacggagctagaactcagggtaccgtgggaccccccaggcctatgctcctcatctttgcagcatagtgcctcctctgaaagcggaagaaggagcttgggcctcaacccaggacaaatctctctccatttcagctcaacatagtaaatattagtaataacatctggatcctcagtctcatgatatgttagcaactacctgccaagtatgtggggtgaggagtagaaagagtaagtgagctgagtccatcacaggctgggtaagatgaaatcaaatggagcagcagaaagtagccctctaagtcaccttgctgaacctcacggtgatgccatctcctcggcttgctagctgtgtgaacacacctggctgggcaagctacttaatttctctgatctcagttccatattaactgaccccattgagtttctgcaaagattctgtgaatgaaagcacatttagcacaatgcctattcagcagaaaagtactattatcattccctgtgttcatttgatcttcaccacaaccctatgaggtaggtggcatcattgtgccactctattaagcaagaaattgaggcaccaagctattgaaaatctcgcctaaggtcatctagatggttagtggcagaacgatggtttaaactcaagtggtctggctccagccctgccctctgcgtatcccccacagccctgtgctttggagggcacctatagctaggtttgcatgtcacatgctagaaatagggtagacgcttctcaaggatgtccggacctctctctcactactgaggaagaagttatttccttctgcttgagggaatggtggggcagagcctacagctgtggtgaccctttgacaggtggggcaggtagagcaggcacaagtgactcaccagggagcattagccctaggatgcagtaggaatgcagctgctgcactgatcttggcagttttgattagtgaacagaataatttatttgtcattcatactctgcttccataaaggatttaagaaagcttacaataagtgactaaatagttactggaataaaactcataagttagaaatgatgtaaaaagaggaaaatacacatatatatacatataaacatgggaagataccagcaaaggacaaggtgatttgattctgtatcaggtaggagaaaagtactagaaaagtattagtattaatatttgtattcaaagtactgccaaagaatgttgaaaatcagattgttttaattctggattggtgagtgccacaccaaatatctatgggacagatctggcttatctatgggtctctgatctggactaggcagttattattatttttttttaaatgaggtctcgctctattgcccaggctggagcgcagtgacataatcatggctcactgcagcctcaaacacctgttcaagcaatcccctagggggttactttgactgaacttcaggcaaccaaggcaaaactgggaaaagtgtcaagtcatatggagtcaaagaattataccaattctttgaaagagaccacatttttccttataccaaattctaaaatcattatttctttaaaaatgaacttagaaatccttccatggaactcttatagaagaaggcagaattcattatataccaccttgctgagagcccagatcataacattgaaacctgacttcgggtctaggataggctgggtttatagctttttggagatgtcacttgactcagtgatagaaccaagaatacccagtttggtagagagatagcatgtcccttcacctttttccatgaatattccttcccttggccagctttgcaaacaaagctgtgttactgacctaggagtgtctcatagtacctcagtactaaagctttttacaagcctggcatcagagaagtgctaaaatgaagcacccgtcaatcgagaagggcaacagatgttgaagcatatcaaatatcagtaaacagcaagccacagagactgctgaacttggcatcctcatagcaaaaataccctgttgcctttaagagagaacgctgtggacttttataaaccacattaagtgatgtatttttttctccatttggacaattgctaccctatgaaatattttccctgaaagatggtctgctatcctctattatttttttttaatctctacttttttaagggcaaacttaatgctcacagagtgttctaggctctcagccctggaaatataggtctccagaaattgagaggagtttcatattcagcttatctagtaccctctcttttactattagccgtatgattcatattataagtaataaatcgagctgtatttcaatcctgtagctgtgcactagattagtccctttacctctctaagcctgcttactcatttgtataaaaataagactattaagaacacatacctcatgcaattgttgtgaaaattaaatgagatgatatgcaagaagtatttggcacagttgctagtatgaataaactctcaatgagaggtatacaaaattatagcaatatttatgatgatatctatcattactattagctgactataagtcacatgctgtattaatgctttacatatattactgaaaggtggctgggctggtcctttgcctgtttgctctcagagagtgctccttcccctgctctgctgtgtgttacacttcctaggctctcttgcacctggcctctgagcaggcttggccattgggaggtaatggtgggagaatgactgatgtgcaggcagaagtcaggtcatttctccccttcactacagcagcagctgcattttctgtctgattccagctcccagcctctctcagatcccagttctggccactcagcttttctttggtttccgttctatactgacattccctgttcctggctctagtcacaccactgcctcctgtcatcccttgattcctaagaggggtagcatctgtctgctgtcggtaacctctgtgtggcttcaacaacctgttgggcttctaggtctcttctgtcactaatgaaactaatttcttttttttttttgagacacagtctcactctgtcgcccaggctggagtgcagtggcacaatctcggctcactgcaagctctgcctcctgggttcacgccattctcctgcctcagcctcccgagtagctgggactacaggtacccaccaccacacctggctattttttttttttttttaagtagagatggtgtttcaccgtgttagccaggatgacctcgatctcctgacctcgtgatccacccacctcggcctcctaaagtgctgggattacaggcgtgagccaccacgtctggctgaaactaatttcttatatttaattcctcctgttcaaagacctagagtaggtctttgggctacctagctaacttgactggtagtccagctacctgactggactctgactgatatcattgcttttaactactaaaagaaaaggtagtccttatagagaattcacttctcctcctctccctgttggagtgagccaagccaactggagaagggatggctggttatcatggagagacgttcacttggactaaagctcaaaagacaataaattgacctaagcatctttgatgaatactgcctatacacccagctgagtttggcattgaggccaggagcctcaggtagcttaccccctctctgaggagacaagattcaagtacaagtcatagccaagcacactacaagatagtgtctagtcagaaggaataggaactcctctttcttgagccagagccctggaccattcactattctaggtaagtaactataatagatatgtgattattctcacatgaaaaatgaggaaatggaggctcagagagggcaagtgatttacccaaagtcacactgcaattaagtagtggtcttagcagcttaagtctgtatgtcctagaacctgtttatgggacttatatctgttcctcaaagttttctaatctttttgtcagtttcaaagcagatagtaagaaaactacatacataattcatattgccctggtcttgtagaaatgaccttacagaaacaatattcagccttattcacctaattctcagaacaggtttatgtggaaagtttattgtgttcattttttacagatgacaaagcagaatcaaaaaagtaaaggaatttacccaagttcataccgaacgttcatattcaacctggaatttgaatgcaggtttttctctccccaagcatatgctctttccacttggggacgtccaagaactggaccatatgtagtataagaccaagtgttttttagaattttttttttttttttgagatggagtctcactctgtcgcctaggctggagtgcagtggcgcaatcttggctcactgcaacctccacctccctggttcaagtgattctcctacctcagcctcccaagtagctgggattacaggcacctgccaccacacctggctgatttttgtatttttagtagagacaggatttcaccatattggccaggctggtctcgaactcctgacctcaggtgatctgcccacctcggcctcccaaagtgctgggatgataggcgtgagccacctcgtctggcctagacatttttttaaaaggttggggagaaaggccaggtaccctatcttccaggaacagacagttgggttagagaagtatatataaagtgacctgaaaccagagagtgctgttgcataatctactctctggtagtgactaccagcaggaaagagtagcctggctttgtgtaagaaatggggcttgaaatgggctggagtggaaacattaatttaggacaggcagagaagcagcaggaagagggatttttagataaaggtgctggtgagagcaaagaaacagatacagacagaacggagatcaacgttaactcctgggaagggtcccagttcaggagtagtgaaaaagaaagttggatagataggaccacagttgattacaggtaggggttgttaaccacaaacagatcaattaggaatttgatcagcagtcttgggagtactttttgctcagtattcccttatcctttaactgtcttttaaaaaaatgttgcaagctgatagtctcactttaaaaaaaaaaacgttaagtccttcttagataatactgctttctgcttaagaaaaatagcttttaaattagttcagcctgtgagtaataataaaagtttattacttatctctcacagttttgaagagtctctaaaatagaagggaatactctttaaatgcccctaaagtgctatcctctttcactacagttcatttgtgtatagggtgttataaaatcacacatttgagaatttcaggatggagaaagcaccttctgaagcaatgtcattgagagatggggagcaagccactttctaccagctcaaaatctactccctcctccctccccaacccctccctgacacctgggcctagaggagcctgtgtgttggatagagttgacggcagtgaaattcctaccaagttggccctttcagtttcacctgtcagtgtctctgatgaagagggatcttgacaaaccagactggtttggataattggactacagcagttgtcttcatctcagtaaactgactaaccactacagaggctggaggagaaatttatagaaaatcctaaaatggaaattgaagcaagtgtttcaatgactaggaaacaacaggctttagtgaggttccaacatattatagtatggtggggtgctgggactcctgtcttcaaggggcccctaaaagtgatagaggggattcatttagtatgccccagctgccatttaagcactttgtggttattggctcacttagtcctcacaacggtcccatgagatcctgatattagttgtactttgcacacaaggaacctgaatcaccaagaggccacgcgctttcccaagcttacatagctggtaaaaggtgaagctcagatacaaacccagattttctgactctgtggtctgttcactgtaaatactgaaacccatctctataaagctcctttgggaaactcatcttggtgaggcccacctctacacggccctacccccatgtgcccatctcttgcaccgcccttagatgttgccatgtttgctgatctcactcaagtgtgagcttccatataagggtccaagtcttactgatccttagccagtagtcagtgctggatacatgtatgctgtaccagactggaggtgaagttttacagagactttgtaatcttcctgaagctggctaagaaggcagccacctgtgactagttacacagaaacccagccacttaaagcagtggcactgctggggatggacttagatttaaagtcgctagcaggtaaaatctgacctatgtctccagaaacaactttacttgtgcacattagctgtgactgtaaactgctgcttaacggttctcacttgctctaatttttcaaagactgactccccagtcattagagtctgttctgttactagtaactcagtggatgatctggaacaagaggtctacctctttgggccacagtttcctcatctttaaactgaaagaatcagattctggttttcaaaaatgtaaagcagtggaacctttgggaggccaatacagaaaacagaaggtgaactgtgtctctggcttatccatcacaccctctttccccactgcctggcagccttggagggtctttgctgaacataagcactggactagatctttccaaaggaaataactgaaaatattataatgtttaataatgatacttaataattcaataataaagtaacttcaaaatagcctagcctaccttgagaaaagcaggttggagggccctcaccatggggtcactgtgcctgtctgtgttactgtcaaacattgtgtgttccaggcacggaggggtgtcagctcagcctgataatgtacagtggattggggaagctaaagcctctgggcctcattctccttggctgaaaacagactgcgtgtcatggcactggtgaattagaaattctatccagccactcttggagattgattttccgtctggggatctgacctcttgcttcactagcagaggggatcagactgttctgggaggagtcaacgagctggccctcagaaaagccttctctttcttttttgttctttttttttcttttcttttttttttttttttaactgtatgtttcaaagggaaagtctgattactttggggacttaacactaccagtttgaattcttcttggtacttacagccttaagatatccatacacccccacatccgtcctttgtgctagaagattactgaagatttaattccatttatgtcattggatttgtaaaaaaccccttttggattcaaagatgaaggcctcacttactttatttttgtcattttcacagaccccttatgtaaatgcctcaagagtaagaatcttgctcaagtgatttttgtatctccaatggctaacaaggagcctgacatagagtagctgcttggtaaatatgtgttcattcattcaacaaatacccccaaggtacaacgataagaaaaataactatagtcctaatactgatcacctctgcagttgactggaagagacagttaaaaagataagtacaaataaatgtatcttgggttaagtgctataaaggaaaagaacaggttcaatggaaggaaaaattagaattgttgatacatgaatggaagtaaatgacccggacttccaactctaaatctctgtctcatttcacctctttgtaaataatcattgctattatgttaaatatcacaactactgtcatttcttgtttacccactacattctaagcttggtgctgacatctttgtatttattatataaaattctcaaaattactctgcccgttaggctttcttatcacttattccaaatgcaaaaataaggtccagggaagataattatgtaacttgttcatgattggagagctaataagtgtcagagatgaattgaaccaaagttggtgtgacaaagcctctgttttaagcaaaagggaaaaaaaattctcattaactccaaggattatcatcaggagtccaacagggttcccaatttgggaactactatatcattatcatatggcaaatggtccactatgttagatgagaggacaaaaaaaaaaaaaaaagttgggggagaaactttgctgtagagtgggagggaaaaagaggaagatagtcttcttgcatgggccgtcttatcagcctagcaataataaactatcaccatagcaacaggaagtctaattgatggcagatgttgagccactttaaaagccacgccaactgaatgccaagctgatgctgtaaacctctctcctctcccgcggctagactaatcatgctatggtcatattggagagacccatctttcaagggtggaagaaactctggacttggcatcagaagacttgagtctgagcctcacatctgcccgtgctgagctctgttgccttgagcaagtcagttcatcaaaagtagaagatagttatcattaattttatcatcattattactaccagtagtaggaactctctgaaattcaatttcacaatctaaaagatagataatatttgtgtaagcatcgtcagaaggtttaaatggaataaaagatgtggaagtgcttagtaaactataaagtaattcacaaatacaaaatattaacaccaagagacagcttgacgtgctagaaagagtttgcattggcatcagacagatatggctgcttacagactgcttcatctgaacgcatcacttacatgctcagcctcagttttctatcagtaaaatttcttagtgtaaatctgtaaaatgttctacccatgttacaaacctgtggcttaattaacctctctacacttcagttactcctctgtaaaatggaggtggcactggcacctccctcataaggtcgttgtgatgattaagtaagttaatacaggaagaacatttagaacagtgcctggcacaggcagcgtgtcatacatattaatggtggtaatggtagtggtggtggagaagaagaagaggaaggagaagaggaggaagaaagagcaattgaaatcatatacgtgcatagaactgtgaaagctggtggtaatggtagtggtggtggagaaggagaagaggaaggagaagaagaggaaggaagaggaggaggaagagcagttgaagtcatatacgtgcacagaactgggaaagctggccaggctcggtggctcacacctgtaatcccagcactttgagaggctgaggccagtgaatcccttgagcctaggagtttgagaccagcctgggcaacatggtgaaaacctgtcactacaaaaaatacaaaaattagctggatgtggtggtgtatgcctatagtctcagctactcgggaggctgaggtgggaggattgcttgaacctgggaggcagaagttgcagtgagccaatgttacgccactgcactccagcctgggcaacagagtgagaccctgtctcaaaaaaagtaaatggccgggcgcggtggctcacgcctgtaatcccagcactttgggaggctgaggagggcggattacaaggtcaggagatcgagaccacggtgaaatcccatctctactaaaaatacaaaaaattagctgggcacagtggcgggcgcctgtcgtcccagctactcgggaggctgaggcaggagaatggcgtgaacccgggaggaggagcttgcagtgagttgagatcacgccactgcactccagcctgggcgacaaagcaagactccgtcttaaataaataaataaataaataaataaataaataaataaataaataaaatactgaaagctccatgtgatacaagtgaggacctccatagtcaatgtcaaaatacttttggtcagttcgtggactggttcacatgtcttatcagttttctcaaagtttccattgtctacatagccttttttgtcatgcccagtatgcatgcctgctctgatccttggctatgaagttttcaatgggaaagggacaaccaggacaaagaattggtagaaaccatgagaaatattttctcagagaccaaggtctccacaggccaggatttctcagagtcttcttcgatatattaaaaagtatttctggaaaaaattagtttgaaaactgctatgatgttcaagataactaggtgtcttttttttttttttttaaagagatggggtctcaatgtgttgcccaggctggactctaattctgtgcccaagaaatcctccctcctcagttttccaggtagctgggactatggatgtacttcacagtacccagctctaactaggcgtcttcatagcaaggcatctgttaagactttaaaatgtaaacatgcattgtgaatctcccaggttggataggcatagagagtatggtgtttcccaaatttacttgatcgaagaattagtttttcatggagcatcttactttgctaaagtttcaagtaccaaaattgggaaatgttgatgtaagcccatagccaagacaatcaagccttaagcatagtaccacaaaacaggtttgaaaactcctactaatccttccatcaattcatgtatctatttaacaaattaaaagagttctatatgtggcagtgactatgtgctagatggtggagaaacaatgacaagcaagactagtatattctctaccctctcagagttctggtgggcctactggggagagggaaaagttgcccactaattttattgcaatgacaagtgaaaagatggagaggacaggtgccatgacaccgggagcagcggcttcttacctaacctggtgggtcaaggagagtttcccagggaaaataacttctaagtggagacccaaaggaggagttacagctgtaggacacataggagcttgcaacacactcgcccatgcattccatgttgtatcctcatgacaacctttcttggtagatgcaatgagagtggtaaaagttactaagtggtcattacgacctaatgagttcctactcaatgagtcaggcactgtgctaggcatcttacaaatttattgcatataatcttgacggcaatgagcagtatcctcagtttacaaatgagaagttgaggctcatgggagataagtggtttcccaaccctgtacatgtagttagtacaaaaccaggactttcagatctgcctgattccaaagcccattacactgtggtcaaccagtgctgggcctggaccgtggctggtccataacagggtttttactagtcagaaatacggaagagtaagcagaatgtcatgagttcttccttaagctaatttttttcttcttaaatgacatattatcctgagatgtccccctcccaaccatttgatgtagaaagtcctgtgggttttttttttatatattacttgtcagagaaaactttgagcttcttcttagcaaaataaaaactttctaaccatatgtcagtctcccaagtcattttggaagtgttgccatctatgaaatctaaaaatcatggaagttctgtgtatgcaactttctagaacatattccttctaaaagtgagagaaatatgaaccagcacattgctgtgagttctgctggttcaaaattggatgagttgctgaattccatgggcaccagcagccaaaaatggagataaaataagatcaagtgtcatcttccaaaatgtacagacataccaccagtgacattcaggcattctacgtcctggtttatagacaccctttttctaagttttaatagatactagaaaagtacctagcattaaacctgggttttcatgaacatttttccctagaaaattttaaaaagaaagaaaagtttttttcccaggacttaaagaaatattttatgactaatcaatactataggtagtacttgagaaaagaaaataattgtgaagataggacctgaattactaaaatgtgtgaaatagtacgataatatgtataaaagtgcctcatgcataaaaggccccagtaaatgctttcttcctccctgattcacatggtgagcaagtggcgggggcccaggactaaacctcatagcatcagactcccagtccagtgctccttccaagaggcctttcaattgttttctttctgtctacctacctcacactgtgtccttcatctctctgtctagcccccaggaaaagtgcagcaagtgcaggtatttctgaaatgacgagtggctcgcaaaaaggatctgatgagtgttaatagtaagcaatgtgtacctaagagtgtagacactattagcatttggaaaaataggaatctgaactgagaactggaagggcccttagagatcatcccacacaaaccctctttttacagatgaggaagttgagacccagaaacgggaagtgctttgtgcatggccagagagctcgttgctgatcaaaccaggacaagcatccatatgaaacacgcaaatgtaaaattacatgaaaaaaaaaaaccctttacctccagatgtactgctttccagaaaagtggcgaggaaataccacaaaaatacctttacttcaaaaaatttgaaaatgttgaaggtcatgcttcatattgtgccaggcaagagaacattgtacataattgtaaatcaccattggaggaggtggtcctggttgtattcttttgtttgtttgtaatacacataacataaaatttatcatcttaaccatttttaagtgtacggtttggtggtattaagttcattcacattattgtgcaaccatcaccaccatccatctccggaactcttttcatcttgcaaaactgaaactttacccgttaaacaataactctgcattgccccctcccccaacccctagcaaccaccattctactttctgtctctgtgaatttaactactctttagatacctcatataagtggaatcatacagcatttgtcttttgttgactggctaattgcatttagcataatgttctcaaggtttatccatgctgtagcacgtatcagaatttccttccttcttggttgtattcttaatgcaacatagcttgttctctgtgatctgctgattataaccatcgtcgctgtgaagactttggcgtgcttaacatttttgtgacttctttccagtgggggaaatagatagctcagttgtggacgatagcagcaatgggaagcagtatttgagaagaaatcagactctcttcttccagtcttttgcaagtaggtgacacaagaggtaaacagaattgcatgctgtgcccctccacatcaccccctattttctttgtttcttctgcccaaggcttcagtcaatcagagaagcaatgagagttgaagattttaaaagtgggttttcaaataagacaagcttgggttccagtcctacctctgaaacttactaaatatgtgatcttgggtaacgtgattgaactctctgagcctcagttctgtaatctgtacatagagataataatacttttatcaaaaaagcatgtcttttttttccttctgattgatgagatgctttctgtattttttctggatttaaacatagtttccaaagttaaaatattaatagtacttttccctgtcccattgggttgtttagaaatgtaatgtgatatatgacattttggcctctctgagatgtcttgttccagcccaaagattattagggaacctcatgtcatttgaaaggggagaaagataatttattgataaggttctgcatgtcatatgtatcatttttttctcatcaaaaacactgagtagaactctattatgatacttggtcctttacttcatacttttctatcttcccagctagtcagaaccatgcccaccccgcagttcccaccccttggtcagtacctagcattatgcccagaaaaactacagatgcttcttcacactcccctccaacccccacacccccattaccaaagtgtttctataatgctctgggaatcagcatctcaattcccccatggcctcatggttaaacataccattcattcgacctctcaactgtgacaaagaaggaagcctgggtgtagaaactgatttcagctcccctctgaagttgggcgtctctctttgctgaccacttgggaatttttttttcttgcttctgacccacctctcccctttcttttgataaacaggacagctgtccccaaagggatgaatccattacctttcaccagagttgagttcgttttccatttcatctttctgcttaaagagaaagccctttaaaagcgcagcgcatacattgagtgcgtgtacttaatttttaatatgtgtgtgcccacagccaagagaacagagaaccttaaataataatgaaactgaattgtacatgtcgtatgttttatgtggcactgattcctaaatatgctcctagcagccaggtattatttaatacatccccattaatcaagctgccaaatctaaatgaaaaccatgtttaaatatgtttaataagattatagcttttggttgaatatcaaactaacatagctacatttttccttccagccagctctcatttactgtcttacatttttactctgaaagcttttgtactatcaaaccaatcttgattataaaacaaattataccacaaacttttagtatcgtgagcttcagctgagtccctcagtgtaaatgttaggagaaagaacagttctgagattttttttctggctaaaaaatgatatttttcttcttcttggggtgagcctttgagtttaaaaggaaattaaaaattcaattagagatactaaattgtttgtagcttctgtattaaatgatgtctgccttttgcatagttattgaaagtgtttcatattaaatgtactttttctttttgacggttcaggcttctgttagttttgcaatagtgacacctaggggctgtagagaacattgcatgggctgctaaaatctcaaaaacaacccctctgctcttttgccatggatagaaaaagtatttgtgggtcattggggctgatggagaaagaaggcaaatggtaccctgggcgaggtaggtttccagttctatttaccaggcttccaatatgcaaacaaaaaaaggaggtaaataaaaagaggtttttataaaaataaagaactagctgaacttggagtaacatacagtattctagcagatttttaaagttattgataaaacaacatcatatttattaacatgtttaattctcgttcttatttgcaacagtttgcctgctgttcttgcctttgtaacaggcatgtcccgcgttgattgcagagaagtgatgactgtatgtggtgctttgacttgttctgtgcgaatgtctcgcttctcacatctctaattcttctatttgccttgttcaatattctatatccatattcacccttataaagttgtcattgagacttttagcctatttgttctctccactgatatcattatttcttctagcttctcagagcccttacattttctccatgtttatatggcttgaagcttttaaattcttgatcaaagcaatcataaatgtgtctgttacaaacacattaaaattcttcgattatataaaaactgacaaacaagtcttataaaactgtttttgtactacattaagttcaaaataggtggcacatgtttaactttgtacactgtaggaattctaagaatcatttcaaaaagaaaaagcaaatacagtgcacagcaatgcatataattcttatagatgagtattatctatctgtcatatctctctgtaaataatgatggtgacaatgatgataggcaaagtttattgatgttttttatatgccaagcactgttctaaccactttgcatgaattaactcagtcaccatgggacaggaactgttattatcccaatttttacccacattcacagaatgcttctgtgttccaacaaggaaacttcaacaaagtagtgcatgagcttatcacaggtcgtgtgcaataagagtttatgttattagtttttccttgaactgcttgggagtcagtgtcacttttcttagccccattagcctgccctccctttggagtgtgcacgtctcctttactgtctgatacctgtctgctttcctcactgagtgcctctagctttgtctagcaacacctgccctcatagaacttacattcagttgggaagatcctaagaaacagcaatcacaacaagtaatattgatttcaggtaacaagaaatgttacaaaagaaagcaaagtgatatcagggagcaaaaatggaatgacagactgggtgtgaagggctggctttgtgagcaggagagaggccctcctgaggaagggatgttcgtggtgagtcccaaatgacagaaaggacagcaagtgcaaaggccctggagtgggaatgaattgaacatgtgtgaaggaaagcaaaaaaagcagggaggctggaatgtgttgagtaaggagaatactgtggggctcctctctctttcctttctctgctgccaacacttgtgttttctgtctcagactctagtttcactgaattcaaagaaatggtttggaattgcaaaatcctgagatgtcatccactgggagtgctggggatagggggacacgtgcaagagaattggcctaagaaaggttataccctgagtatcttccatatatacccatagccccacacatttttatcttgcaaagtcagttaagatgaacataaggcagaagtggaatcccagcacagttcatcctcagtgctccacagcacggaacagaccttggatatcgtacttcacacaagtttggtgactctttttttatgtctgcctctccactagactggaaattgactgaggacagagcttatgtcataatcattcttcagtcatttttctttcttgcattcattttatcagtaaatgcttcttgagtgccatctgtgtgccaaccactcgtactaggcccatctatctctgcttggataaaattccaagcaagaaagatacagtccctgctctcaagtttccaacagtattgcagaagaggcataccataaaatagcatcatacagtgtgctatgcctcagctttggggaggcagagaaaatgttccaaaggaagtgacagttgagtccagtcaggacttggaagtataaataaaggcgagtatatgtctgtatgtgtgtgtgtttctgtgtgtttggagaggggtatgcatgtgtagtgggcccgagatgggagagaatgtgtgcagaattttaaaccttgggaacaaaggattcatgaactcagaggtgaactcaactgtgtactggatgaaaatgtgaatgaatgagtacatgaatgtataaatgaatgaatcagtgagtgagtttttcagaggcagctcatgaaatggagattgtattagcgtgtttttacactgctataaagatactacctgagactgagtagtttaaaaacaaaaaaaggtttaactgactcactgttctgcatgacttacagtcatggtggagggtgaaggggaagcaggcaccttctttacaaggcggtaggagagagagagcaggggaaactgccatattaaaaccatcagctctcgtgagaactccctcactaccatgagaacagcatggtggaaacagcccccatgatccaatcacctctcaccaggttcctccctcaacatacggggattacaattcgaggtgagatttggatggggagacaaactatatcagaggtataaagccaaaaggcatttttattaatttaccctgagaaatcactattccaaattctgcccattatttccatgtaggcagactcatatggagacctatatctttatcaaaaatgtgcttgtcaagtagattattcagtgacttattgggagaaaaggttaggcattcatcttattgtagggatggctttatcaatggaactgcatatagctgatggccaatattcatctttatcctgaacattgcttagatgagaactatggggtaaacaaatgagtgaaaaaaataagttaaaatgtcaagggtgttcatagaagagagagaggctgttaatgtggtctagatgccagaggtggagagctggcttggaaagtagggactagattctagtctttgctgtactactctcttgtgtgacattgagcaactagccatcttcaaacccgtaaagtggaactatgccaggcaatgtctaaatttagtctctatcagctctagaattttgtgttcatcttagttatacctgctgaggagggagaggtattgaatgtgtatggacaccagctgggcagcttcctcatggtccctggatgacagctttgtcctggggcactcaatcctccagagtaccttaagaagctgtcctaatctgccatacacttgggagggttctggctgttaaccacctatgttggacacactgctgctattctccttccccacttttatctgttattctaaagtgatctgagaatttggctattcctgatgttgccttttcttatactccacgtagggagcctctgctcagagggttattcgtaaaaattaatgagatacatgtaaagcagccagaacagtacctggcacatgaaaaatagtttaatactatttgtcataattattcctgcagcccttcattgttgcctttcttcctcaggtattttctgccttgttctccaacaagcacaagggatacaggggtaaataggataccatctctgtgctgaggggttttgtccagtgctatttactgagtgccttccatgtgccaggcactaaggttaaatcattaagcccccaccacaatccattgcaatactcattatacccatttcatcttccaggaaagtgcatcccagaacagaaaagtcatgtgacattcccagcatcacacaattagtaaatggcaaagttggaattggagctccagtctcacagactccaaatccagtgttctttccaccatgtcacccagctaccacaaggctgccattgcacagttttgaaaggacaaagaagcagcagtgcatgatggaagtcagcataatgggaaataagctctccttccctgggcatctacttctaacttgcagaagaataggaaggctagtcttgtgagcccagctcccagcagtccttgctttagcccatctgaaaaggatctgtctttaaaagcaaggagccagaaaaaataattcatactaaaaacaaactctgtcatgagtcatttgactttgctttcccctgaacacatagtttatgtcttgggtgagctaaggctaaaggaacatctgatatgttttaggctagcagagccattatttaaggaacttcacatccaatgtgcgcccattggaccctatggtttaaatcaagtcttctgcttatggggcctgacaatttgttattcttgttgtagttgtattggagtgtgattgtgtacatgttttatcaagatgacaagaatcactctggttcatgattcaaaagttctcaggctgttgaactagcctatgcagtagttactctgagtatgtgcgctagacaggaatgtgtatatgtgcgcacatgttcagatgtgtgagcacttacagaaagagaagagaatgagagaaaggcggattccagctgagcatcttaccattcctatcagcagaagagcgacccagccctggggctgggtcagaggatttctcaatcctgggagaacagcagataaccccgagcacaaagcaagtgtttctgtctctgttgccaacttgcttttctttagatcattgaaaaatgacaggaatacacttactctgtaaaagcacgaacaatgtaggaatatatagagtaaaagcaaaaggcacaaacctctcctgatcccaaaagtaatcactattatgcgttttgtatgtctgtcttacattttttatgtattcacagacatatatatacacatatatatcatatagtagagattgtataatagaatactatactgtttaaatagtagaggatgaaaaagagataactttttttatctacaagatactttggaatatattaatacatataaagctgccccatgtctattacatgctgacagtaattccagaatctgcatatataaaaaactgtttaaccaatgtgttgatagacctttaggtagtttctagtgtttagctgttacagagacacaaagattattgttggtgtagttctttatatacaaatatgaggacttcttttagagaaatacaaaaaaaaagtggaatttctagtggaaggatttgtgcatttaaaattttgttagctgtggccaaaatgtcctccaaaaaagctgtcccaattcgtattcctgccaatgatgtccctgtgcctttgccaatgctggatattgtcagttgtttaatattttttgccaattttcgggcagaaaatgactgctcattgttcttttcctttgcctttccccattactagtaagaatgaacattctctttatacccatcaagtacttttctgttaatggcctattaatatcttttcttcattttcctatagggttgtttgtcctttcctcattgatttagaggagttctttatctgctctacataccaattctttatctatcattacatactgaagacattcttatagtatgtcccttcttatctacctttgcttacaatatctggtaccggagttttaaaacttcataaacttttatctgtgaatctctttatgacatcagaatttcttggaaatgttccctttaaactatttctttacttgaagctgtgtttttcagactgataatgttttagacttttatgtgcccaagagtaaacttttatgtgcccaagagttttagacttttatgtgcgcagtaaggactgaggaggtgagtgttttaccaagggcaaagctgagatcagaacataccaggctggcaggtccctgtgtttgttaaagacattcttagtaattttatcattaattatggggaaattctaaaactccattgggatcagccacaggcaaatgagatgctgcaagaagctggatactgagcatgcagcctgaagtcatctgagcgttggatcataaccagcttcctctacttaccacttgactttgagacataactttgcttctctgagccttagtttatttctctgtagaatggagctaatcacaacttcaaatgactattgtgaggtttcacatttcccatgtttcagcacttggtatctgctcaatacatgtttgcttttgccttttctggttaaagaccttttttcccctggacctttgaatgcaactggtcatctaaaactattgacttccatctcttctgaggatttttgtagccaaatggtggaggcatatctagcttgagagtctgaggcaatttcctgatgatacatctcagtgggcctaaaggaaacgaaacacctacaccattgctcaatgctggaaaattctccacagtggccgacccctttaggaggagggaagccagggctctggggaacagctcctgtctacgtgggtggagagttctttcttcaagcattgtggatcgtaaactcactgagcctcctgcctgtacaggaataaatttcccctgcctttgagatcatctcctcttctcctcacctcaacctggcatccttctcttcttaaggcaacacagcactagaggctgactgcccagcctcttgagccagacttcctggaattaaaacccagctctgccactctttacttgtgaggcctggagcaagtttcttaattactctctgcctctgtttccctggctgtaagatgagagtgctaatgttatctacctcacagagttgttacatgggtcactatttataaagtacttggcacatagtacagtactcagggagctactaataaatcatatatggtatctgaatttgggcttctcatttcacagccaattgactttggataatatgcttactccaagctcagctctctaatttgtaaaatgagtatgaaaatatctacttcatggaattgctgggcaagtcaaatgggataatgtgtgtaatgattgtaggtactcaagaggtggtagctactgtggtgatgagtatcaaaaaagacaggaatgaatatacagagactatcctaattctcaaaagccaagagactggtagaatgtggcctccacactcttagccctgtgaccttagacctaacctcttcaacattcagtttcctgatctgtagaattagattgacaatggtgcctacctctaggttcatgatgaagaaggagtaataataaattgggttcatagaaagtgcttaataaaattaattattattgttacctgtatctcctgtccatttaagggaagattcctatttgtagtcaggggtccctgggcagaagtgatgacagcacaggcagagggctgcaccccctgccctctccaactctggggatatagcacaaggtaagaaagagaagcaaatctaaggaagggaaattgagatcaaagcctggtttctatggatcaggccaaaatgattgagggagagagagaaacacaactcaggatgtccatcaggatttatctgcagcagtgtgtctcattttaactcttaaaacagttttgttggataggtactattatttccagttttgcctagcgaaactgcgagctggagaggttaagtgactcgcctaaggtcagatagctaaaaagtagaaaaactgggatttgagcccaagtctgtccaactctaaatccctaatgatatgcttttaatacatgccttgcctctgctgggaatgactcagaggccaagctgtaggaggagggggagagagggatgactgtgtttctcagggtgaacagagtaggcagccacaggggcagtaggcccggagctaacaggccttcatgtaaaaatttggaaattttgcctgaaagacaagagagtgttttcagctgaggccgttttcaactgtaccctgtgtactaggctgagggtaaaccaaaacacagccataaatagttctccacagaattctcgtcacaacagcccactgtattccttctgtttggagatgaatgttgaaacaccatgcatgaaaatggctgagtctgttgctgttcatgaagtctagtcacagcccattcaaatgaagcccccttggatgtgaatagagatacgagaatcagcagatgatcagccatcatggactcttgacaaatggctttgcccaaagaatcggcatccttggacttcatacaaagcaggccttcccaaagcctctgttttgaagggacccagtctgtttgaataggtgtttacccacttgctacagaatatgtttgtatacctgttctttaatttaaaaaagtatcaaagctagaagggactttaacaagtcatctagtccaatgcatttaaaagaaggggacatttggttccagagtaggaggtaactgtcctaaggttatatagagagaatccgagatgaaatccagggcctcctgtttcttagtctaaaacatgtctgactctgcccttgtgaatgcagccaatacagggacaaaaagtctttgggcttctctaaagggagggactgcaatgtgttagaaatgggaaggaggttatgtttgcccttggtgctttctacctttcccatctattcttttcctcccatttcattttttttttcctcatctgtcagaactaaccagtctaatgtgctcaattttcattccctaagaatcagactcccagatttccagagttactgctgtttacctatttcagagcttttccctacttcaactgggctgccttttgaacaatgaaagggaccctagaccaggggaataccaggctcggcccctattaagtgggtctccttggttaagacattgcctacccaagtgtcaattctcaatctctaaggtgcaggtgagaaagaggaaagggacaaatagtaattgatcacctgatacatgctgaactctaattatataaccagacttaatctttaaaggaggttatgtgaggtgggtagatattattatcttcatttgcaaatgaggaactagatttctagaaaggtaattcacgttctcaaagccatggaatcagaaagggagagagttgggacctgtacctagatttgtctgaaaaatccaaagtacaggttgagcagcgctaatttgaaaatctaaatccaacatgctccaaaatctgaaactttttgagcactgatatgacacccaaatgtcatgctcaaaggaaatgctcattggagcatttccagttttggattttggattagggatgctcaaccagtaattatttaatacaaacattcaaaaatccaaaattaaaaatacttctgattcctagaattttggataagggctcaaccttttaaactaaacctgtttaagctgtttcaagtttgccaagtaagagaaagtgagatgaatatatgtgttcatacacacacatacacacacacgcgcgcgcgcatacacgtcctcactctgtattagtccattttcacactgctataaagatactacctgagactgggtagtttataaacaaaacaagtttaattgactcacagttccacatggctggggaggccgcaggaaacttacaatcatggtggaaggtaaaggggaagcaggcacattcttcacaagacagcaggaaaaagagtgagtgcagaggaaactgccacttttaagccatcagctggcatgagaattctctcactatcacaagaacagcatgaggaaaccacccccataatccaatcacttcctaccaggtccctccctcaatacgtggggattacaatttgagatgagatttaggtggagacacagaatgaaactatatcacacacacacacacacacacacacacacacacactggaagagtgctttccaaactatgaaatgccgcccacaggtggacaattagccacccagtccaggccaagaatgaagtggctgtcagcatgccacagccatcacacaaggaatctacttgcaagtgagaggagcggaggaaacatttagaggcaagcacctatcagttaggtcagtagttctcaaatgtcactggagggccactgcaggcagggctggctacaatttgtatatcccccaatttgtgggacccagtgcaaaatgaaaatgtaggtccctgaccagggacaggaaagtcactccttccaacaggccttctgtctcaacctatggctgacaggtgacttccaaggctttccaaattctacatggaacccctctgtgtgttgtcagcctgacactccatggcagtggtagccagctggggtcactgccttgacccaccctgagacacagggggcccaatgtctggcctgactctttccacacctatgctcatctttatgaggagaagagcaagagcaaaacatgcccccacccctagccatgtaaccctgccaccaactcacagatgtgtggtcagcagtgggatggggcagcagaagacagggagtggatggccaagaactggccctggagactagccccattgttccatcaatttttcacctataaaacacagattcaaagataaaataggattccttatttaataaatggtgttgggaaaactggctagccgtatgcagaaaactgaaactggaccccttccttacatcttatacaaaaattaactcaagatggattaaagatttaaatgtaagacttaaaaccagaaaaaccctagaagaaaacctaggcaataccattcaggacataggcatgggcaaagacttcatgactaaaacaccgaaagcaatggcaacaaaagccaaaattgacaaatgggatctaattaaactaaagagcttctgcacagcaaaagaaactatcatcagagtgaacaggcaacctacagaaggggagaaaatttttgcaatctatccatctgaaaaatggctaatatccagaatttacaaagaacttaaacaaatttacaagaaaaaagcaaccccatcaaaaagtgggcaaagaatatgaacagacacttttcaaaagaagacatttatgtggcctacaaacatatgaaaaaaagttcatcatcactgctcattagagaaatgcaaatcaaaaccacagagataccgtctcaacaccagttggaatggtgatcactaaagtcaggaaacaacagatgctggagaggatatggagaaataggaacacttttacactgtttttgggaatataaattagttcaacctttgtggaagacagtgtggcgattcctcaaggatctagaactagaaataccatttgacccagcaatcccattactagatatatacccaaatgattataaatcattctactacaaagacaaatgcacatgtatttttattgcagtactattgacaatagcaaagacttggagccaacccaaatgcccatcaatgttagactggataaagaaaatgtggcacatatacacaatggaatactatgcagccataaaaaagaatgagttcatgtccttcgcagagacatggatgaaactgaaaaccatcattctcagcaaactaacacaggaacagaaaaccaaacaccacatgttctcactcataagtggtagttgaacaatgagaacatatgggcacagggaggggaacatcacagactggggcctgtcaagcagtcgggggaaggggagggatagcattaggagaaatacctaatgtagacaacgggtcggtgggtacagcaaaccaccatgacacatatatacctatgtaacaaacctggatgttcttcacatgtatcccagaacttaaagtataatttaaaaaacaacaacaaagaaagaattgaaagaaattgactgcaaacaattaatgcccagcttgggctctttctggatagagctctgtgcattgcacgggtgtattagtacattttcatgctgctaataaagacatacccgagattgggcaatttacaaaagaaagaggttccatgtggctggagaggcctcacaatcatggcacaaggcaaggaggagcaagtcacatcttacatgaatgacggcaagcaaagatagagcttgtgcagagaaactcccatttttaaaaccatcagatcttgcgagacccattcactatcatgagaagagcacaggaaagacccacccccatgaatcaatcatctccctccaggtccctcccacagcatgggggaattcaagatgagatttggatgcggacacagccaaaccatatcattccaccctggcccctcccaaatctcatgtcctcacatttcaaaactactcatgccttcccaacaatcccccaaagtctgaactcatttcagcattaactcaaaagtccccagtccaaagtctcatctgagacaaggcaagtcccttctgcctatgagcatgtaaaatcaaaagcaagttagttacttcctagatacaatggggatacaggcattgggtaaatacagccattccaaatgggagaaattggccaaaacaaagggtctacaggccccatgcaagtccaaaatccagcaaggcagtcaaatcttaaagctacaaaatgatctcctttgactgtgtctcacatccaggtcacactcatgcaagatgtaggttcccatcatcttgggcagctctgcccctgtggttttgcacggtacgacctctctcccagctgccctcacaagctggcattgagtgtttgcagcttttccaggcgtgcagtgcaagccatcagtggatctaccattctggaatctggaggtcggtggccctcttctctcagctccactaggcggtaccccagtagagactctgtgttaaggctctgacaccacatttccctttgcactgccctagcagaggttctccaagaggacctcacccctatagcaaacttctgcctgggcatccaggtttttccatacatcttctgaaatctaggcagaggttcccaaacctcaattcttgacttctgtgcactggcaggttcagcactacatggaagctgccaaggcttgaggcttgcaccctctgaagccacaggccaagctatagggacgcagggcaccaagtcctaggctgcacacatcatggggatcctgggcccggcccacaacatcactttttcctcttaggcctccaggcttgtgatgggaggggctgccatgaagacctgtgacatgccctagagacattttcctcattgtcttggggattaatatttggctcctcgttacttatgcaaatttctgcagccggcttgaatttctcctcagaaaatgggattttcttttctattgcattgtcaggctgcaaattttgcaaactttcatgctctgttttccttttgaaactgaatgcctttagtagcacccaagtcgcctcttgaatgctttgctgcttaggaatttcttatgccagataccctaaatcatctctctcaagttcaaggttttacaaatctctagggcaggggcaaaatgccaccattctctttgctaaaacataacaagagtcacctttgctcccattcccacaagttcttcatctccgtctgataccacctcagcctagactttattgttcatatcactatcagcatttttgtcaaagccattcaacaagtctctaggaagttcgaaactttcccacatcttcctgtcttcttctgagtcttccaaaccgttctaccctctgcctgttacccagttccaaagccgcttccacatttttgggtatcttttcagcaacaccccactctactggcaccaatttaatgggtgacacactcgtgcagctggtccccactgcaggtccttcacaaagcttcactagtccatgagaaatgaaacaataaggacagggtattgagattttaacaaaattaaatgtagactatttaaatgattctcctttattctgatatcatgataaccacttttttggtattaaaatctccttttggttatgaaataatggtgagagtaaatatggagcagttgctttgtttaaagtccttatataatcaaataaaaagctgacaattatgttgtagatctccaaaaagtttgaatattttattggtccaaagtttgagaactcctactctaagactttcaagaagatggcccttcccacatgtggggctggaacctcttcccctttcactatcatcagaaaggcttccgccctggatacaattagtatttgttgcatacttcagtattttctaggtatatctttgctttttggaagtctaaaacatctggtagaatctttcagaagaagcaacacagaatagaggcattaaaatcaaaatttgaagtctgaaacttctgtttcttaccatcattaagagagaagtgcccaatgacaatcatttctccaaaccatcagcagctccttggaaatgaagtggaagggtgataatatatccaggacagacctagctaatgtcttaatcttggcataattattaataataacattccctttccttccaaaaagtgtctaggactcaaaggtgagttcattgggataataaactatggccaccttaaatgaaggccccttcagctctcctgagctagaaagtcccaaagagcctgctctttccctgggcaggaagccatggtgaccagtggaaggattatgtctgtcttaccagaggcctgggttgggtgccagcatgaagcctgtaggatctacttagatctgggacttcaaagacctagtggtgggtgaatctttgtggcttccatcattgctttgtctctgggagcatcaagttgaaggccaagctagtttctttcctttgatgagggaaaatatgtcaacacaatggtccactgaactctgggaatagacagacatgtggtgtctttgggggattatagcctaaatggttttactctggcacatgtggaattaaatataaaacaaacagctgattgctgttaaattcacatgcataaaaacaaccattactatgtcttctcagctacagtaccagagagtccccctagaatcaagcagttattagatgggactttggagtgagtgtagaaaagaaaaggaggaggagaaggaagaaaatgaggaaaagaggaagaggagagagaaataacaagtcaaataggtggagagttttgaaagttacaaagtctgtgccatttagcatgagttatttttcctttttattccttgtatttgacatatgaaaagaaatctttgctgatactggcttcagattctcaggtttaagtatgctatccttgacccaggaaagagttacatgcatcatacttccgaggccttcaaagaacaacttggagcaagcttgagagtttgcagggcattttggtgacatttctggatgccctttgtttccccctttcaagaaaagccctttctttcgttgccttctcacataacagcttgggattcttgtccctcccagaaatgcatttgaacttgctgggtttgttaagagtcagggcatgaagcatttttccatggtagaaaagttctggcattccaaagcagaactaatgtgggatttgggaagcttgccctatttgtgcacttaattagagctcaccaaaagcagctgatccattggtaccataaaaaaccaatgctgagaccaaggaaggctaagactgtgagtacccttagagggtggtgaacatgaattccacacctgttccctactgactggaatcaggattcaaaggcaaaaagttgtgtgctttccagcaacattcattgggatccgcagcccaatttaatcaattgataggttgccagtgtctaagtcaagtcccgaaacacttggttccccttgggtcaatgaaatttggtcttggttctaatacaaactttaagttggctaaaaatggctgagaaaactactggttttagagtcagtcaagcctgtgctctaagtctgactctgccactatgagatgtcagatcttggagaaactgttcagttacttctgagctttagtttgcttcccggtaaagggacatactaacacctattccatgggtccattatatacacaacagccaacatttgttgagtaattactatgtgcagagcactgtgctaagagcacagtctatgttaactttttaatcctcatacagacctaaggaaatagattctatattggagattggcaaactactccccacaggccaaattttgcctactgactgtttttgaaaataaagttatattgagacacaatcacatccattcattcacatagaccctatggctgctactgtgctacaactgcagagttaaataattgtgacagcgaccaaatggcccataaaacctaaaatacttactatctggcccttcatagaaaaaagtttgcctctgctttaaattatctcaacttaaagatgaaggaaataagccaaaggtattaaaacctattttaagtaggttagctggggccacaaagctggtaacaggtaggactaggatttgaatcaaacagcctgactccagaacttgtgttagtcaccagtatcttatatataatatatatgaaatgcctagcatagtacctagcacacaggagatacttaatacatctgttttattagcatggtattccctttctttttacctcctttcccagtttcctatcaattccagttaccttttgcttttcttctgcaagataattcagttaagcatatttctggccaattctatgcccatgatctcagtctatccaacaactctatgaggttggtatcattattttcatttaaaagatgaagaaactacatcttgatctctgagctcccaggaatctttgcactccatttggggaccctcagaggaaacgttgctaggaacttttggaacatttgttttatgcggcaaactagcatcaaagaaaaaagaatctcagtggctgcttgagaaaggattacaatctaattagggagacaaaaccaaaatactgagacaacagcaggcattttaaagtaagttatttagtacagacagtaagtgagtgtgaattcagagagctgggaacaagagagcggacaggggaggggagggctctcaagtttcctggtcaaatgtgaactgtgccttgaatgacagactgaatttaaaaaggagaggctcagattcaggcatgatggaagcgggaaaaggaaccacagatttcctgcagaaatggaagtgagagctctcagacggacagaatcagcaaatccctgggaactgtagaaaatcagaatgagtaaataatgtggtgacagattctacaggattttgaaggccagagagaggtacctgggtttcagaataacaatagtgatcatcataacacttagttgcaggattgctgaccacacacatttcacatatgctcgcccttaaccctccttgtccattctgtgatgtaggtatcatcctgttttacagatatgaaaattgaggcttagattatagcaatcaaaggttgatgggaaaattagaaatattctgcttacttagttcaacagtgcagagcttttgtgttgttacgttcttccttggatacatgtgcttgtcgttgagattttatagggtaatctatataccctataaacccatttaatataatcataggttctgcttgttctaatactgttacctataaacaattccccatggactcagatggaaagtgccatgaattaaagaccttacactacctggaccactctgatactgcccaccacaggcaatgggcagctatggcatggtttagagcataggataccataatgaaaaggatcagttctttcaacaaaggccggatgggaaagacaggaaggaggaaatcgtgtgaacccagaagtgtgatattcgatggagaggcaatcctgggatgaacacccagagcttgggtttgggatggctgaagaacttatgccaagaagagaaggcacacatgtagattgagaaggccatgaccagcactgcttaagtcttaccacttagtcatagttgagggacataagacttgaagtatggagatttaggctcaagtcctagtctcacggctactggcactatgtgaagaaggacggaaaaggcaagaattatatgctgattgagttatgcaatatattgtgtcttcccatcaatagcacttaagtatttctgtgtgccagcactttctaatttctcttctaatcgcttaacatatattaacttatttagtcttcagagaaaccctattagattgggggtattatcatcttctttgtatagctggggagactgaggcacagaaaaggttaagtaacacacctatggtcacacagctggtatgtagagaaactacactttgaacccatgcagtttggcccctgagtccatgctcttacttactgtcacattacctctcaggagaaaacaggataggtgttacgagcccagttttacagatgatgagactgtgggtccaagaccataagggatttgactaaagatcaaacaactaaacaaactgttacgctggcatttgaactaggtcttcctaattctgatccagacattctttctatcagatcacactgcctcctgttggtgtgaaagcattttacaaccataaacctcctcctgtttattaacacattattatgatagatataaggcttctctgattcagtaggaaaactaaggaggtagatcagccaagctcgtggttggtagtaataaagggcttgccttctagacggtgactccctccaggagagccaccaaccagttcctaacctctgtttcttgcagttcctacagagcctggcatggggcagagggtggctctctacaaatgtttgttaaacacaacttgttccagatagaagcatgtgaggctctccactaccaccagtggcatagcaggcacacccatgcattagcgacttgccctctgccaactcctgggatggtgatatgatgatggttctttgtaagcttgtcacttgtccctcttccaaagtgagtttacccagaggagcattctgaggttgaatttgtcccataccaccccttcacctacacattgacactccccgctgtataccatggggtcagagaccttgcactacaaaggccccttgccaagcgtggtattgcttgcagcctgtctgaggctttcactactttcccccagactctcagcccctggcctcctggctcatggccactcccagtgcccttagctttagcttcctgacccccctataactggcacccaggaccacttcaccagcttccttctcagaacaattgacttttgcccctggggtacttatacctcttttgttcaaggtcacaccccagctcaacacccaggatccaccctgccagcctgtgtgagagccatccccactagactttgaaagggactggacagtgtgttcagccaccttctcaagggcctgtccctggcagctttactggtcccacctgttcctagcctaggagctgccaatccaacaagatgaggctattctgggaagaagcaggaagacctcttcaccctaattgagtctttcttaacaaagaagtcaacagaacttttttttttaagtgttttaaatactgcacaggatgctacagcagttaagagcatggcctctggaatcagaaggatatgagttaaaaatccagttctgccacttgctagccatgtcatcctagggaaattacttaacctttctcaacctcggtttctcatttgtaaaatggagctaaaaaaggcccacattactaggtaatcatgagaattctgtgaaatgatatatgtgagcatatgtcacagcatgtgacaagcagtagatgctcaataaatgatagttattatcagcattatattaaatattattaaagtatcttttaagactttctggagacatttcattcagacagttatttattcaacaaacatttatcgagagcctgcatttctccagatccatgctgagtgcaaatatgggatgtataattatgtttataaaaaagagcggtgcatgttaatcacttactataggccagacactgttctaggcattttaggaacattctttcatttaatattgataagggccttgcaagttggcagaaattataattgtcattttagagatgaaaaaactgaggttcagagaggttatccccaaaaagacatgacctgtgattgagtgtggcatgcatcacccttaaataaaccaaaatattttaagttcaagtccccactattgagagatcgacaatttactcccatgtagtagaatgcctttatataactttcttgttaaagtcaaggtcagagcaaagtggtgtgatttcctcctcattggtaaaaatctctgtaagaggtgagtgttctcgtgcctttgttagcatgccagcaatgagcctggggtctctcctctgattactggggatttcatcatcattcaggataccttctctcattatgtgggactgaaaatagagatagaaaaggcaacaggtaaggggctcatagtgaactcacccaatgcatgctttgcaagttattttgttttttaagcaagtcccagtcatgatcttgctttcggattcatgccttatgcctgtagccattgaaagccaagtatgtcagggggaaaaaaaggtccttcagttagctgaggttttattctgtttctactttggtggtttgaaactaattacagactcggttgtgcctacatgtgcaaaatgaaatgagaggttgagccaattactttaataatgaagagaggaaaatccacttttctttccattatctaaagatttcaggcatatgtgagttttatatatgtatatattaaattatgtgaaaaattggcctcaagccttcatttcactttgcctgtctagaaacagactcaaattttgtttcggaaaggagatgacatgccttaggcatcttccaggagactagagggtcttgttgtaacaattgcagctaagattgattttcttattgttatgatgaatacttgtgcctgcctgggggagggaggtatattatgaaggatgacttttaaaaaaaggctggaatacctagaataaactttaggaggaagtttccactcatattatttattcattcatttatttagttcttttcaggacctgcaaagccctcctggcctggtgctcactccctttctaatttcatctccttctgccacttgcccaaactgccccagcaggtctggcttcgttgctctctttccattcactgagcacacttccaactcagggctttcaagcttacagttccctccgtgtggaatcatctttccgttgattttttcattgttcactccctcattcccttggatctctgctcaaatgtcattttatcagagagatgccattcctagtcaccctatacaaactgcctgctccacgcctaccattctctgtcccccttgccctacttgatgtttttttctccctagtacttaccaccatctgtgtgatatatgtgcatgaacttatgtgttattttgataaacatgaccatatattttattttaataaactttatttttagaagagttttatatttacagaaaaattgtgaagatgatacagagagtttttcttttctttcctttgtttttttttttttttttttgagacggagtcttgctctgttgcctaggctggattgcagtggcacagtcttggctcactgcagcctccacctcctaggttcaagcaattctcctgcctccgcctcccaagcaactgggagtacaggcgtgcaccaccacacccggctaattttgtatttttcgtagagacagggtttcaccatgttggtcaggctggtctcgaactcctgacctcaagtgatccacctgccttggcttcccaaagtgctgggattacaggcataagccaccacacccagcagatacagagagtttttctaaaccacatacttagttacctttattattaacatcttacattagtatggtgcgttcgttacaattaatgaaccagtattgatacattattattattttattttatttgttcaccagtttggaatgcaatgtatttttaaacagagtgaaagacacctgacaggtaactgaacaagttagcattagctgggcccaagattaaccaacttgtatcaacattcacagacttctgcagattccctgaggacagcaatatccaatagtgtttacttgttttgtgagcacagtaatagaagcaaagcgagacctttgttaattaaagcacatattttatgcagatttccttagattttacctaacatcccttttctattctagcatcccttccaggacaccacgttacatttagtcatcatgtctccttaagcttttctggcttttgatgaccttgacatttttgaggagtactggtcagatactttgtagtatgtccttcagttgagatttgtctaatttttttttttttcatgattggagttttggtcttttgggagaaaacagaagactgacaaagtaccattctcatcatatcatatcaaggatacttactatcagtgtaacttatcgctattgatgttggccttggtcacctaaggtagtgtttgtcaggcttctccactataaaattactctttctccttcctttttacactgtactctttggaaagaagtcactaaacacatctcaaacttaaggagtgagtgagaagtaagttacgatctacctcctcgtgggaggaatatctacataaatttggaattatgctgtttgggagatttgtctcttctcatttatttattcactcattcatctgataactcatacatatttatatttttggttataatccagtactactttgttttgttactcagttgttccagttgtagccattggcaactcctcagttggctcctatgaccctttgacataatcccgtaattgtgtgtcttgtgaggttttaaaaaattattatattcttactttctggcactacaaggcactttaggctaattgtgcatatttcctgctccagttctggaatcagccatttctccaaagagtctgattcttttttttgttttgttttgttttgtctgtgtgacggagtcttgctctcacccaggctagagtgcagtggcacgatcttggctcactgcaagctccacctcccaggttcatgccattctcctgcctcagcctcccgagtagctgggactacaggcacccgccaccatgcccggctaatttttttgtatttttagtagagacggggtttcaccatgttagccaggatggtctcaatctcctgacctcgtgatccacccacctcggcctcccaaagtgctgggattacagacatgagccactgtgcctggccagagtctgcttcttgttactggagactggtggttagacaccaagatttgggcactaagtgtgctcattgctcttgggctattgtcaatgcttcttggccctcccagctgaaagagcaaggaaatgtgtatgtaccctaacccatgtatatacccatatctataaatatttctgtatgtaatcatctttttgatattaagctaaacatgaattcacactggtttcctactgtaatctattgccacatggatcattctaactcgctctccttgcttatatttaaattccccctcaaataatgagaaatctggctcccaccatctgccatccatttacttaattattcaatttcagtatacatgtatagaaataccagaattgttaactcataccattgcagaatacaactttattaactggaagacagtacttatatacagttttcttggcattttcttgtttttttttgggggggggtggttgggggtttttttatctttagtttttcagactctactaatttctgaagttacttaggtcagcaccttaatcacccaccacacagagtgagatcgttttatacactagtaacacagttacattgtttttgacatactacattccatcatgggatcccccacctcctgaatttttaaaatttacgtacattaaggtttactttttgtactctaacattcagtggttttgataaatgcataatgtcatgcatattcaattacaatatcatatagaatagtttcagcaccctaaaagttaaaaatcccatctgggcatggtagttcacacctgtaatcccagcactttgggaggcctaggcaggcagatcacatgaggtcaggagttcaagaccagcctggccagcatggcaaaaccccgtctctactagaaatgcaaaaattagccaggcatggtggcaggggcctgtaatcccagctactcaggaagctgaggcaggagaatcgcttgaacttgggtggtggagtttgcagtgagccaagattgtgccactgaactccagcctggacaacagagcaagactccgtctcaattaaaaaattaaagttaaaaatcccccgtgttggccaggcatggtggctcatgcctgtaatcccagcactttgggaggccgaggcaggcagatcacgaggtcaggagatcaagaccatcctggctaacacagtgtaaccttgtctactaaaaatacaaaaaaaaaaaaaattagccaggcatggtggcaggtgcctgtagtcccagctactcaggaggctgaggcaggagaatggcgtgaacatgggaggtggagcttgccatgagcagagattgcactgctgcactccagcctgggcaacagagcgagactccatctcaaaaaaaaaaaaaaattcccctgtgttttacctctttaactttccctccttttttcccaactccttgacgatcactgatctttttattgcctctatagttctaccttttctaaaatgtcacataattggaatcttgctccacatacttttttagcatttggcattgttcgtttttttattttagctattctaataggtttatagatgaatgtcactgctgttttaatatgcaatttttaatggcaaatgatgttgagtgtctttatatatattatgtgccatctatatatcttctttggtgaatcacatgttcatatattttgcttactttttcactacattgcttgtttacttattgttgaattttaagagttctttgtatattcagatacaagtttctttatcagatatgtgttttcttctagtttgtggcttgtctttccattctgttaaaaatgtctgttgcagagcagttttagaattttagtgatccagcttatcaatttttttcatggattatgcttttggttttgtatctaaacttatcacctaacccaaggtcacctaaattttttcctgttatcttctagatgttttatagttttgtgttttacaattacatatgtgatccactttgagttaatttttgcagaatgtctaatgtcactgtctaaattcattgttttgcatgtggacatacaatatttcaaacatgacttgttgaaaatattacactatatcctttgaattacctttactcctttgtcaaaggagttggaaaaggaataaatcagttgactctatttgtgtctatttctggattctctccttggttccattgatctatttgtcttttctttccccaaccttacactgtcttaattattgtagctttacagtaagtcatgaagttgggtagtgtcagttcactgactttgttctttttctttagtattatgttgactaatgtagatcttttgcctttccatataaattttagaatcattttatggatacttaaaaatagttcgctgaaaattcaatttatttatttcatcagagttttgtaattttccacatatagattctgtgtacttttgttagatttatacctaagtgtttttgtgggggttttttttgttttttgttttttgttttttttgcagcatgctattttaagtgttatttcttaatcaaattccattttttcctcaatggtaattgctagaaagaaattgactcttgaatattaaccctgtatcctatacccttacttgtttgcttattagttccaggatttggtggtgttctcattgggtgggttggttgatttgttcattctttgtgattttccacatagacattcatgtcatctgagaataaagacagttttctttctttctttccagtatgtatgccttctcatttctttgtctttttgcactagctaagacttccagtacagtcttgaataggagtggtgagaaaggacattcttgctttgttcctgatcttagtgggaaagcatccagttttccatcaagtatgataatagctgtagagtttttttgtacatgttctttatcgaggtgaggaaaatcccctatattcatagtttgctgtgaatttttaatttttaatcacaataaaaaatgattgttagatttttttgaaatatttctccttcatttatcaacatgattatataattgtttttatttaatctgttgatgtaatggattacattgactgatttttgaatgttgaaccaaccttgtacacctggagtaaatcgtatttggttgtggtatataattccttttacacgttgttggattgatttgctaatattatattaagaatattttgcatctatattcatgagagagagtggattttggctttctttttttaatgtctttgtctggttttggtaatagggtaatgctgacctcatagaatgagccagtaagtttttcttctgcttattttcctggaggacatggtaaagaactggtataatttcttccttaaatgtttgctaaaattcactagtaaaaaccatttgggcctggcactttggtttttggaaggtaattaattattgattcagtttcattagtggatacagctctattcagatgatttatttcttgtgtaaattttgatagtttttgtctttcaaagaagtagtccatttcatctaaattatttttagttgccaatgttagtaatttgtaacttctctctttttatcttgattaccctggctaaaggtttgtcagttttattgctctttctaaagaaccagctttggtttcattgatttttctctattgctttcctgtgtttaaattcattgatttatgctctaatttttattatttcttctgcttttttaaaattttaatttcaacttttattttagatacaaagagtacatgtataggtttgttacataggtatattgtgtgatgctaaggtttgggtacagatcctttctcccaggtagtgagcatagtacacaataggtagtttttcaacccatgtctcccctccctcctgtccccctctagacatcccagtgtctcttgttcccatgtttatgtccatgtctgctcagtgtttagttcccactgacaagtgagaatatgtggtatttggttttctgttcctacattaatttgcataggataatggcctccagctacctccacgttgttgaaaaggacgtgatttttttcttttttatggctgcatagtaatctgtgatgtacatgttccacattttctttatccagtccaccattgatgaacacctaggttgattatatgtcttcactattatgaatagcatggcaatgaacatgcgagtgcatgtgtctttttggtgaaatgatttcttttcctttggatgtatacccagtaatgggattgttacattgaatggtagctctgttttaagttctttgaaaatattcacagttaaaatgaattacctaggaatatactaaccaaggaggtgaaagatctctacaagaactataaaacactgctgaaagaaattggagatgatacaaataaatgccaaaacatttcatgctcatggatcagagcaatcaatattgttaaaatggccatacttcccatacagattcaatgctattcctatcaaactaccaaaatgatttttcacagaattagaaaagcctattctaaagttcatatggagccagaaaagagcctgaatagccaaagcagttctaagcaaaaagaacaaggccagaggtatcacaatacctgtcttctgctttctttagatttaaattactatttttcccctccttgtctccaatgtctcttttgcctgaaattaatgtaactactacaactttattttgattagtgttagcattgtgtagctttctgcatccctttacttataacctgtctaagttaaaagtgggtttctttgtaggccttattcttttaatcatctctggcaatttctttcttttaatcagtgtatttagacaattcacatttaaagtgattattgatatagttgggttattatctaccatgtttgtaactattttatatttgtaacatttattctttgtttacctttttttcctcttggcctttcactggtattcatcaggcattttatgtgatttcattttctctcctctcttagcatatcaattatacttctttttttaaaaggtagtaatgtccctaatgtttgtagtatacatgtttaatctaagtctggcttcagataacgctataccacttacatgtagtgcaggtaccttataaggaagtactttcaattcctccttcctatccattataacattgctgtaatttatttcatttatccatttgctataattactcaatatattgttactattgttactttaaacatataattatagatcaattaagagtaaaaagatgaaatattatcatttaccttcatttatttcttctctgatgcttttcttttatgtaggtccaagtttttgacctatatcattttccttctctctgaataactttttttcaacattttttataatgtagatctcctttcaataaatttttatttgagaatatctttctttctctttcatgtttgaaggatagtttcattgggcatagaattctaggttagtgaggtttttcttttaatactttaaatattttactccattctagttttatttacacggttttctgagaagtccattgtaattcctatgtttgtttctctatagattaggtggatttcttgccccctttggcttctttcaaaattccctctttgtctttggttttaattttgattatgatttgctcagctttcgatattttcatatttattctactttgtgttctctgaacttctggatctattgtttggtgtttcttctttattttgggaaattcttagccattattacttcagatatttcttctgctccattctcactttgttatcttcatattctaaccatgcatatgttatacgttttgaaatttttcttgggtgtcctgggtgtttccctccattcttttttctttttgcatatcagtttgggaagtttttaactgatgtatcttcaaattcactgattctttccttgtccttgttaaggccatcaaaggccttctttgtttctgttggtctttttattattattatcattattattattattaggatttcttttagatacttttttagcattttcgtctctcgttacattgtccgtttgtgcatagtgtttactttttctattagaacacttattaatcatagttgcattaaattatctgataattctaacatttgtgttatatctgagttgggttctgattcttgctttctctctttggactgtgtttttcttgccttttagcatgccttttaatattttgttgaaacatggatatgatgtatctggtaataggaactgagacaaataggtctatatgtgacattttgtgttagaaattgaactgtgtttaatgtttgttatagttgtacatgccagaggcctcacattcttctattgtccttattttttcatccccactattgtctttggcgtccctaagatctcctccttagatagagtctatgtcttgctgctctttgagctgtaattcactaatattatactggggtcatgtcgatgtggttttaaggtatggggaaggaaaagcattctataatcttttgattatatctgtcttttagtgggactatgtccctgagctatgaccttcatagatgttcttaggcccctactcctttaggtgagacagaaggcttgcaggcactagagttgaagagatgtccttcccctgtgtgcaataggcttttgtaaagtctcttcctcttaaaaggtctttattatggagaactctgtgttatggaaaaacactgtaaaaaatattttacagtgtttacgctttccctccccctgccagagccaagaggggatcattcttgactctttggattcctggaggtaaaaccgatgaaagtgtgggcccccttccactaagactgttaccctcaggagttgctcgctttcctattagtccacactcagcccccaacacttcaaattaccactgaagtgtccctaccagtttatgactccagcagctgctcctccaagtaagatctcagctgtgactgtctgggttgtcctttctcttcagatttcagggtgatagtttgtcctgtaacctcagttctcttatggatccaacaaaaatcactgatttgcagtttcttagcttttttttttttttttggagtaaggatgggataaatgacttagacagtttttacatgttggagctataaccacaagtctctacatgtctttaatgtacttgctgactttccctactggaatgtaagcttatgaaagcaggggccatgtctgttttattcatagctacagcttcagtagccagaatagcacctgactcaaagtaagcgggccaataaatagttgctaatagactaattaatctcttggcagtcattgagcatattgttataccaggcactgtgcttagtgtggaaagacatcaggtgcctacattattacagtggtgtgggggcagggcatggtggacatacaactaaaataacaataaaccacagatcagagaatagggaagttttaaagcactgaggacacatacctcatctagcccaagcaagagggaggtagaggtaaagcattgccagagaagaaaaccatcacctgagttgagttgtaaacaatgagtagctgttagcctgtatagtggagagggacccagccaaggagacagcacagacctgtcaaagtccatgtcggacaacatgcaaagtgatttacttaacccacctcatgaacgtttagtagcccacgcaaggcaggcccctgttaactcacaggtcaggaaactgagcctcagacagtttaagtgactcgacaaaatgtcaccaatgctgagtgatggagcaagtcggcttgaggccaaggtccattttctccctgctacaaagatgactaagcacgactcagagtctggtggaggagcagaacacataaacagtctttgatgatacccatgctcttttgaatttgctctattgttgttcattttctttaagatttcagccctagaagtagcaagctgaaaatcagggctgctttgcaaatgcccacaaaccactgaggggagttttgtcaaagaaggcgggaaagaaaaataaatgtgggcttctgctctttaaacctcagcccagtgaggcagactttcccggaatacttcaggcctcttcaaaggcctattgtggaaagtgtccagatgtgcgtggaaaacctcactgggaagcttcccggtgaagaggccttttaagcatgaaccgagatgaaggaagctgacgccatgagtcctatcaggtggccttttttctgaaggagcccagattttcccctaaccttaagaaggttgtagggggttgggtgattagccagttcgtattcctttgattacaggaagcagtggggttagttgttttttgttgttgtctttcctttttttgctgaagtgagaagaggagatgggggtggggggcattctccatatgatttatctacctgtaagttgttagtgacagtctggtcattcctccagcataccttgtgagggccaggagggatttctggattggataaagttgaggcactgagtaagtcctgctagtttctatgatgatgcctctgagtgttctaagagtcagaatcccctggaatctggctctgatcccctgctccgaatccctgtttaagctctcttcccaatgccctgtttatcctaggtttgaggccccatcttcctcttgctagatacagttaagccagagagacccagatttaaatcctgctctctcattagctgtgtcatcttgcacagagtagcatcagcctcaccgagcctcagtttcctcatctgtaaaatggaggtaataccagtcccgtcatcatccagttgctgtgaggattaaatgaattgctgagttgccgcacacaaagcatctggtccagttcctggcacagagtgagggttcagtttattttcattccttttctctttaatccagttgtacaaagaggcagagctgtcccatttgaccagagaattttacttctgtagctctttaaattctctccccgccatgtacatatgggcttagctaagtattttgagatcacagtgtatttaggggaaagtccttttggctacagctaaaattaggcctctcttgtgctcctctgtttaccaccccccttcctattttaactaattagaggcattgacactaagaaacacttaagaaaagttggaagaacagctgggagttgttctagatacaagcagctgctccctgtcagcatgcaggcacagaaaaggatgatcctgaatggggaagtgcagggagggcacctcagagatgaagatgaggaatggcaaagtctgtctatgttgtggcaaactgagcagggtggagttcttatcactctgtcctctaccttctgctgagagaaaaggggggtcagagataccaaagcagatagaggaaaggggggcaagaaaggggaagggaaggaaggtattcaggagcttagctagttggttagttgattactttatgcagaccactgtcgcccccacctagaccactgcggtatctcctaactggtctcatgctgccggctgctttcctgctggaaccagagacgtcacaggaacatgcaattcttgcaccctgaaatccccgcgacgagcttccaccatggaatttagacagaattccaaaacccatcacatggcccccgagtacctggatgcaccttccccctgttccccgtaattgttactgctcagtcctgctggcttctgttcattcgctctgcttcaaaggactttctctcctggagccagattgcctgagtttaatccaggtttccctactcgctactactacttacaggcctctccatctcccttccagccttaaacacctactgagctcccctggaattccctgtccacgtcctacacactctcctcatggagtccccgggcctgtgcacccccaaataaaagtttctgtgtttccagatggccatggtgactgtgcataaagcctagcaaatgtgcatcaagccagaagacacgagacctttccaaagggctcatgtcttctggcctgatgcacatttttgtgtcccctgccccatctcctcctcactaccctcgggaaactgggtgatgtctctgtgggaagggctgagcctcaggctctgtattgattgtccagtgctgcatttaaacttcctgactggatattcagaacttatgctgttgttttgttttgttttgttttgtttttttgttttgttttgttttttaaagcaagcaccttcacatctcaggtgtaaatgccagatcttctaacacttacaaggacaaattcatttcttactaaatagtcaagcttaaaacccacatgactggctgatgtaagctttggccttgtctgtgaggaatttttgcaacattatttctcttgatttctttctttgttgctgctgttctcagaacaaggcaaggctgaggttctccttctcagttactccatgtccctgaattaagccctgtgagatctaaaaacaggagctctgtgcacacagccgtaaggacaaaccctcactctgcatccccctaagtgggccacatgcctaagcccagaaatctaagagttacttctaacaactttctctccctaacaccctcatctggtctgtcactgaagcatgttttctgcctcctgagcatctctcatatctgggtgataagagagccaccttgatgtcccctggcccttgctgacctcagcagagcctttgggtgacagtagctctggcttcccagggcccttggaaaggagactgtggggtccgcgtggtatggccctgcctgcctcttggttctgtttcacccacacttcccttcactcttatctgctccaacaacacagcctttctcattcctcaagtatcagttttcttttctttttctttttatttatttcagtagggttttggggaacaggtgttgtatggttacatgaataagttcttttctgagacagggtcttgctctggtgaccagactggagtgcagtggtaccataacagctcactgcagccttgacctcctgggctcacgtgatcctcccatctcacctcccaggtagctgggaccgcaggcgtgcaccgccacacccagctaattttttgtgtttttttgtagagacggggttttgccacattggccagactgatctagaactcctggctcaagcaatccacccaccttggcctcccagagttctgggattacaggcgtgagtcaagtgtcatttttcgtccttccgtatggccctctcctctgctagacacatgcttccccctccttcagccattaatacctgtgcatcccttgaatctcagctaagctatgacatacatgaagcatacatgcatatagacacagacatacataccattcaacctaacatgaggtgattgaggaatgccgagaccctcctctcccctctcagtgccctgaagcagcccctgggggaggggatggccctggtccctctgactctgacagggactgccctcccacagagagaggaaggcctcgggagctggttgtgggctcacctctgtggtactgctcttcctcctgcttctgagcagagaaggcctgggggccaaggtgcccaggggctgtggacaagatccttttatgctctgtccttgcctctaatgtgacagattattttgtaattacctggcagagataagtttggtttctgcaaataaactagcaaagattccaaggttattaaacacaaccttgcctcatctatctggtcatatccaaaaaccttaaaagaatttttgttcttctgaatttcactctccaaggcacaaagaccaggtgatggtggggcaggggtagagagagggatgggaagacttctcacagtgattcgagaacgttcacacacacatacgcacacaaaaaccttcactctccccctctccaaccccaccccactgactgcacacatgtcttggcccccttgagaatcccttttccatagacaagccctctgaggtaagaggtttaggcctccttcctgctttagttaacatcttgtctccacagaaccacatccaaccttccatttttctccaacctctttagctcatgaggaagatttacagcctgggagtcaggaggcccaagttctagtccttgctttgacaccaggtgatattgtggtcttctctgagtattgttggttcactcttatgagagcattctcagacctgtggcattttcaccattgaatccactgtgcacagaggtaaccaacatttgtgacacctgctgtttgcaaaacactgagctaagaattagtgattacttctcaacccaccatctctacaaggcagctatgactcctgttttatctatttatgaaggaagacagagcttagcaaaattaagaatgctgctcagacccacaaacaggtaagattagaggcaggtttcaaaacgaggtctctgtctccagagtttctgccatcacagtaagctgagtctcaactgtactatagaaaaataaatcaaaatgacattttaagtatcatctcttttatttatgcattatgcaggagatggaactcctttcttagatttttttcccccaaatatgctgtgctcaggagctgggaaaagggaaaacacacaccctgggaccttacaccctgatatggtttggctgtgtccccacccaaatctcattttgaattcccccatgttgtgggagagacccagtgggaggtaactgaatcatgggggcaggtctttcccatgctgttctcatgatagctgataactctcacaagatctgacagtattataagggggaatttccctgcacaagctctctctcttttttttgcctgctgccatccatgtaaggtgtgacttgctcctccttgccttctgccatgattgtgaggcctcccagccatatggaactgtgagtccaattaaacctctttcttttgtaaaatgcccagtttgggatatgtctttatcagcagcgtgaaaatagactaatatagtaaattggcaccgggagtggggcactgctgaaacgatacccaaaaatgtggaattgactttggaacttggtaacaggcagaggttggaacagtttggagggctcagaagataggaaaatgtgggaaaatttggaactccctagagacttgttgaatggctttgcccaaaatcctgatagtgatatgaacaataaagtccaagctgaagtggtctcagatagaaatgaggaacttgttgggaactggagcaaaggtgactcttgttacgtttcagcaaagagactagcggcattttgcccaagccctagatatttatggaactttgaacttgagagagatgatttagggtatctggcggaagaaatttctaagcagcaaagcattgaggaggtgacttgggtgctgttgacggcattcagtttcaaaaggaaaacggagcatgaaagtttgcaaaatttgcagcctgacaatgcaatagaaaagaaaacctcgttttctgaggaggaagtcaagccagctgcagaaatgtgtataagtaacaaggagccgaacgttaatccccaagacaatggggaaaatgtctccaggccatgtcagaggtcttcatggcagctcctcccatcacaggcctggaggcttaggaggaaaaagtggttttgtaggcagggcccagggtacccctgctgtgtgcagcctcaagacttggtgccctgaatcccagctgctccagccatggctgaaaggggccaacatagagctcaggccatggcttctaaaggcgcaagcctcaagccttggcagcttccacatgatgttgagctggcaagtgcacagaagtcaagaactggggtttaagaacctctacctagatttcagaggatgtatggaaatgcctggatgtccaggcagaagtttgctgcagggacagggtcctcttggagaacctctgctagggcagtgtggaagggaaatgtggggttggagtcccagcccagagtccctactggggcaccgtctagtggagctgtgagaagagggcactgacctccagaccccagaatggtagatccactgacagcttacaccatgtgcctgaaaaagctgtaaacactcaacaccagcccatgaaagcatctgggagggaggttgtaccctgcagatccaaagcggcagagctgcccaagaccatgggagcccacctcttgtatcagtgtgacctggatgtgagacatggagtcaaaggagatcattttgtagttttaagatttgactgcctcactggattttggactagcatggggcctgtagcccctttgttttggccaatttctcccatttggaatggctgtatttacccaatgcctgtacccccattgtatctgggaagtaactaacttgctttcgattttgcaggctcataggcagaagggacttacctttgtctcagaggtgacgctggactgtggacttttgagttaatgccaaaacgagttaagactttgagggacttttgggaaggcatgattagttttgaaatgtgaggacatgtgatttgggaggggccaggggcagaatgatatggtttgactgtgttcccacccacatctcaccttgaattcctccatgtcgtgggagggacccagtgggaagtaattgaatcatgggggcgagagcaaactgaggaccagagtggttataaaacttgtctgaattcataccatttacaaagtaaaagaagagtctagagcccaggtctcctgagtcctcagaatcaaccaagtcaaataagctcccctattcaaaaagaagaaccttcaagaatattaattttgtgcccatctaaaagcctcactgagctgtgctaaaggtaataggcattgaagaaaacgttctcacagaaactcccagctgcaaacacaaagaagcagctctccagggaacagggtaaggattgtctgaagagatctatgctggtgagattacaaaaatcataatatatgaataaatgaacatatggaaggaatcagcaaagccctctcattcttcccgtatgtaaactcggcctttgcctaaagtcattaagtaaacacagatgcagccaaaccaggcaccagatggcaaacaagaattggaataaaaggtaaagaaagcttttggtgtttactcaaagatggggaaaaaaaccatgatccaaaatgctgtggtttccccagaatggccacctggagtcaccagggcccaaaagtgaccaaataaaacaaaacaaaactagaataatcatgattgggaagttgtaggaaaaccgctgctatcttctgtgaatggaatcccatgtcagaagaaactggttattctgggaaatgaaataaatggttaaatcaaagtactaggaccagagagcaacaggaatgtggcaagaatccacttttgctgggcactcacatctgtccagagctttgtattcttggccttatataatcctcacaattacccattaggtattggccaaattttataaatgaggaaattccataaatgggttgagagagattaggccccaaggtcacaccacaggaatgccatcctagctgtggccagtgcttctttgtccattcccagcttcgtagctctgatttcagtaccagatacaggggaatccaggcacattctctctgcctttcctgcccaaaccactggacctaagtaagaaggtcacctggtcaggtactgccttgaagggagaccagaacagacatggagtggggaacagagcattcctgaaaacttaacttcacctttatttcacaaaagacacccttgcacatgcctcatccacctcttagcttgtacatttgccatgagcaccagtaatgaaggcagtccttgtgaatatttgcttttcagtatgcatgagtttatatattgggggtagaaaattccaataatgtttcagcttcaactaaaagctgtatcttgttctgtccttgcctctaacctgacagattattttttaattgcttggtagagataagtttggcttctgcaaataaactagcaaacatttcctgcccaggctaccaaacacagcctcacctcacctatctggccatatgtaaaaacgttcattcaaataagttttgttcttttgagttttactctcccaagcgcagaaactgggtagtgaggggtgcaggggtatggggagaatggtttcaaccaaaccattcattgcttgcaggtgggaaggtaaggtggaaaatgctttccagctaaacagacctgtctgataaccctaccactaactaaacttgctctcttgggcaggccacattatgctttgagttttagtttctttctctctaaaatgtacgtggaagggctgttttcagaatttttttttcactttcctcttacccatcttctctttttctacatggtcaatctccacgtggctgttttattttttccccattgttctttagcaaagcttaatccaggatgaattcagctttgtggacactataaatcaaagccatacaaccataaggcaggcttctaccactctatactaattgttaccagtctcttagccctggtttctggttgggtttggccaatgggcagccccagcaggaacctggagaataatgaagttgtttattcccccagcgctctccttgctgggttgacgcaggttagctacatccatctaccatccttctacaatggaccacagttcctgtgtgtggccctttccctacaattttgtgcatgatgggaacctctcctccctccctgtcctccttcaggctaagaggttgtaatggctccttactgttggtaatcattaggtacttgtttctttacctaaacctttttaaacaactcttcttgaagcttacttcagttacccaatgtgagtgtcaatctctttcctaataggaacctgaataaatatatcacttcagctcaatttcccattttctacaatgactattatcaaactttgccaatttccatccctgtctttcctctcatgttcagagagatgacctcctgtttattcttagccaccaactacctctaagagaaaagccattagaaagacaactgccattaaatctcccagctttcttagatccggtagtgagctggggctagctcagccctgctcgcaagagcatattgtgcacatctcttcccagcttcacatccattccatcacattcagagcttgaaactggccaagatggaagtatttacaacacagaaattggcaattgataaaattagggctttctattgattatttatcagtattatttatcaacacaccactgcttatatccagatacagtctttttctccttcacatttgttacgatgaaagagatggcccacttattatcagagactctttcatctcctactgcctctaacagcccacttaattcattatccattcactctatgtttagcttcttcaatactatctccttctcatcaacatttaaacatgctctagacctgtgctatccaacagtagccattagttaaacgtatttattgaacccgcgagatgtggctagtccaaattgcaatatgtaagatacacaccagatttcaaacattttgcatgaataaaagaatgtaaaatatctcataaataatttttgtattgattacttgaaatgatatttggggtataataggttaaataaaaacatattaaaattaaattcaccagttcacttacacttttttaagtgggtactagaaaatttaaaattacttgtgtaaatcatattatttctgttggacagtgctgctgtaaacctttcatcttaaaaataaaatccctggctgggcacagtggctcacacctgtaatcccagcactttgggaggtttggatctgtgtccctggctaaatctcatgttgaattgtaatccccagtgaggagggccctggtgggaggtgattggattttgggggtggagctcatgaatggtttagcaccatccccccattggtaccacatagtgagttctcaggagatctggttgtttaaaggtgtgtagtacctccctccacttcctcccgctccagccatgtaagacgtgcttgccttctgtcatgattgtaagtttcctgaggtcttctcagaagcagaggccactatgcttcctgtatagcctgcagaaccatgggccaattaaacctcttttcttcataaattacccagtctcaggtatttctttatagcagtgcgagaacaagctaaagcaggaagattgcttgaggccagaaattcaagaccaacctgggtaacatagtgagacactttctctaataataattttttaaaaattgccaggcgggcgaggcgcggtggctgacacactttgggaggccgaggcaggtggatcacaaggtcaggagatcaagaccgtcctggctaacatggtgaaaccccatctctactaaaaaaatacaaaaaaattagccaggcatcatggcaggcacctgtagtcccagctacttgggaggctgaggcaggagaatggcttgaacccggaaggcagagcttgcagtgagccaagatcgtagcactgcactccagcctgggtgacagagtgagactccatctcaaaaaaaaaaaaaaaaaaagccagtcaccgtggtgcatacatgtagtcccagctgctcaggaggctgaggccagagaatcagtttaacccagaagttcgagctgcagtgagctatgatcatgccactgcactccagcctcggtgacagagcaaaaccctgtctcaaaaagtaaagtaaaatcccttcttctgcctatcagctcccctagctgttgcctctcatggtcaaggatgctttaaaaggtatctatcctcactaccatgatttttctcaccaccacccctgcctccttaactaaggcagatcttccttccgctacagaaattccaccaaaatcatgctgcctcagtcattagtgctgacccaaggcattgctgagcccaaagggcttttcaacccctactcagctttagccttggcaacattttgcaaagtggagcactcccttcattgaaacacgcttccactgacaacatattttcttgatttccctcccgctgttctgaatgtttctgcacaaattccttttctagttttcctttctcctctccccaatattatatggtagtcttatacaggaatctgtccatctcatctacttctaaggattcatttactatttatatgccagcaggtttacacctatctatataacatcttcacttaaagggcttacagccatctcaatctaagcatattaaaatctgaacccaccatctccacctctgcctgaaaaattggcactgttcccatacgtggcactatcaataaatggcaccacgtgtccttactcactcctggcagaacctcaaggacattctgagcccactctgtctttctgctccacatcagtctctcatggtgtctttctaaattacatttcatgtctcttgaattcttccactttgctttaattctaccatcaccatccttttgtctcacctggactgctccaaagaacttttgaatggtttccttgcctccacttttaccattctttagtttattctctacaaaactaccagagtgatctttaacaaacatgaataagatcactcttgcttaaaactctccagtggcttctccttgactttggcataactcaaaaccttttaacatgatttacaggaccatccaaaatctgacccctgccttcatctatagcttcatctcctatatgctttcccttcattttatccagtcatcttggacttctttaggtcctttaaatgtatcatgttgtctttacttaaggccttcagatatgcatttccttcagtctggaaccttcctcatcaactttctttacccagccaactccttgtcaaccttcagctagttccataagtttccatagtagttttgtcttcctcttcctgtctcccatgatcaccgatgtttctccagcaggctttaaacttcatgaggtcagggatcagagctgtctggttgcctcctctatccatattgtgtagcacaatgccttgcacacaataagtactcaataagtatttggttgcacaataaaaatgacattatctggctcaaacttcccattttgagaaagaggaaactgggatccaaagaaaggaagcaacttattcaaaacaacagagcccaggctaagattaatacagggctggagcctcctaatttccagatcttttttttttttttccagcacatcatgtgcctatctataatatggtaaccagaaggaagcagactggattccctgtgtcttgtaaaagccggagcaagttcttatttgtaaacacagctgacatagttgttttctttgtttgttttaagtaaaaggactggaagtacaacccaaaaataaactttgtgtttccaaaccaagaagcttctacaacttttatcccctgcagcctcctttctgtccattgttcatcttccttcccttcattaaccacaggcatcagctgatattcaatgttgaatggtccctgcattctgtgttctttatcactcccctgcccaggcagcatgtcacatgcagcagcagattaggaagtgctgtctttaaatagtatcactcaagagaacattacaagatcctgtgtagcgctggggtggagattgatgtaataatttttagaataaaaataactcacatttttgaaactattagtttgtgactggcactaatttcagtggtttgtatgcattttcttttttaactttatgagtaattatttctattacttctattttacagatgagtaaactgagggacaaagaggttagttaaggcccaagccattctgttttgtttgagacagagtctccctctgtcatccaggctggagtgcagtggcacgatctcggctcactgcaacctccgccttctggattcaagcgattctcctgcctcagcctcccaagtagctgggattacaggcacctgccaccacacccagctaatttgtgtattttcagtagagacagggtttcaccatgttggccaggctggtctcgaacccctgaccttagatgatccacccgcctcagccttccaaagtgctgggattacaggcgtgagccactgcgcccggcccacccaagccattctgttagctagtgaaagagtcaaagttctaatctagccagtctagagcctgtgatcctaactgtctgacatcggacaatgaagaatgtgttgacctggcaggaaataccaaaaagtacaactgagggagatcctaaacttgctttatacagatatcctggatcctacccctgattcattcattaattcattaatccatttactcattcatttaattctttcaacatgtatttattacatttttgcattatttatatcaattttggggaatacagagaaagttaatggcttctaccctttgacatctcacagtccagtggggagacgtaagaaaacagacatttatcctactgtgtgctgaatgataagacagaggaaaatcagtgagctttgggaacatggaagagattataaacacataataaagagagtttaaaagggcactacagtgatttgctttggacctgcattccacacctgtcactctatctgtctgacctctgctctctctatgctcctggcttctagcccttctcttactttggtaccatccttagcctctcaactcctggcttcagattcgatgtctttgcttgtctttttcctctggaagttggtttggaatggattctggcttggctagagggtttctgtatcgtaaacagtctaaggccagctccaaagtctaggccagaatatctaggccccactaccaaaatggctctcgcttagaagaattggagatccaaaagcagggaacttgaaagagcatggagggatagatggatggatagattccttgcctcttagcttcgattattcacctgcctaaacccagagcagttggcctagtgactaaccaacatcccttgcagctcaatcattattcattatgttaatattatcacacattttgattctttgctgtcgatttggttgctgatctgctggccaaaggatcatcatgggaaggaattactattgaagcaggcagtgcaaatttcaaaagtgttcagaccctgcggcctttcatgatatttcactttcttgagttgcagtctcccattggcctgctccttccgaagcagattttgtcccttgtagccataagtgaagcatatcctggctaaatgtttctgtggactgaaggtagctattgaattgggcagttaagagaatattgcagattcttgtcggtaaatgacacaaaagatgatggactctaagctagctatggaagaaattagagccagacagggcacatgaattgaaagaaaatgaagtgatggagattctggaagttgctttaaagtggagaaggacatttgctaagaatgatagagtacatgagagaattggactgaagggcaatggaattcagaaagtggctgttggtatattgtaatattcataagtatagcagtctcaaggggggctgtgggagtattgaagtgaaatggagatgaaggtcccggaggtggaaacattttgaaaccgtctaacagtggaacattggatgggtcttatgagcagatgctgaagttgtccaggacaatgataaacctccaggtagatagggaggcttgtgatctaggagccttagcctcatttaacatagggacagaaacaagaggctgacagtgacagcagtgagatgcaggggagacatgtgtcattgtatctccatcattaggtggcataaacctcagaggaacaggcttttttgcctgcaactgcaggaatacttgtctggaaatgataatgaggaggcctgagaataatgactgttatcaccttccccaacccacctgaaacatacacacatggcaacacttacctttcaataaagtttctgggaaaataaagtttatttcagttgataggtacatagtaataataacaatatctgcacttttaagcatttagtccatccaataggcctataaaataggtattaaaacttccctttttttgagacagcatcttactgtgtcgcccaggctggagagcagtggcacaatcgaggttcacttcagcctcaacctcccagactcaagggatcctcctatctcagtcagccttctgagtagctgggcctacaaacacgtaccatcacacctggctaatttttattttatgtttttgttgagatagggtttccctatcttgcccaggctggtttcaaactcgtttcaagcgatcctcccacctcagcctcccaaagtgctgggattacaggtgtgaatcactgcatccagcctaaaatttccatttttaaaatgaggaaattgagactcaggatgttcatggcagaactagggtttggattatgatctaaatatcactgaagtctttgtttcacagcaaatgtttaaaagtataggttccaaagccatatgttttcttgtctttgaactgggaatacaaactaggtaacgtatttaataatatagtgctaggccatagtaagtactcaacaaatatcagttgccattataattattgttattgagttactattatttaattacagctcacggcagtactatataccttctcagcctcacatatcagcaagatcatatttttttccagtcaacaatagattattagatgagtgacagcttgcagttttggaacctatcatctgtctgatgcttttagcaagaagcttcctatttttactttgagaaatccataagaagtaagtcaaactcatgtagatgggatgaatacttgctccctattcatgtttggatccaactcttttgcagccaggccatatattaggaccccatctcagagtatcacaacagaggttgatggccttacctagtataaaaccactcccctgtgccgtatttgcccatgactgaatcggaatgaaactttcccttgctaggaaaacactgtgggtatattctctgtcggagtgtgctgagcaaaaccctaatagaatgtaccgtgaggaataaggagtaacttgtcaactgagagttaatcagaaaaccacatgtgcacaaaaccaacagattgcagagctggcaaagacttcagagataatttactccaaccccctcattctactgataaagaaagtgagtcccagggaggggaagggtcttgctcagggtcatacagctggcagtaattttgtttgtttcaataattaatatgaacagtcattctatacatcagtgaatccaccttcctgcctttgtaagcacaatataatgaccataattgaatttgtctttgacagtgaagaaagcaggcttttagggctttacagggccccaaagtcatcagaagaaaataaattgtcatgaactaaagctggagatctgcctgttgactgtgagcttcttaaggaatgggcctggtcttattcatgagctaaagcaagtttcaaatcctggcttagccctttactagcttaagcaagtacttaacctctctgagcctttatttcctcattgtaaatttaaataataagaccttcctcagagactgttagtgaggatcaagggaggcaagatctgtataccagtaccttgcgtaaaataggcattcaataaacttgcactttcaccttacatttaacaaatgtcctgctaaaagctagggatacttcaaagaaaggaaagccaacgactccactttcatggagcttagattcaggagggaggagagcagaggtgaggaccacagagaagcaggcagacaataaacaattaaaaatataatttcagatgatgatgtgctatcaagggttatgaggaaaagaaaatgagatgatgtcatagatgtttaggagagtgcactgcttctgctaagagtggccaagggcagtcttttcaatattatgtttgaagagaacctaaatcatatggaaaaagccagacagtcaaagatcctggagaagaccattcctgagagattcagaaaggccttaggcaggaggaaggttggcatgttcagccagcagcaagatggccagtgtgttcccagcatggccagcccagtaagcagggcatgagatgagactggagacatctgcataaactccatcctgaagttctagtccaccctatgacatttgagttttattcaaaaagcgatggaacactgttgcaaggacgtgttaaaaaataaatattggtctttgtccctagttcctggcacacagcttctaaaattcttggaatccctgctaaaagctagggatacttcaaagaaaggaaagccaaggacttcacttttatggagcttagattaagctccatgtgtatggtaatgagatgactgatggctgagaacccctccgtagcatcaggatgggggctggtcaccagaaagaccaaggcatgattagagggttgaactttcagcccctcccctgaccttccagaatgagaaaggggctagagattgagtcaatcaccgatggccaatgatttactcaattatacctaagtaatgaaaccttcataaaaacccctaaatgatggggtttagacagcttctggattggtgaacacagggaggtattgagaggatggcatgcctggaggaggcatggaagctcactgcaccactgcacctccctcccctcataccttgctctatgtatctcttccatttggctgttcctgaattttatcctttataataaactggtaatagtaagtcaaccgttgtcttgaactccataagccgattctagcaaattatcaagccttggggggtggagtttgtggaaacctccaatttgcggtcagttggtcagaaatacaggagacccaggacttgtgattggcatctgaagtgtgggcagtcttgctggactgagccctgaagctgtggggtctgacactaactaactggggtcagtgtcagaattgaatcaaatttaattataagtcatgcaattggtggcaggagagttggagaattggtgagtgtgaggaaaaaacccatacatttggtgtcaggagtgttgtaggtaaaaacagcccagagaggtaaaatcattcattgattcatttaacaaatccttatagattaactattctggccaggcacagttcttggtgtggtgcatgaatccaatacacacccctggccacatggagcttgcatgctaaagggataataaatatctaaagtttatgtagcatttactatatgctggcattgttgtgttttacctcaaataactcacgtgcttctcatagcagtcctatgaaaggcatatttttatccccattttctgatgaggcaacaggcatgaagaaattaagtaattattccgtgattatacagctagtaaatgtaaaaatccagtttcaaattctggcagtctgttatagtcagtctgtattttaatcactgccctttattttctctgcttctgaaaaatcacctagactggtcctgactgctataaggggaaccaaagtggaagtcaagagaccagttaggcagtagtggtcagagaatgggatactggaattttcaacaacactgagtagatattattattcccacttaataaatgggaaaactgagctttgattcacacatctgataagtagcagagcctggatccaaccccaagcccatttatctctaaaacccagtatctttctgctaatgcctccatttcctacagaattataaagcttccactcctcccctcctttatgaccaagagaccaatttgaggtatgttttagagtcaaaattagaggactgggcgtctaaaaatttttttttctcttggtaggcatttttataattgaaaataaaataaaatataaatatactgacatgcagttctgttttctcattttcttttgcaaactttaaattgagatatagtacacataaggtgaaatacaaagatattaatgtacagcttgatgaattttgatgaagtatacacccatatagtcaacactctaaagatatgtaaatgtgtgcacatagtgtacttaaaattataaatgaggtgccagttttcatatcatgagtaatgataaagacctctcccactctctttttctctcatcccttcctgcttctcaattgatatttttgtctccaattcatgggggttacacagaataccaggtgcaggtcaaaagatgactgtgtcaaaaggaaaagaaagcaaaataaataagagaacaactagccatttcttaatgcgtgttgaaggaaagtcacattgatatattttctgtttttctatggaggggtcacgtgcctcagcccacacattagcatgtgaacttgttgttccagtcaaatgagtcagagttcctcaggaaggcagattcctgtattttagagctatgtgtcagcatctgtaaaaaaaaaaaaggtacagtgtcctgtattgatgcatctcactgatacacacgtgctcgtctcactccaggtaatcacacctgctaataagcagcagaagtaggatttgaactccagcctagggcactcaagaatcaggctgttttcatgacagggagaatggtaccactgagtccgaatgtagggtttgcaatggcctggagtcagaagtgggcttgaattctggttttactacataatggctttatgaccttgggaaaattacttatattctctctattttcagttcctttattcacaaagtggtgatagatgatctgtgtcctaatgtccttttgagggttaaaaagatcatgtacttaaaataatcagcacagcacagagtacaaagcttaaaccagtaaaatggcaatggcagtggtagtcggcccctaagtcaacagacaccacagtgttttttaaccatatacccccatcagttaaaataaattttgagtatgcatcctcagtacatgaaaacctatttatgaaaaagcatgatgtgctatactgtgttcatagattatttactctataaaacaagtgaaatatagctgaaccaaagtatttccaatgtgtttacctgtcatgatggcttcatgctaatattagcaacatgtaaaagtacactatatgtctatggccaggtgtgtttttaataattttaaaatgatttttgatgatttttaaatgattttgtatgtgcctatgtatcgaaatctaaggcaatcttcttgataattttgattattttcccaatccttgtcttatttgactaggtcttcattgtttttaccttacaatatgaggagctagtactgagtaaatacatcaccattttcttgtttacttgaatctgaatggtgaactggtgataattatctccatcacgtgcaaatccattgactgaatcttttttagctgcttgtccattttgtgagggttagtttaaactagttaatacctattaatcactaacctggaacatgcaaacgacaacatgtagcaattctggaagctgaggacatataagggagtgccatagggccatccctggagttggagagctcccactctcctcacaagaacctcacacatcttatgtgactcatgactgactgatgtgtggccaaactgataaattgtctagtaacaatccatatattaaatgctggtaaagtgtaattaatttcttaagaccaaaaaaagtcatataaatggcacttccagtattttcttctggaatcttaatgagaattccctggagtttatggatgccacttaagaaacactgccatcactttttcctttggcaactctgcaaacactaaccaagcacctgtaagtgctaggactgtgctagacattaggcctacagtgatgtgatttctgccttctgggagttcatatatagcttgtttccaccacactaagttctgctatattctcccctatagatggtgactctggaattgcccagcttgcagtgccctgtagtaccttgggctagactactgacagtcttccccaaaaggcttaagcccattattccccttcctcagggtaggggagaaggtactagatcttctgctcccaaaattgccaacatcagtaagtctaccactcatggaatccacatcttttccaagggtactgaagaacccatggcttcctttaacctcatttccctggtaactcactccaacatggcctacagccctttggtagctcccaggccaggtcattacagtgagaattgggtgtttcccctggccacatgcaggcctggctgttgccagtgctgccacaagagaagtggtgagcagtgtgtgctgattagtatctcagcctcgacacaccagggaagggtcaaacccatgaatgcagtctttcatggccgtggtacagggcccctattttttcctccagaaacccttcacttgctttcagaagtgatgatcaaatgtgaactttcatggtttatttatagctctgccttatagagagaaagaaaagaagtgattaaaatgctattttacaaaatattttgtttttaaaaagctttcattgtgtgggcaaaaggaaaaagaaaagtcactgtattaattgtgctgtctagactctcaaacaaagagggtagcgtgctgcaaattaagattgtccggctcctgcctgctgacaaaaagtatgaatttggaggccaacttcaaataaaccctttggaacagaaatatattgtgggggtgactatatttagcatgtgtcagcatttccatactaaattcatattgttatgttgtggtaatttcagatttcctgcagccaagtgggatcatgagatttcagttttatgttaattatttggagaaattgaaaaactcagcagtgctgtttctgatgacagcactgattctcagggtattctccacgttgtgtcagggacccataatgagccctgcctttcaggaaaggggaaggtgagcccgagtcattttgactgtctttataagcataactttaaatatatatatatatatatatatatatatatatatatatatatatatggcattacatgttttccctacaaatacaaaattaatatatgccactgtagaaaatttagaaaacacaataagcaacttgacaagaaaaaaaaattgttacccatgctatccaacctgttaacattttaatatatattgatccgatctttattatgcatatataacttgtttttatatgcatatcttgtttttaacttgtttttaacaagttatatggagcaaacaaaaaattatgtagcacaaacatgattattgagatagaatacaaaattataactttattttctattctcattatccctttgcatttgtgcagtagagctagtttttccctgctctggttaaaaatcctggtggttccattacttttttagataaatataaagtcacttagataatataacctttatggtcctttaagttgtgagatgtagccaaaattcagaaattcaaatatcaaagaatatgtaaaggtaaaggtaagatgttttccagttcttccagctggagtctgccagaaacgagacatagccctaatcagattcttctttcttcctcattcactttctctccaacatattagcttttttcttgttcctctgaaatggttagaaagtataagggaagaaaagttagtggtgtaggaaatttcttatctgatcagtactgtcataatgggcttcatgctctcttagccttataggtgtttacagctagctctgattctcataaggcacatcatagatttttggggagaccccctgcctctgaaaacctctcgcctgaaatattgttgtcttggttaacacctgtctattctcatagattgctcactactcttctcttaattcctcaggaatcctttccttttttttttgttgtttgtttgttttggtctcttttttgtttggttttgttttgagatagagtcttgctctgtctcccaggctggagtgctggagtgcagtggtgcaatctcgattcactgcaacctctgcctcccaggttcaagcaattcttgtgcctcaccctccccgtgggaccacaggcacatgccaccatacttggctaattttgtatttttagtagagacggggtttcactatgttggccaggctggtcttgaattcctgccctcaagtgatccacccaccttggcctcccaaagtgccaggattaaaagcatgaaccactgctcccggcccaacctcatgcttctttatggtgactgctccacctcgttaggtggccatgttggacaggatctgagaacccctggcagctctctcatacatgggccacttggggtctatgggaaacctttgtcttttggatctggacagactctggcagtgctggttgatcccagggtaacctctacttcacttttacactgcagctgtcagccagcctgtctcttccagacaggagtcacatacaagccaccatgtgccacaacctcagggacatgcagcagattctctgctggtctgtgtcttcctgactcctgaagggagaggatctcttcatacttcaccctggaaggaggcctgatgtgcagtaaaccaacagctctttcctaaaaatccatctctgtctgaccttccacatcaatgaaaggtttaagagttgattaatgggtcctcaggcacccttcttgcacattcttcagggtggtctgtttccagttcactttggtatcttatatctgtcatctttagatctcagccaaaacttccattttaacattccgtcacgtgtattatccttaagttcattcattccgtagacattccctgagtgcatacgatatgccagatgccgagtttggcagtgaaaataattataacaattcctgctttaaggcgctcacagtctagttggggaggctgatctgttaacaaaaaaatatggtgccatgtcataaacgctatgatagacggaagcagaagttgctgttggagcacataactcaatataggtgggaggcaggcagcggggatgagtcagaaaaaaatctcagtagagctgatacctgagctaagtttaacatttaaatctgtactttctgagaaacagcataacctctttttaaaccattgaaatctctcttgctgatgtttgcttctcaatttatttttaaaacaagcaaaggtaatgtggagaaaggagggaagaattccctgatgtctgccgtttatgtgcacatctgttgcagtgggaaggaaaataacatttatggagtaccttctataatagaagtttcctggatcccacccatgagggcgatcctggaatgttgtctcaagtgtggggccaaagcacagccaggaggagcattccctgagggcagtttgaagattcagagctggcaatagaaggcaaggtcctccctaaagcacagcagagcacaactcaaggaagagacgaaaaggacaaaataagaatgagtggcacggttgatgatggggattgctgagaccatctcaacaataccccggcttgctctaagggaatcaggacttcgtctttgaaggaaactgttctggggtaagcagagctcttaacatacctctgctaagtggaatggcagcatgttcactaagatgtgtttgaccatttggccctccacaaaatgactccagacagcccttttagtcttcctctttctccatggtttctttgtcaataatttttcttcattaaaaaaaatctcctccctacttaaggctgccatttctttctgttgtcattgtgctggctactcttagcatctctgatctcccaatcagcacattcacatccattgagagctgggaagctagatgtctagttcagaatgcacatgctatccttgtggaagagtccatagagcaacctagcaggagtggaaattcgtgtaagctagcagatgaaagaaccatcaggttacctaacccttgaataactactgaaagaagtttatccgcttctagcgtagtatttatcacactctattttgatcacagtaaatgtcttttccactctatagtgagctctttgatgaaaggcccatgcaatcttcctctctgtattccatgtagattgagtgttatgcttggcacgtgaaagggaggcaatatgttttatgaatagtccaggtgtcgagacttagtagtaaacagacaagtccttgccctgtgtagcttacattccggttagggcaaggagtggagaaggcagacaacgaacacataaaccagtaaatatacaaagtggcagaaggaaattagtggcatgcaaatcagtcaatcagtcacagtaaggtggcaaagatggtcaggggaaacacttggaaatgttttgaagatacccaggggctctcatattctgtatggtattcagattttttttttttttttacattttttcctcccttactagtatgtgagtttctccaggataaagagtatgtcgtatgcaaatctgtatccctagcagagtgtgtggtacatagtaagtgattaataaatgtgtagaataagaagttgtacacatgtgatcccagaatgactgcatccttagcaataggaattcaatagccgttcctaagactgagcctatgctgtagagctttgtcgtgctgttgcttgcaatcttccctggccaggtctgttggactccaaagtttactttctcatggccttaacagccttaggagactgcttaaaaaaacctaacccttctgctcatatgggagccaaaacaatccatggttaatcttgatgctgcacctaccataccatgtctacccagatgctgtaacatgtcatctgcctgagtgccccattgtaaagaaaagaatgtcctgaagtcacattccagaactcaagtcacttagactcagcccggaggtctcagtatgtactcacaacttcagagattgctggaaaaagagctgaagttgaattggagaggtcttaaatattttatcctcaagtacaggtgcgaagtgagttccattccgtgattgctatctttagggaagtagacaatgtactcagcggctggttatgttccctgcttctgccctgtgtccagatagtgaggaggggaaataattcttcccacttacccctggaggcagtcacagaactgctttgccttttgggttgtttatgccccagaggcctcaatacacaagtatttattaagcccaggaggtgtggtcataattgaaactttaaatgttcactgtgttttattcctatttttgtgttttattcttattaccaaagaaaagtaagttgaaaaaaaagaggactaaccaaatatcttaaagggaagcaaattcaaattagaatgttttgcctgtgacaagcctcgctttggatttcgctttccaactcagctgtctatgttgttttccatttaataggaagcaatggcaaaaatgagcaaagttgggaaagttgtgttcccgagactacaggataaaaagtaagtgtgtattttttatatgtacagtgctaaggaagtgagcacatacacacacacatgcaactatagatctggaataaactcaggtggtcaactaatccagtcctttaatttgtggttaagaaaactaagttccagggaggtaatgtcaccttcacttacctaaggctgcagaactatgtagggccagagctgggggtgaatgtaagcttctgaactctcagaccaatgttctttttcccaggtaattggcagcaaatctgctcttctctgttctaaagtagggatctcttatatctccatcaaaggacccagtagaatctgctcattcttttactctttgtatcacttggcatcaaaggctaaaaaatgacattggtcagtattttaatcccaattcaacaaaatattagtttactgaattcctgctatattcaaggcattatgctgggctccaggcaggtgttacaggggaataaaacacaatttaatttaggcacataagattattttagaacaacgggataagttccacaattgaagtattgccaggtgacaaagttgcccaaggaagaaagagatgggagcctgtagagatgagagaatgcttttgggaggaggttatgtccaagctaactttaagctcttgtaagaaattggtagacaggccaaggcaagaaagaacattcatagtagaaggaataacatgtacagttataaaagtgggagcagcatagtacattcaggttactataaacaactcataatccagaaacacaaagtatgagatggggaatggcaggaagtgggactagggaaggatagaattgggtagggggaggtcagctcataaataccttggaggccatgctgaagacctccaacctcatcctataggcagaacagagatgctgaattctaagcagtggtgagatctggtcagatgcagatcagaaaaatccctcttaaaggatccagtacagggggctcagggtagaaatagagggtccagataaaaggctttttcaagaatccaggctagagatgtaaaagacctctattaatttgctggtagtgattttgaagatgaaggggctgttgtggaagtgcttttataattttagggaagtattcgaggttaagacctaaaagcaaattccacttaacatgatgaacaggcaaatgtgcagatcccactgaagcaggatcagtatttaacagaattggaaatgttcatggaaaagcaatccactttcttttcatttcctttaactccacatagagtcaggctgctaaccctccgaatataaacccttctctaaaggccagggtggaaggtacaggcattgcgtaggggagctccatgcaggaaggtggagagatctgagttcccactggcagtaggagctatgggctgctgtccctgtttctgttccctggaggcagctggagcatccctctttttgtgaaattagaaagattgtctttctccatctcttccctgaccctcccaagacttttcagggaagtttttaagttttttccgtaaaccccacgtgttcagagagtcctccgctgcttgctgggagctggcagctggcagctgttctctgcgaaggaggcggcacacacggtgctttagcaccatctgcaggcaacccagagatttgcaaggagacaggagaagccagtttccttctgagccaacctcatctcattgcctaatagatcacactgttaacgatgtgggacgacatttacttaggcctctgccacacagaagcagggactgagttgaggcacattttgaagagaggggattcagctgattttaaaattcacagtcacggagagtgtaatttagtgactatagtttaataataaatgtttaggatgaccccaaattgcattattatgttcagtccaaatttatatgtggctctggaagagtcacttaaatgtgctttgagaaatttggtgcattgaaagacactatcaacagagtaaaaaggcaactcacagaatgggagaaaacatttgcttatcatacatccagtaagggattgatatccagaatatataaatgtataaagaactcctaaaactcaacaacaacaaaaaagcaaaaacaacccaattcaaaagtgggcaaaggacttgaatgaatatttccccaaagaagatttataaatgaccagtaagcacgtgatagggtattcaacagcactattaggaaaatcaaaactaccgtgaggtaccacctcacacattaggatgctactattttaaaacagaaaacaacaaatgttggcaaggatgtggagaaattggaagctctgtgcatagttggtgagaatgtaacatagtatcgctgctgcagaaaacactatggccattcttcaagaaattaagaatagaattaacatgtgattcaggaattgtatttctgagtatatacccaaaagaactgaaagtagggtatggaagagatatttctacattcatgttcacagcaacattattcatgatagcgaaaatcatgagagcaacctaagtgttcattagtagatgaacatataaatgaagaatgatatgtgcatacaatggagtattattcagccttagaaagaagcaatttctgacatgccacacatcagtgaaccttgaggatattattctaagtgaaataagataaccacaaaaagacaaatactgcatgattccacctatgtaaagaataaggccagtgcacaaagttgtggcaaagttgtcagtattaacattgtaaatcaagtgtgtgtgaaggggtgctcaccttagctcccttctagatattttgagattctaaagtcaagaaatctatctcatgtagtgaaagaattccttaccgttatattgtcacagagcatcattagtaggagcaaattgttcctaaaataattctacaactaataaatttggatgctcatagagtaggtcttagtagtacctacatatagctatattgatgatattaaaatattaattatctaaaatttagtaactagcatttatatcacttattatgagtcaggtactgttctaaatgcttttcatttatttccacatttaatctacaacagctctgctgaagtagatcccataattatccccatttacagatggagaaatttaggcagaaatagtttaagtaacatatccaaagtcacacagctaatgttaggccacattaagattccaacccaggctttggagttcgccttttaaccctgtgcttggccccgtcacaactcctacgttaccagaatgcttacagtctaataaatattgggtaggggactcctactaacatagctatgtgtgacaagtagaagtccctgtgtgtatccaaggttactcttacaacctctctctgccaatgcacaactttgcaccaaaatttcatcatgaggactccttttcagagcaccccagaattgagcaagacatgctaaactggcttcttcaccccctcaccccatgtcagcttcccaaccaagaggagtaaggacaaagttgcaaggctgcaagtataatttgtctcggttcctattattcctttcaggattatgatgccagagcagcttcagctgttctgctgtctgattcatggccaataccagttctaacaggtctaacccaaagagtcagccagataggacagggagagcaacggccactgtgagatgtctggaaggcgagcacagctctagaaaaggcattagctacatttccatggggttttgctcctggataaagcaggtcacaagggaaacctagatgtggaatctgcaaaagggcaattaaaatgttcagtctttgtccttggtcaggctgtgattttaggccagtcatcaaacctggggctagttatataggaaatacttattgaagctggcaatgtgaaagagtctccattaagtccggcctttttgtatatacagtagaagctttgaagtcagacagacatgagtttgaattccagctctgccagtttttatctatactactttgtatatgcctctcatttaggaatttttttttttttttttttgatggagtctggctctttcacccaggctggagcgaagtggtgcaactcaaccacttcacagtgaacgggggacggttcactgcaacctccgccccccgggttcaagcaattctcctgcctcagcctcctgagtagctgggattacaggcgtccaccaccatgtctggctaatttttgtatttttaagagatggggtttaaatgttcttatttctaaattggagataataaaacttcatccaggtcacatataataggtctgaaacatgctaattcattgcccaggatgctgtaagcattcagaatctaggtgtcagcatcaccaccacacatatatttccattcttctaaatgtacagggaagccctgtggcagttttgtcttgagatcattcaacatatttatatttctcccacagatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaaccagaa

SEQ ID NO: 1382 - DNA, 465778 bp, Homo sapiens; identical to SEQ ID NO: 1381

SEQ ID NO: 1383 - DNA, 452654 bp, Homo sapiens
gaaattttgcatgatcgcatggagaatggattttgttgctttatctgatattgtcctcagctcctcctgaatttgccgagatcttacagcagtcagtaaggttggtgagttctttcgttgttttaatttgagtgactttctgggaaaaactgtggatttcggccaatatgctgatgataatagcattgctttgaaggtcttgttctgtagaaaatcatttcatagttaattatgtcagcaaatcaacagcaacctcttgaagaagaaagcagtgaggggagaaactgtgtatatgtttaaattattcagaactcaaagagaggtcaggaattcacatttcaaaaggaggagtctatgtaagaacaaatcattaaatttgcatatcttttccccattatgggcctagttttgtaattggcatattagggattaaaatgaaataaccctgcatttagaattaggaaatgactccccctgtcccccgactatctccctttctgtctccagggtcctggcacaggagtaagaaactatcacatttaaatgtctgcatttagagaactcagggtgtccgttgggtttgtagaagatggactgactctgttgattcacttgtcgggtggaccctttctccatcgtccttctctcctcagtgtgtgttcctatttaaatggagccccctgcttgggagggagactgctccaaagaggagcatggtgcttcagccacaagccacatagaaggcttgctcataatgctgctagaactctgcagaggaagaaagttttttagggtctttttattttaagagatatttgactattttatatattaataatcctctcctccttcacaacccagtaattccccttattactacattacaatacattgtgctcatacaaggaaggtagggagcagagcattttcagttaatatctaatgtttcccacagtaggatttatcgtgacatcaggtagtctgtattaactggatcatggagaaggcatttctaatgatcatctgaaaaggcttcacaggattaacagatttgaaacttcattctctgtgtgcccaggacacaggcagcttggttagtgtggaaagccaagtcatttcagggatggtagaaagagttcagctctggctgataacaaacctgaaattttttttttttttaaagattcttttttttcaatattttactgtaagttccaggatacatgtgtagaacctgcaggtttgttacataggtatacgtgtgccatggtgatttactgcacctattgactggtcctctaagttccctcccctcgtccccccaccccacaacaggccctagtgtgtgttgttcccttccctgtgtccatgtgatctcattgttcagctcccacttatgagtgagaacatgcggtgtttggttttctgttcctgtgttagtttgctgaggttgttggcttccagcttcattcatatccctgtgaaggacatgatctcattcctttttatggctgtgtagtattctatggtatatatgtaccacattttctttatccagtctatcattgataagtatttgggttggttctatgactttgctattgtaaacagtgctgcaataaacatatgtgtgcatgtgtctttacagtagagtgatttatattcctttgggtatatacccagtaatgggattgctgggtcaagtggtatttctggttctagatccttgaggaatcgccatactgccttctactcttccacaatggttgaactaatttgcattcccactaacagtgtaaaagcattcctgtttctacatagccttgccagcatctattgtttcttgactttttaataatcgccattctgactggcatgagatagtatctcgttttggttttgatttgcatttctctaatgatcagtgatgttgagctttttaaaatatatttgttggctgcgtaaatggtcttcttttgagaagtgtctgcttatatcctttgcccactttttgatggggttgtttctttttgtcttgcaaatttgtttaagttccttgtaaattctggatattagttctttgtcagatgggtagattgcaaaaattttctcccgttctgtaagttgcctgttcactctgctgatagtttcttttgctctgcagaaactctttagtttaattagttcccatctgtcaattttggcatttttttgcaattgcttctggcaaacctgaactttaatatggctttgtccctctaagggctttgtgactatcaacaggatattgactctttcaacatttcagtttcctcatgtagatgggagaaacaacatatactttggtaggtgttataaatgtggattctcctctccttttctctgtaaagggaatggcttggtaggtcaacagaagaaggcattataaacaagtaaatgtgctttattggaacacaagggttgaacagaacccttgggagggtgtaagcagggttttatggaagatggtatgggagatctgaagtttaatttctttaaggggatgtttgttggtggagtttggggatgtcatttgatgagtcagattttttcatccatgatatctttaggacctgttctgtgcatttggcttcagccaagtttgggttttatgtttcccttgtgactgctgttggacattacctgtgtggctcttggaaggttatggtttttggccaccattcaagatggttcaccatccaaaactggctcagtttggattcttgtggctgccacattgtgaggcacacatggggatttggtaggttctgtcttttctgccttttggaatccaactttaaatttaaaaggatagccaacttttctactgtctttctgatttaataccatgtccctcttccaatcatctgttagtctttacaaatgggctcagtaaagagcataaggatccccaaaaccctgaaaaatactgagtttctgacctagttggtcagaactgttggaacagtaatgagagcagtaaactggtacctccattaactgctgacttgttgctgtgtcctcacatggtagaaggggcaagagtcttccttgggcctcttttatgaggatactaatcccgttcatgaggactcctttttcatgacctcatcatctcccaaaggtcccactttttaataccatcaccttaggggttaggtttcaacacatacatttttggaggacacaagcattcagaccataacattagactgtcagtttgttaaaattagagataatgtatttttcagccccttattcctagcatcctggcatagtgaaagcacttaatatttgtttgtttactggaaatcaagctgttagatatggcgagaatgcctaggtatagataacacatattaaaagatgtgggtgtcagcaattgcaaaaatgtgaaaacaacctaaatgcccatcaatcaataagtgggtaaagaaactgtgatatatgtatcacacacacacacacgcacgcacacacacacacacatgatggaatactactcagccataaaaaggaatgaattaatggcattctcagcaacctggatgggactggagactattattctaagtgaagtaactcaggaatggaaaaccaaacattgtatgttctcactcataagtgggagctaagctatgaggatgcaaaggcataagaatgacacaatggacattggggactcagtgggaaagagcgggaagggagtgagggatataagactgcaaacaaagttcattgtatactgcttgggtgatgggtatatccagatctcacatatcaccactcaagaacttactcatgtaaccgaacaccacctgttccccaaaaacctacggaaattttttttttctttttttttttgagacagaatctcgctttgttgtgttgcccaggctagagtgcggtagcgcaatctcgctcactgcaagctctgcctcccaggttcacgccattctcctgtctcagcctcccgagtagctgggactatcggtgcctgccaccacactcggctaattttttgtatttttagtagagacggggtttcaccgtgttagccaggatggtctcgatctcctgaccttgtgatccgcccgtcttggcctcccaaagtgctgggattacaggcgtgagccaccgcacctggcctaataaaaaaatttttttaaaagatgtgggtttcaagaggtgattcagtgttggaggtgaaggttgatttgaggcccacactttgagtaagaaggctgtagagtgtctttggtgatgctatactgttacacccaaattttccttctgtgcctcccagtgccattgattctttctggttataaaggaattgcccttttaaagggctctctgtgctcattatttcctttaatcttcacaacaatcccttggagtagttgtatagaattcatgagtctcatacctgtgaagagagacatcagtgaagagacttaccccaagtgagtcagtggtagacacagatgggacaagcatctggtttcctattctgaatagaatatggtgaccctgatattgatttattttttagtgttgtggagaagaattgtcttcatttctcccaaatgcagtgactatttgttagtccattcttcagctccttattgagtacctactgcataccaaatttatttgtgtgtgtatgcactggggatacagaggtggataagatagacgcagcttatgtcttcagttgtcaagacacagtcctgcattgcttagcaggatgacttctgcactccgtcttggagcttcttttgagaacttctgggctcagagactatgtgtgtgatgttgttttctcatgttctatggtgtctgggatcttcagagcctgttagccagctggctccaggaacctatgtgtcatgggttccacaggtgaacttcttggtactggggctcttgaggtctctccagttggtgacaggaaacattccaggtgtgagtggctgaccctcagagtagagaaagggttttgttggtttgtgttttgtttctttggatttacctctgggtttctgagaactgacattttcataatctgttccttctctgcattatgttaatagacttttctggggcaggaagaatttagtggatgtcatttgttagccaaggtatatgtctgcttttttttttccttctcccctcctcccatcaatcaaaggatttcttagtttcttatctgtgaatcactcaggcttccacttaactgccagttcagtttcctccttgcccatcctcccttctcttttctcctctccttcccccacttctttcccccatttcccttttttccctctccccaccacacttccctttcctttccccctcttttccttttcctcagattcttttgaatttttcttgatctgcaacaagccaggtcctttgttaggcattagtgttagacatcagtgatgcataaaagattgttctgctcttccaggagctagataagggcctggttccacttctcagtattcagggaatggattccctgcttactcccttccttcctttggatgccacaaaatgagcacttgactgaaaatatgcttatacgcgtttttacagactacgccaagccacaggtatgtctagatgaaaaatgtgttgtgccattgctacagactctaaaagtttggggaaccatggaagtgtttgggtttcttttgagccagtcttggcaaccttaaaacttttagaactgtctccccttggagggaaaggcgaaaaagaactgaagaggaggccttaagaaattttcatgtttagaggtaaagttttggttagcaagctggtcttttcttcctatttattgttggtagagcccatagagaaacaactattattgccaaatcagctctttccttctcatttcaaatttttccaccatcttagagcatgtaaaaattgttgaaagtggtattcagtcatttctattaagactgaggtgggcaagcttaactcattgttcatcttttttcttcccaatcttagcaaatccctgattgcagtataactaactaaataaattgcacaggacttgtgtacatcaactcccagcaaagtccaaagatcaaagttgaaagaggatactgaattccttcccagatttctgggacactgcttctgtgcactgtcaccaaataaatcctggaggagtggcgccttaagaaatagggtaagctcatccgcttctgggagattgtcatcataggcagcaatcttaatgctctgagatgcttcagagggaaagaaggggaaaagtataaaagaacaatccccacattatcggtttttagctcagtatttgtagcttgtacccccttcttaggattgctaaaacccgtttgcaaaggacagccctctatttccaggtccccttttccttttttcacactgcatttgagcagtttgcacatttgttgaagaatcagccacaaagtctgtggtttcctgtggcacatttctaacaatatttatacaggctattatttaatgaactgtataaatatttatacagaacagtcttttgatcataaataggggctaaaagtcagtccagtccatgctgaggacttggacaggaggctgtttctgtgctttgaaatgtcttgtagactgagaagttaggtatgtcccaggacttgtacgcagcacagcttgaatttctgttatttttctttctcttggccgtccacagtccgtgccctcatttctttccgcctgaccaccctccccatatccctaacagctgttttctttttagagtatttatctttgcctaagaagaatgaaatgaaaccccagttccgactctcaccattcataatgcggtctttggagtcacactgacttagcctcaaaccccagcccctgtgcttctgtaccatgcaactttaaacagcttcctgtctgagaacctcactttccttagctgggaaatggggctcatactgcctacctcacagggttgctataaggattaaatgaaatcatggagtcacatggtgatctgcagctcagagctcaatagatatttcttgctgcatttgttgttcttattgaagaagtaatcaaagggtttggctttcagttttagctggatgttgtggaaggagccctaaacttgccgcaagagactgtggttcaaatcctgatgccatttgctgtttgtggcactttgggcaaattactccacccttctgaggtataataaagtggtgataggtttaccaaactgattgggtttctgtgaatgagattaacattgtgtgggaataagtgacacgatgatgatccttatccttgtttactttacaaactagaaaaaggaataatgctttccactttacagttactttactttttgaggccaaggggtactggttgcataagattaggagtctaggacgcagcagatcatattcatgacccaggaacaaagggcatagagggggaagagcaggggacctatgatgcagaaagtcctttgctggagctcacaggtcgaatttcagggaagctgcccaagggcttgaacatccctgctttcaggttccaggtatggaaataatcacagagatcagttaaaactataataatgggaaaagtggtgaacctgaaatatgcaagtaggatctatttcatagaaaaacatgaactgggtgatgtgtgtgaatgacgctgggatggtttgactctttgctgcatggtgccctggtaataagttatagaaatccatattttgctagaagcaggccacctggtgttgtggaagggtcagtctctgaagatgaacagcctgggttctgagtcagccaaccttaggcacagcaggcagaggcccccagcagagtccttgacaaatgggcatttagtaaatagaggaatagcaggaggcagtggagcatcctgagaaaggttagggctgatggaaccggagggaatggattactgtcaattgtattactgcctagtaatatggcatactggagcaagttactttacctatctaggacttattttcctcatcagtaaaatgggagtgatcatagttattgtcttcaagaattgtggtcaggcattgtaatcaagctgcttagcagaatatcagatatgtggtaaacatggtacctttttttatttccccagtgatgaattttaaagacatccattcactgagttacaaggacttactgagctcctgctgtatgccaggcactgggcttacagctgtgacacaggcggcagctggaattaactgtaatcataccgctccattctccatgtgaagggtgggctcctgccagaaaccagaactggagcaagcccagggctaactgtagagtggaaatctgcctctttgggttttactggaaaggaatcagaatgtgggtagggtggtaagatgatgtattttatcatattactctcttcatcagagagggagtcaaaagtgaggaacccaagcctgagcacgtgggccagccccatggggaatctgtcttgtcatcggggctggctggagtagagacaagtctggatgctggctggccaggtctgtgtaagccagggtattgaatagatttttcatttcctatttatttctttgtttcttcctaagcgtttatagtagtcttgcaaaagtcttgccaagggcaaagagttgttagcatgctaggatcagtgttaaggagcagcaccccgggggcctttgcagtagagacagtgggaagcccagagaggggattccaagtaaagtaagcagctgtgagaggttggtagagggaaggtagagtggctagcttcaatcttcttcctgtttgcagctaataaaattgaggaaactcagcgaaggcattgcccctattttgtcaatcagtgtatcctcagcaggcttcctggtgttactgtcttctgcatttcttctgagtctcagatgtcactgattgcaagatgcaccattatttattattaccatgaagtaagaaaggaaatgataccaattaattgtaacataccattgattgtaaggttctcactggttttagagaagctaaatatggaaaaatgagtgccgtagaatgaataaaatgtggttgtaaaatgaataaaacaggcatggacctgttcatccttgtttctgttaattcattgattcagttgttcattcagtaaacatttactgaaaacctattatgtgccagacactgtgcaaggagcttgggatacagaaatcaataagttcatttttttcagattcagttaggaagacagacatggaaagaaaaataaaattgtgattccagagtggtaagttttaaaagaaagcagggagaagataccatgttggcatcctttgtatgtatgcaaggggagaaagggaaggaagccttttccaaggagaattgatggctgacctgggtcttaaaatataattcagtggtcaccaggcagacaaggaaaggagagaattaggaagggatgagcaaaggattggggcagcctttagcagctgggggcaattgagagcttatgaggagtttgaggatgtctgtagcctggagtgagaatgagcaggactgtattaggcggggctggatggcaggcagagggagcctgtggagggtgtgagatcccgtgctgaggccctggggtatatcacagctcaaagctggtggttttcagttgtcctgagagagggcctagcagagggactgctggggggaagggctggagggtggggcaagggcgatctttgcttcagagcagctctgtttttatctgttttgttttcttcaaataatggcttgaagaaaaggtatcactgttgaatgaatgaaggaatgaatgatttgaaaactggtgctaatggtcatatggaggtccccaaggggaatgtaagcaagggagagaagttgaggttacacaccagtggaggtctgatgaagctcctatgaacggagcaaatgttacttctgcagcttctccattttatttttcacctgctcatgagccacagagccaaaagggggacaattctgttgggaaatcattgtgattaagacagaagcaattacttttaatgaagtttttattgttttatttgttttttactggagtaaatatctaggaagcagtaactgaacatctgctggttgattttctttcagaatctccatgtttgacttggctagggaaacattttctttctgaagttgaaggatgcagaaggttgcccaggttgaaattagactctgggtggtaaaactgccttgagctcacctggagagttgtagggcatccacctgctcagttgtgttgggggcttgttcttattctttcaaagccaatctggaaaataaaagcctctatgagattccatgtcatgtgggctaatctgaccaaagggacttagagcagccatgaaggccaaggaattcctgaatgttctctggtcagatttccttgtaactcacaaggggtctgtaaggaaaacagattgtctaactaattgctgatcttgtctcctcggggttccttcccaattcccagtcacttcatgacaaagctgcaatatatttgcctcttctccaaacctatacagaaagcttttaagaaacaaaggaaagagcatgaaacttgggattgcacaaatatgggactttaggtccaggctgcccctgaatgaagctgattaaattccttaacttctcatagacttgcttcttaatcagtgtagtgtgtatcattataataatgtacatttactgtttgaatttatgagtagacctagctagcattaagcaaaaagttacttatctcttggaatctcaccttgaccacctgtaaaacagagatgtaaatagcctcaccttctagagtcatagtgaggagtaaaggggacataagcacttttcacagtgcttgcgtgtaagaggtacttagtaggtaattgttgaatgaatgactgactaggaggacaaggttccttttcagtaccttggcttctgttcttgttgattgaaattcactgagaagaaactcatctccattgcctccagattctaagttctcctaccaccctgtacttgcccttacagcactcatcacaactttgcctaaataattatgtatttaaatcctgactctctctcaagagtggaaatgccatgtctgaggccatatctgtgctgttcacccaccatgtagctcaatgtttattagtatactgttatcactaaaaatgtttgttggatgaataaataacaaatggctaccggttaggtagcggtacctcttttatttctacttttgagatgttttgtgactgtctttgcagatccacttggtcttcatatggtttttacacttgcttactataggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaaggtatgggcaaaactggtgttctctccttgttcatattcctacctgctgagtgtcgtgtgtcaatctggtgccgtaaacaatgttggggtaactttagatgcagaggtaagcaagacataggccttgcccttcaggagctcacagtctactggcagagactgataaacagctaatatatggtaagagctgggatcaaagtaactatagctggagctggggaaagagctaaccggagggggctcagggaagacaggacagcttgaggtgtgaccacatgtggaagaattcactgatcaccttattaacatttaccacgcctttaatgtgtgccaaaggctgtgtaaaatgtgttaacttgcactgtgtagttgcatcttcacatgaccctataaaggtaatactgtcactacccctattttattgagggagaaatgtaggcacagaaaagttaggtaacttactcaagttcacacagtaagtagcagaggcaggactagaacaaagcagtctgactccagaggtgcgctcttttttttttttttttttaattaaaaaaagttcaatgggtttttggggaacaggtggtgtttggttacgtaagttctttagtggtgatttctgagattttggtgcactcatcacccaagcagtgtacactgtacccaatgtgtagtcttttattcctcaccaccccccagcgctttcctccgagttcccaaagtccaattgtatcattcctatacctttgcctccgaggtgcactcttaaccattggactctgctgccttccaagtggacaaatgaggatgagaggaactgcattttgggcagagggaatagcatatgcaaaggcatggtggcacgaaaacatggtgtgttctgataaagcaaaggagtcagattagagtgtctcccatatatgccaggcatatgttcaccctgagtggccttggattggatgcagcctgctggcttgggaaggaaagcaatgcttcacaattcttgtttgtttttaaagtttcacttgactgtttgattttatgtcttggtgatcagtaatgacagaggtccttttgtctttttttccatggggaaaaataaagtcctggattccttcttttccctgttcctagtttagttccttaaatattcatgaggtgcttggtaatttgcagatggacaattcaccattctgtccctattgatcagtctgtttaaactttaatgaattctgggctgctgttagtgcccccggagaagaaggcagagagaggagggagtgggtaggcagtaccagagcattatacaggaataaaagagggatgcatcttctcttttgcccatttaattttcctctcctctcccctcctttcagcccccaatctggtaagaatcttctactctttgcacttgggccttctttcttcttttaacatacagccttgcttgccgttaaggaaattatcaagaagaaaatataatcccctgatgaaaagctactttaaaaaaggtctactctaagtacagctggtttaatggtagatttttaatcatctcccagtggtggccaacttatcatctgtttgagccctgttagctgcataagtaccatggacatctgtcgatagcaatgctattgcactatagcaaacctaaatgaagcccttgggtcttaggcgattctcctcagatggagtatggatatgtgggcatgtgccagaagccacaggataagcatgttacatctatatggaacatcattgctggtgtgaggcttagggagggaagcatttttatgttagagagataataacaccataggaatgagagaggtaggtgacctgttatagagcacagattctgcagccagactgcctagattgacatcccacttacaacgtttattaggttgtgatcttggacaagttacctaatgtttcttgcttcagtttccttatctgtaaaatggaaatgacattagtacctacttccataggattgttgtgaggattaaatgaattaatgcacataggatgtcataacattgcctagaaatgtgtatgggttgtttcctatggtggtgctgatggtgacagaaaatgagcagattatagaagatagtgaatttctaagacaaaatactgaaaagtcaaagtctacggcgggggaggcgcttcttgggaatattcattcactctcctggttagggttcttactgtgtaacactttgagaaacactggtctagggcaaagggtggcatcagatatgtcctggtctgtcttttcttcctcatggactccaggaagttgagagcttcagagcagttgttctaattccttttccctaagtcattcacattgcctgagatgactttcctcttagttaaagcaacagtaaggataatgtggtgtcaatgatgatgacaaagacagctaacagttcttgggcacactggtccaggtactatactgaagagcttttacccatcacttcattttatccttataataactacttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaataactactttttaaggtagttttgattgttctctctgttttgaagatagaaaaacaatgagctttgaagaggttcagtaagcagcctaaggtctcctgaataagaagaaggggacgctgtccctgccactgctactgctctcatgctctgtcccttgtctctctccagccatatctccctccacatgaccctacctggaactgataagaagtagcctgaaatttttagattttctacacatggggcatcatgaggttacccaggattacgagtgcctttacctggttgcctgctcatctgggaagtgtgtgccccctcagcaggggttatatctagtttatctgtatttctctagaattctttgcttgtagtgtgttcaattaatgtttgttgagtacataaatgaatgatatatctctgttgtttacattgtctggaatactcttctcttaacttcctcacctgcccaactcccaccttataaagtaagcttaggcggggcgtgttggctcacgcctgtaatcccagcactttgggaggccaaggcgggcggatcacgaggtcaggagattgagaccatcctggttaacatggtgaaaccctgtctctactaaaaatacaaaaaaaaaattaaccaggtgtggtggcgggcgcctgtagtcccagctacttgggaggctgaggcaggagaatggcgtgaacctgggaggcggagcttgcagtgagccgagattgcgccattgcactccagcctgggagacagagtgggactccgtgtccaacaacagcaacaacaacaacaacaacaaaaacagtaagcttaaacattcctgtctcctgagtgtcttccttggtgacttctgacagtctatgcccttttttaccaacctcagcagaaagagagggtgagaagcccctctctactgtccagagcccaccatcttcacccagatcactttctactccttatctttgcattttacttgttggcttgtttacccccttttaaactatgagctgagctcttagagagattcatctttatgtctccagtatctaacacattgcctggcacaaattaggtgctcaattaatggctgttgaatgaatgttacttagagctaaaaacaaagagacaaaatccaatctagcattccttatcttgtttcagtgtcactgtggggcaggaaggacaactattcttcctatttgaaatatgaggaaattgaggctctggaactaacaagtattggagacaagaccagaaccctggtgagatggctccaaatcttcctctctgtcttcctccctacattccctaaatttggcaggttttattgggctggtaagccgcacacctaagaggttttatggaaactcacaagtcatagaggttatatgcagtccacgattttaaaggttcctttatggagccacaaatcttaatcattccaaaaaggtgagaacatttcaaattagtgcatgattcatactaaacttctcttaggaagaaggagaagataagctggaggaatcatttagccaacaggtgtttgttgagtatcattctttcatttagtctgcaaacatttattgagcacttaactatgtgctatgctctttgctaagcattggagcatatagaggagacgtatacaagaagtctgctgcttttaaagatgaaacagcttaattgtatgagaaaaataaacaacacatatgaagccagtaaagtaccattttgttctgtcttggtgctatctatatgagtagtggttgtggggagggggacagaagaaagagtagccacatgtcgggttgagcaataatgttaaccttatattcatagaaccattatagtttacagtgcatcttcattttcatttgattgctattgcagggtgaagtagggaagaagttgttattcccatttacatttgaaaaactgagggccagagagttaagtgattttcctaaggtcacccaggtggtatgtgataaggcagaactcagatgggtcaaacctatgcattctctctatctctagcaccatatacctttatattttgcatggaatattattccaagaacctaactgatgtcttgatattcatttttcttttctctattcttgcatttgaagtgttttttttttcctctagtgctaactgatcatgtcactcttttgctacagcccttcaacatctatcactctactacaggcataatgataaattcagttccagaacaccataatgaggtgaatattgcaacaaagctcacatgaatttttgagtttctcagtgcatatgaaagttatgtttacattatattgcagtctattaaatgtgtaatagcattagtctaaaaaaagtatataacttaatttttaaaaattgccaaaaaatgtgttaatgatcatcgaagcctgcagtgagttgtagtctttttcctggtggagggttttaccttgatgttgatagctgcttactaattagggtggtggttgctgaaggttaggtggctgtggtaatttttttaagtaaggcaattttttaagtaaggtttgctgcactgattgactctttctttcacaaaagatttctctgtagcatgcaatgttgtttgatagcatcttatccatggcaggacttctttcaaaactggagttagttctttcagaccttagccttatcagttaagtttatgtactattctaaattgtttgttgtcatttcaacattgttcatatcatctttatcagaagtagattccatctcaagaaatcatttcctttgttcatccataagaagcagcccctcatcggttcatattctatcatgagattacagcaattcaatttcatcttcagggtccacttctaattctagttcgtttggtatttccactacctctgcagtaacttcctccacttaagtcttgagccactcaaagtcattcatgagggttggaattaacctcttccaaattcctgttaatgttgatattttgacctcccatgaatcatgaatgttcttaatggcatctagagtggtaaatcctttccagaatgttttcaatttactttatctagatcaattagaggaatcactatctatggcagctatatccttacaaaatgtaattcttaaataataatacttgaaagctgaaatttctctttgatccatgggctgcagaatggatgttgtgttagcaggtatgagaacaacattcatctccttgtacatcttcatcagaactctttggtgactcggtgcattgtcaatgaggagtaacactttgaaaggaatctcttttctttgagcagtaagtctcaacagcagggttaaaatattcagtaaaccatgctgtaaatagatgtgctgtcatccaggctttgttgttccatttctagagcacaggcagagtagatttagcataattcttaagggccctaggatttttggaatagtaaatgagcattggcttcaacttaagtcaccagctgcatttgcccctaacaagagagccagcttgtcctttgaagctttgaggccaggcattggctttttgtctctagctgtgaaagtcctagatggtatcttcttccaatataaggctgttttgcctaccttaaaaatatgttgtttagtgtagacaccttcattgattgtcttacccaaatcatctgtataacttgctggagtttctacatcagcacttgctgcttcaccttgtgtttttatattatggaaatggcttgtttacttaaacctcctgaaccaacttctggtagcttcaaacttttcattctgtagcttcctcacctgtctcagcctttacagaattgaagagttaggactgtgctctggattaagctttgacttaaagaatgttgtggctggtttgatcttctatctagaccactcaaattttctccatatcagcaataagactgtttcactttcttattcaggtgttcactggagtagcgcttttagttttccttacgaactttcttttgcattcacagcttgactatttggtgcaagaggcctatctttttgccagtcttggctttccctatgcctacttgactaagcttaatcatttctagctttacatttaaagtgagagactatgactccttctttcacttgaacatttggagaccattgtagggttattaattggcctaatttcaaagttgtgtctcgggggtagggatccctaaggagagggagagagatgaggaatagctagtctgtggagcagtgagaacacacaccacatttatctattaagtttgcccgtcttatatgggtgcagtttgtggtgccccaaaacaaatgcaatagtaacatcaaatattatcatagcagatataatattaatgaaagtttgaaatattattaagaattaccagaatgtgacacagacatgaggtgacatgagctattggaaaaatgacactgatagacttgctctttgcagagctgctacacaccttcaatttgtaaaaaacacaatctgcaagatgcggtaaagcaaagcacaatgataccagatatgcctgaggcatacctcaaactgcggttttagttccagaccactgccacaaagcaaatatctcaataaagcaagtcacatgaattttttgattccccagcatacataaatgttttgtttgtgctgtaccgtagtctattaagtgtgcaatagcactgtatctaaaaaaaaggtaccttaattaaaaaatactttattgctaaaaatgctaatgaagtgagcacatgctgttggaaaaatggcagcaatggacttgcttactgcagggttgccacagacgttcaatttgtaaaaaatgtaatatctgcaaagtgcaataaagtgaagcacgataaaatgaggtatgcctgtatttgggtagaactcaatccttaacatggccttcagggccctacatggcctgtctcgacttgcattcctggctcatctcatgatgcttctcctggctctctgcattccagccacaccttccttctgtcatgtcctcaaacatgcaatgctccctttagcgtaagaattgttacccagattctttcttctggctgcatatccttcctaccttccaccagcatatctaactcctgttcatccttagacctaagctatccaatccaatagttgctgaacccacaatgccatttaaatttatagtaattacaattaaatataattaaacattcacttcctcttttgctccagccaaatttcaagtgctcaatagccacatggtggctattatactgaacagcacagatatagcacattttcattattgtagaaagttccattggatagtgctgccccaaaccttaattcaaaagttagttcttcaaggaaggagcattttctctaccaataccacctccaactaagtcttatttcacttattaaatgttttcacagtgccttgtacgtctctttcatagaactccatgtggttcgtgaatcattcattttttgttatcaaataataaaatcattctataaatcaagaataaaataccataaaatgaaacaaaataataagatatttcactttttggattaatgtatgtcttccctactagattttatgtttcaggagggcaggagctatgttttgcttacccagagcctgggttatattagacccaggaagtgtaaaaaaaatgaagggtcaaaagaaattgagagcactttgggaggcccaggtgggcagatcatgaggtcaggagtttgagacccgcctggtcaacatggcaaaaccttgtttttactaaaaatacaaaaattagctgggcgtggtggtgtgcgcctgtaatcccaactactgaggaggctgaggcaggagaatcacttgaacccgggaggcggaggttgcaataagccgagatcgcagcactgccctccagcctgggcgacaaagcaagactccatctcaaaaaaaaaaaaaagaaaagaaaagaaatggagacctccctacttctacccactggagaaaacttgagaaaggatgtagggcaaaaagtgactcttgaactcttaagagaagacaattggaactggaggaatagaatggtcagaagcgctgagatgggaacatcaaggatcgaatcctagctgtaataggtggtttctaataggaagaaggaaagggaggctagaattgacgatacaggggtaggtgagacagctggctcagaccaatggggagctcctctagaatcatcctgagtttgagattgaccagtcttgcaacagattcagaatggctggcagagaagaaactaaatttaaggatgtcaggaggcagacatcctgatgagtttcagaggctgagatttttttttttttaaactataaactttgggaagactgggaccacgtctctcttgaccaggatatgttctctgtgtctggcacatataggtgcttaatatttttaataataaatggctagattagactattggcagaggaataaataggagggctgagactgagaggctttaggaaggcaggcgtaactggacttggcaacaatggagaggaaggaggtagaggctatttgagtttcagttcttggcagaatgttggggtcactgatataaatgagagtatttggcctttatttcatcatcttatcatcaaatggcaataccatacctaagctgggatgctacgtaggtaaaggattaggactgggtttatttacttcactggtcactagagtagcttttacaaaattgactgccttcaagggccttccaggtaatgcacgccccaacacaagctgtatttgtcttcttgctgttccccctcccaggacctctgcgctcgctgttcccctgcctggaacactcttcccccagatttccatgaggtccactcctcatgtctttcaggtgtatcctcaaatttcacttgcatcttgcataggaaccacctcctccttgcattcctaatccccctgagtaatcacttgctagtatactatatctacactatgtaatttatttgatttattgggtattgtctatccctactaaaatgtaatctccaaaagagcaaggattaaaaaaaaaagtttttctctccattgtttttccaatacctagaagagaaaattctgcacagcctgaccctagaaggggcttgattattttcgctaaggacttatggctaagtgagtgattgaactgtgtaaccaacaggtagtgatggagcctgagggaactggtgattgcataactcctcgcacgcccccaaagctgacaaaggcattcaaatcaagatttaaaagaatacagtacctgccactcagaactctactgcaagctggattatgtctatgaagccccaggctttgacccttgctctaaatagagctaaggataaaaccaggtatgcatctgaccctccagttctcagtttggagggtttctaagaaacaccatctccccacccaatatggcagatcttgctgatttaaaacacatgcagaattgaaccatttcccacaataagaagaaagtgatacacaatcccttccccaaatatttgtttgctgccccatagctacgagttgacagttgttagacatggaacaggttaccaaatgaggttgcagaaatctctttctctggaaattctttagaagagcaatgtgctttctctctagctagggaaattctcttgattccaagctgttacaatgagattactgggctgctttcttcttccattaataagaatataaaaaagaattcttaggtcaccaggtcaagccccagaggccttctgggtagtgtgactctgacagtcatctttctgggatggtttagatggtgtggggtgaggggttgggaatggcgatgttcctcagctgtggatgagcatgatcataaggcatttccttgtaaggctggggaaatagtagtggctacctagctagatcaggtttaaatgcatgccacagttactcttccagtttcttgtgagaggtctctgtttgaaagatagagacgctgagtctttgtgactgaaggccatgattgtaatattgagcactctgtaggtctgttgaggggattcataacatacattgaagaaaatattttccttgctcctactaggttactcccgccatgattcttagaaagatttgagtctatccaattttttctattcctactctttttgcttgtcatttttatatgtgcttacgtgacacagagagcaagcatgctgtgctttgtacataaaaacattccatgaacacaataaggcattgagtgcatttcctatcctattttctataaaggtttactggtttcaaagtaatttcagactccactgatcccattcaaagcctttgattcttacttgggaggtatctctcactcaggaaactgaggctcagaaagttgatggagttagtgcaggattacctgacctagaagtggtggagttggcaccagaaggaagttctttggacaccacatcctgtgtttgtttctactcccaaactgccttgtggtatggagtttgagtcatctatattttctcacccaagtcctcttttgactaactgcagacctgtgtgagatgggcttacccaagtcagacatgcactttctgggcacagaagccaattgggccacatagcaagtagaagttagggctgggtgattgattgattggtatcccacatggaaagatttgaagcaactaatttgctctaatataaactgctacttactgtgcactgatgccagatgttgagctcatcacaccttattttgctgaattctcatatcattgggagatgcaggtttaggtaatagttttgtactgccaaggaagctgcttatctgacttcacaaagttatataactcggaaatagtagaaccagatttcagactcaggtcttctgcccccaaagtcgctgatttaactactatccagtgatttccaagccaagttgtaaggacattccaggcagaaatagccatacctgtaaatgctatagaaacatgaaccagcaaagcaagagaggagttgcaatggctagaattgtgtaacttgccttcagccacgtagccatggtggcagagctaggatttgaattcaagtctttgtgactcattgtcatgaggccatactgcctgtcaggaaatgggtttggtcctcacactgtaagtctagatagatcagtgtggtgaaggcatctgggtattcacttggtactgtgggtcaaggtactaccagcagtcacagatgggtcagcagcaagtgttctctagatcacatgtcctttccacaggatgagtctcttgggcaacaggaaattatctgatgacagaggtgagcagtatggtataatggaaagaaaatagacactgagtttgaattctggctctgcaatctactggctgtgtgacaagtgcaagttccttaacctctctgtgcctgctgttcaccctttccctcgccaatcatccacttcttttattttgttttattttttttgagatggagtctcattctgtcgcccaggctggagtacagttgcatggtcttgggtcactgcaacctttgcctcctgggttgaagcagttctcctgcctcagcctccctagtatttgggactacaggcacatggcaccacacctggctagtttttgtattttttagtagagatggggtttcatcgtgttggccaggctggtctcaaactcctgacctcaagtgatcttcccgtcttggcctcccaaagtgttgggattacaggcgtgagccattgcacccggcccccacttgtttttcatgaaaaactaatattaaatgtttcttttggagggctttgtaaggattaaataatatgtatgtcaaacatatggcacatagtagatgttcaatatatggcaatgctttattaatatgacttgaaaaaaattactgcttttcttttttggacatttctcataattatgtgaagctcttgtttgaggaacatgttaaatagtaagaaatggaattctaaattataaatctggtatttccaaacaggaaaaaaataattatatattttaaggtgaatttcactaaatgaggatggacatttttgagttgacttttatgggatttaaaaggttgtagtcatgttttaagttaatagaaactggtcgctcatgctttttctataaaggaaaccatagaaacaaaaataaaaaatagaattaatcgataaatctattattctacaactttaaaaattatacaaacaagtgtaaaatctatatcctcctcctgcagttccaccctcaggagcaaccactattaacaatttgttgcatattcttttttttaaaaccttactaatatatcatggatgtctttccattttatctttcatagctcaactcgttttaaaagtatttaacagcttgatgtatgatttatatatcataaaatccagccattgtaaatgtataatgctgttattttgtaaatttatacagtggtgcaatcatcacctactccagttttagaacacttattactccaaaagtttccttacacctgtttgcagtcaaccccaagccccagtcagaggcgctttctgtctttataggtgttctttttagaaattttatataaatagaatcacatagcgtgctttcttttatatctggctcttttcacttagcataatgtttttaaggatcatccatgttgttacatatatcagtagttcctttttcttgctgagtagtattctgttatatggatatacaatactttatttaacagttggttaaactatgatggatatttggttggttttcagcttgggaatatcaataatgctgctatgaatattcacatacaattctttgtgttgatgtatgtttttattttattttatttggtttgttaatattttgtattgaagttgccgggttgtgtggtaagatgtggctgtattttacatttccatcagcaatgtataagggcatcactttctccacaattctctaacacttggtattgtcagtctttgtgataatattctagtaagtgtgcagtagtatcttattgtgattttaatttgcatttccttagtgactaatgatttgagcactttttcatgtgtacattggccatttgtatattttctttgcagaagtgtccacatcttttgccaatgttatcattgggttgtttttcctcttattatttgagttttaaaatatattttatatgcaagtatattatcagatgtgttgtttgcaaatattttcttccagtctgtagcttgtcttttcgttttctaattgtttcttttgaagaaaaagatttttaaattttgatgaagtcaaaattttttcttttgtgggtcttgcttgctttttataaaatcttcatctaatgcaaggttgcaacaatgttctcctgttttcttctacacattttatatttttagtcttacatttagggatgtgatatgttttgagttaagttttgtgtatggtgtgaggtaagagtctaagttcttttttgcatatagtcatatagttctagcatcactgtcaaatagtctgtcctttcccccattaaattatataggcacatttaccaaagccaattgccataaatgggtttacttcttatatctctgttctattgatttataaatttatccttataccaataccacataaacttaggaatgctagttttatagtaagttttgaagtcagatagcatatattttccaagttctttctattcaattttgtcagtttctacaaataagtagataaataaataaataaaacctgctagttttttttttttttcactttaagttttgggatacatgtgcagaaagtgcaggtttgttacataggtatacatgtgccatggtggtttgttgcacccatcaacccatcatctaggttttaagccccacatgcattaggtatttgtccaatgctctccctccccttgccccgcaccccctgacaggccccagtgtgtgatgttgccctccctgtgtccatgtgttctcattgttcaactcccacttatgagtgagaacatgcggtgttagaaaacctgctaggattttaatggagttgtggagaatctgtaggttaatttgaagagattaccatctgaacaatgttgaattttccattttacgagtgtgacatatttctccaatttttagctcttcatagcaatgtttggtagttgtcagagtataggtcttgaacttcttgtgatatgttaattcctgaatgtatttgtcaggtttctccagagggacaaggccagtaggaaatatatatgtatatgtacatgtatgtatatgtatatattcatatatatatatttatatgtatatagtcatatatatatatatatatatgaaagaaagtttgttagggagaattggatcacatgattaaaaatgtgaagttccacaataggtcatccgtaagctagggaatgccagtagtgtggctcagttcaagtccaaaagccttgaaaccagggaagccgacaatgcagtcctgaataagtctgagggtgaaggcctgagagccccaggcaggctgctagtgcaagacctagagtccaaaggaagatgaacctggagtctgatgtctaagggcaggaggagaaaaggtgcctcactgcaaaagggagagagggaggaaggtaagcaatctgagtatcccccttgttccacctgctttgttctaatcacacccattactgattagatggtgcccactcacatcaagggtggctcttcctctcccagtccactgactccacatgtcaatctcctctggaaacaccctcacagacacacccagaaacagtgcttcactaaccagctaggcatccctcaatccagtccagttgatatctaatattgagcatcacactgagtatttcactttttgatgctattgtgaatgggattattttcttaattttattttttatcttttagttgctattaagtagaaatccagttgatatttatatgttagtcttgcatcctctcatcttactaaaattgcttattagttctagtaatttttttagcttgtagattctttaggattttctgcatatgagatcatgtcatctgcaaagaaagacactttaacttcttttctaatctgtatgcttttaatttacttttctcactttattgcaatggctagaagctcaagtataaggttgaatagaagtggtaaaagtgaacatccttgcttcatttctgatgggggaaagcattcatgttaccattaagtatgatgttagctgtaggtttttgtagatgctccttatcaggttgtagaagttctcttctatgtctggtttattgaatgttatatttggagggtaggggttcttttttctgcatctgttgagatgatcatttggtgtttgtactttgttctgttaatgtgcgtattccattaattaatttatggatattaaaccactcttgcattcctgggatgactccacatagtcatggtatataaaggaaagttttacatgctggaagatttcgtttgttaatattttgttaaggatttttactatgttcatgataaatattagtctgtagtgtccttttcttatgtatttgcttgactttggtatcagggtaatactggctatgtaatatttgttggaaagtgttcccttcttcactgtattttagacaagtttgtgtagcattggtaccatctcttccttaaatgtttgataaaatttcccagtgaagcatttggacctgtagtttttttattttttgtgggaatgttttaagcacaaatttgatttttcaaaaaaaaagtgcttctcaatttttcacatggctttggccaatttccataaccccaaaatggtggtttttgatagttttgtccagtttattagttttattttgctaagaggattttttgacttcacaccgccacacccagcagttgcctctctacctctttttaaaaaaaatctgtatagtatttcattttacaaacatgccataatttatttaataaaaatagttttttcacttttaaaatatagtctgagcagtgctgaagctaaccttcttctatatataactttacttacttttgctaataagatacgtgcatttttaattttaataaatgtcaaattattctccaaagtttgttgtcattaattatattgttagaataatctccaagaaggtccacttctgcatatattgccactaccatatacaggttaagcaaccctactctgaaactaaaatgcaccataattcaaaactttttgagtggcattgtgacgccacacatggatgtctaagatagtaacatttttgttttctgatgattcagtgtacataaactttgtttcatgcacaaaatcattaaaaatattgtataaaattaccttcaggctatgtgtgtaaggtatatatgaaacatatatgaattttgtgtttagacttgggtttcatcctcaagatatctcattatgttatatacaaatattccaaaatctgaaaaattctgaaatctgaaatgcttttgatcacaagcatttcaggtaagtaataacagcctgtagtattaatcttttatatttttgccaatatgaaaagcaaacagtttgatatctttttgtttgtacttatctaattggaggtgggaatcttctcatatgctctttgaccatttctttttattttatgaggtgactttttattcctttgcttaatttccaattatttttaattattattattatttttttttgagatggagtttcgctcttgttgcccaggctggagtacaatggcgtgatctcggctcactgtaacctccgtctcccaggttcaagcaattctcctgcctcagcctcctgagtagctgggattacaggcacacaccaccatgcctggctaattttcgtatttttagtagagacagggtttcactgtgttggccaggctggtcttgaactcctgaccttgtgatctacccacttcggcctcccaaagtgctgggattacaggtgtgagctgccatgcctggccttaatttccagttagtttggttctttttttcttatttataggatcttttgggattatagtgatactaaatttttatctgttttatgttgtaaagatttttttctattctgtcattccttccttctagttgtaactgttttcaatctttaaagaccctggtgttgtaatttatgtttttatttgtttttaaaacagaaagttgtacaagggattgatttaaaccaaattcgaggacttgggtttgatgccacgtgttctctggttgttttggataagcagtttcacccattaccagtcaaccaggaaggtaagaccatgtctcttccttttcccagtggtgggatacttggctgattaatccaatgggcccaggtggaacaggagggcaggcgtctcttgctgctgatagtaaaatttagaggtagagtgaagtgacacagatcatgttgcagaagtcaagagcttggagagcagttggtatgagtggggtggtgttgacgctggattagggggactaggctttctaaaactcaggagccacagtgcagagcttggtaaaggaaggatatgagattgttagctaggagtgattaaccttgaaacacacaggtggttttgatgttttctgagaagagagtgtcagtgcttgcagtttctttgtatacgatattcctattccgtgcttatctgagtggatgagccaagtcctttgaaaggaaatggaacatggtagacagggccatgtgacagatagaaggtagaagcagatggcctctctattttcagtagccagaccaaaagacattcacattaaatggtgttgtcctaatagacacttgtgagtacagaaatgagctgtttgaaatgtaaagtgctacttgggtccaccatcagagatttttcacagcagataaggttgtcccttttggggaattttagccaataacgtttgtactggggttacaaacccgaaagtctattaatatattaatgtaataattaatacattagtcagatgggtaatgtaaatgagtaataggccaggtttgagaaaaaccactgcacctgtgtgaagataaatttcaactgatatttaaccttgtaatgagcagatgacattagggagcagtggaggctgcattgcactggaaattgcatgctccatctgaagggaagggccagctctaggcattgtcagtcagctgttgccaagatagccattgcaaacatatttggggctagattctgttagagaacccttgattctgcacactgttgcagcagcatctttcttaactgttggctatgaggtagtagggtacattgatacacagtggaattagagttaggcggggactctgattgtagctctgctgttgctgagctgtgacaccttgggcaagccacttaactctgtgtttctcagttttcttctctgaaagaatttgaatgaatcagtagctttgctgtgagaatttagtgagagactgatacttaaaatgctcagaaaagtttcttccatcagatgatgaattttttaagttaagagaatattccggtcactactgtggacctaatgtatgaaatagtgattattataattataaggactataaatgatcatctatttgcatcccttttcactataagtgatcactataaataatcataatcactatgtgctgaaaatggatgcaaatagatgaatgattagagcacagtggtaatgatgaccattttctgcacagacacacacacttttttccctcttcttgcgacatttattaacacctcctgtgttccaagccctgtcttagcaaatgctggggcttcaaagataaatcaggacggttctttttcttggtggctgttcattggctcagttggcactgttctggcccaggacagggcagccttgttctgagccatttcagaaagcagagaccaaacctgggtagagcaaacctcagctctgcagcagcaagcattcactaattacaagatgtggccagccacagacctggccgttttgggaggctgtcagtatatcttttatgggctttatttaagtaaaggtcaggtgattgtttgggatgccatagatcagatgtctcttactgttgatagtgagatttagaggcagagtgtggaggctagaaatcaccgtcccagaagttaaaagcctggagagcaattggcacgagtggggtggtgttgggggcagagttagagggaacttggttccataaagcacaagagccatgttagagagcctgattttgggtggaactttagatactaagagtcctgtttcaaggattttgtatcatctgatctgctaaaatacatgtttacttatttatttttattctggctgtgcattagtatcaactggagatctttttaaaaattgccaattcatgagccctaccctcaggatttgtattcacttgacttgaggtggagctagggtgtcaactttttaaaaaagttttctcagtaagtctagtatgtagagaatcactggggacagattaacggagaattaaaatattaggaacagaacacttgaagtggaagaagacagttccttgttaaatttgcttaaatatgtaccctctttggatgctatttttctttcattgtaggtagaatggcttcctgttaacaaatcctctattaaaaaggtaactaggttatcactctaattataagtgttgaaataactttattccacctaaaaggttaaagtgtacccattcatcaaatgcatccagctgcaggtgccctcatcagtttcttgcctttcaacagattgtattaaggttagatcttttatctgaaatgaattatcctgtgcaagaaaatgaaattagaattataaaggtggtttgaaggttctttagagactcctacctgcatggcagcgaccaactcttgattggctaatgggagtaattgtgaggagcagagagtggggtcaggaagattccagataaccctaatcatgcagataacctaaaaccaaacccataagaccagcaaaagtattgccgtctttagatgttaaccaaaaaattataaacgaataaattaagtacaatagtttaagaaaattcagcattagtctatgataaaatagtctcatttgcctttccttgtttgactcttcttccttaaagatcagaacaacccctgggctggacagcagcacagttgctgaatgcttcctacccctgccactgaccaaactcagagccttaccctgattgtgtcatctcagccataggagctcttgggagggagaggaacaaagggtgataattggggctgggagagggagttatgacctagtctcctctgtgcaacagatacctaatgtttagatttttttgctgattcataatattttttcccctcaagtatgcctgcaacacattctgtgaacataaacatgtattttagcaaggtattaattaagtgaatatatggatgaataatctacccttaggtaaagtgaggtagctcaaatgtaactttacctccaattctcttaaacgacaacatttttgtgggtctgtgttctgtttcccatgctgccttattgtatagaacctctttctcactctttcctcacctgcctagccattggctagtcatttgaagaattaaataaacactttcctgccttttgaaagctttctgtgcagctccaggctcagctaactagagcctgctctttgctcctcctccacattcccatgtctggtactcttgttctggcagtcaacacacagtatagactctttctcctgcagacatatgttgcttaagggcagaactgtggcacattcttcttgatatcctagcatccaacactgtgcttggcatgtagtagatgctcaataaaagattaaatgaactttcagttttccataagagctgaaaaaaattaacttctcagtttttatctaaaacgaaaattattaattctaatacagtaatgattctgtacaattttcattgtattgttctgactgcattttgagagcatctttatgtagaggcagtagtagctgattggtctgtctttactataggcagaagtttagcaacaggtatttttaccttaaagtagctgtagatttgttctgtacagtacttaagaaacaatactgatattgtccccttcaacactcacccacccacacatacacccacatcctgattcattgatggttgtggaataggagctggacatcagtatttttaaaagttatcaaggcgacgctaatgtgcaactaggtttgagaactagagctttgagcacttctgttagatagaggaacaattctgtttacaaaaaattctttgacattcctgtggaaggtcccatgtactctgtattattttcaaagtattagtataatggtttgtggagcttttgtgggaggtgatatctttccagttaggcaactgagcccctgccttgttatgcccatgaccttatttaggtatcttcttacattggctttttttgttgtttttttttttggttttaattttaaacattcttttcaaagatgtggaagggtaaagaaagcaacatcttcctattcgcctaccactgaggataaacatgaaattttgccatatttgcctcagctccttttattttaaaaaaagatatttgtaacttcagcttttcacctcctgcaggtaaccattctgctgtagttgctgttcttaaacacattgtttttgtgcttttactacatatgtgtatacccacaacaacaaacagtatacaatccttcctctgtatctgaggggtacttgttccaggacctccttaagaccataacccacagatactcaagtccctgatgtaaaatggcatcgtatttgcgtataacctatgtacgtcttcccatgtacttcagataatctctaggttacttataatacctaatgttaggtaaatacttgttatactatattgtttagggaataatggcaagtaaaaaagtctgtacacattcagtacagatgcaaccatccatttaaaaaaatatattttcaatccacggttggttgaatccacagatgcagaactcacagacatggagggctgactctgtgttttaaagtatctcagctggtgtccttgttcatgttactatgtctaactctagtttattcatttaagaattgatttatctgttctctatgcagatctagttccaaaatacactttgtgcatttcccagctgtgagacattgggtacgtcttcactttcaagagtctgtcattgaaaaacaggggttaaaaacctgtatcagagggttgttttgaggattaaatgtgatgatatgtgtaaaatgtttagcacagggcttgggagacaaacacacattacaaacatttactattagcaagatatgtagtgctgcggttactttgccattaaataaaataatgtgtgaaaatataatacctggtttggtaactgctgggtttcttttctctttgccctaataatctctcgggtatattaattgctgttctgcaacttttgccatcagaggcatcagagggctgttaaaggatttctggcttgcccattggtacaggatgaattaacagaggctggggagagagataaggagttactgtgtggactacagggtggtaaggcaggatatgaggggcagtgctccttttccagctggttttaaattctcctccttatgattttctcctcctgagggcctactttctgagaagtacttgccatatcctttatgtgcattatcttttgtttaaaaacttcctgaattatacatcttcatctgtaactgtatcttcatctgtaactagcattccctgttagatctgcctaattccaaaacccatgagcttcccacgccagcaaacaagccaaccaaatgaggaaaaaaaaaaacacctacataaactaattttaattaaagtgaccagaaaaagtgggaatataagcagttaaatgccattgtttagctattagatgtattataccgtcaaagtatttatccatatttaaaggagacagatcttagaaagtattgtcttagtcttatttcatagacacctttcctgaatgtatgcccagaaaagtttttctagaacagaagggataagaaaggaagggaagaatttgagagagaatacttgataatataattaattggtagatgttttctgcttttaatgtagacatttattctaaggtcatggtcagagaacacatgactggacgggaaattccaggcctggggacagtgctttcctcagccttgctggtgtcctttcattttgcacactcttgatacataaaattatagaaagtacatagcattttgatcttgggaatccataattgttcccttgaattagaaggaagagaatgtgtgtccatctgcatctccctctcgtttctgctaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagaggtgagtgcatagggtctaagagaagataccaacaatagtagaggattcctgttactgtggacctgtaggtaccaggcaccctgctaaaatcggttatgtttgatttttcccagcaactaggaggaaggttgatcccattttattgattacagtgtagttaaatcacacctgtttttatgtgcctaactcatactaggcactgtgacaagtattgtacacattatctctttgaaggccaacgaccctatgaagtgtttgtgtgtggtgtttattttagggtgtctgttttgtagacaagaaaacgaatgttcatagagataaaacaactcactcaaagtgacaaagtaaatatgtgacagaaccagaatttgaacctaagactggctgactccaaaatcatttttttttaattttaaaatgtttcttttgtagagacttggtctcactattttggccaggctgatttcgaactcctggccttatgtgatcctgcaaaagtgatatgattataggtgtgaaccactgtgcccggccatccaaaatcaattctttttttttttttttttttttaagtatcaatttctcttttaatcttagacgtcgtggtggaaggaaaaatcagttagcaaagaagcaatctcagaaaaagtgtatctttttgatgcctttatgccttttttttcctctttttttttcggttattctttattattatactttaagttttagggtacatgtgcacaacgtgcaggttagttacatatgtatacgtgtgccatgttggtgtgctgcacccattaactcgtcatttaacattaggtatatcttctaatgctatccctcccccctccccccaccccacaacaggccccggtgtgtgatgttccccttcctgtgtccatgtgttctcattgttctattcccacctatgagtgagaacatgtggtgtttggttttttgtccttgtgatagtttgctgagaatgatggtttccagcttcatgcatgtccctacaaaggacgtgtgaactcatcattttttatggctgcatattattccatggtgtatatgtgccacattttcttaatccagtctatcattgttggacatttgggttggttccaagtctttgctgttgtgaatagtgccacaataaacatacatgtgcatgtgtctttatagtagcatggtactggtaccaaaacagatatatagaccagtggaacagaacagagccctcagaaataatgccacatatctacaactatctgatctttgacaaacctgagaaaaacaagaaatggggaaaggattccctatttaataaatggtgctgggaaaactggctagccatatggagaaaactgaaactggatcccttccttacaccttatacaaaaattaattcaagatggattaaagacttaaatgttagacctaaaaccataaaaaccctagaagaaaacctaggcagtaccattcaggacataggtatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaccccatcaacaactgggcaaaggatgtgaacaaaatcaattcttttaatacccagtattctattggagttcagagaggttaattaccgttccaatgagaaagcagccgaggtgggatttaagtccatatcttctgaccagagctttgctgttctgtacacttttagccccaacttattaatatttggccttgttgacatcttaggctttccctttctcatcccacctgcactcgagtttctcatccttaaatgatatggcaatctctggtcaaagcacttgcaggtggctcccatttccagatgttaggacttctttctgaagtgtggagaatggtgatgtcagcttaatggttcccattagagatggatgtgtgagaaagttcaagtcctttgggaatctcaaggacttgaaaacctctaggtggtctggagaagtagagaatccatctaatgagcatgacctgctgtgattcatttactggctctgagatttcaggtgggctgagtcttctattactcagattgtaaatggagatggggagagcttaggttgctgagagggtgcctaaggattgccatcacggggcaggagagtggtaggaaagaagggcttcagcaatcaaagcaggcttggctttttagctattttatatattgagctgttttgtaagttttaatctacataaaggcttctgtggttgctaagagtttgaaaacagagtttcttaggagtcaggagttttcaagaatctaattctgactctactgtcaacaattgtatgctttggtcaaagcacttcttatttcaggcctcactttcttcatgtataaagtgggagagttgtattaaccagtttgaaaacctgactcgggtatatactgaaacacaaaattggaatatagaactgttctgcgctgcccggtaccctgctttgagttgtataagcattagttgattttaatcctaatggtctgtgcctggtagatagcacaggaaactgatcctaaggaggttttcccaaacaggtgatagagccagaatttaaatccatgtctgctgggctccaaatctcagcttattccatcatgtcatgcagtagtaaaatccctctgtgaagcatggctcttggcgtaggaccaggaatgatggcagtggtcttcttcaatttggcctaaacttgttgctatatcaacaagtttggattggatatatcaccttttttggcaacacagaaagaaaagttatactgagttaagcaaagaggattgggcggagggtcattggttcagtgtcagggccttctagagcacttgccatgtggccagctccagcctatatcccaggagatctaaatgcatatctggcacgaacctctcaggattcttaccatctcgcacttgagataaaactgcactaaataaatcccataggaaatagttaaagtctagattacatggcagtgtttgtgaccctctgagaacatcttatattaatttattttaaaaaatcaattttctttcagaattttctgagtaagcctctagtgtggggtgtgttttggtaagcatgtacaggaattcttgctgagaattcctttggctttaacatgattgcaaaatcaaaattaaagagatttctaaagtcagttttagcatcttcttaaagcctgaccaggagggctatagtgcttctcagacttcaatgtgtaaatgaatcacctggagatcttaggttctgattcagtagctttgggatagggactgaaaatttgagattttgtatttctaactcaagttcacgggtgatgctaatattagtggcctgggaacttgtgaaaccacttttaattccaaaagctctgctcccctaccctgaaaagcatccacttttggggaatcagggaatggtacctttgtttttaatgctatgatgggagacacaggaaagtttgatagcttcagtagagctgctcaagtgcccgttcagtataaaagcatgagattctgtgttctaagttcatcaagctgtcatgtgtttactccttcttcattctttaattcttggaagtctgtactgagctcaactatgaaccagcaactgtgataggcactggggaactggggacaataaggactcaaccttaccattgagcagcacacagtccactagggatagtggtaggggagcataaggaatggggtggatgcaggagtgacatgaaaacagagccatcaaatgtactatgcactgtgatatagcaatatacaaagtgctttgggaaaaaggatttgcttcccagaggcaatagtttgacaggagcctcaagatatgagtagaggttttgcctagcagagaagataggaaagacattctgaagagagactgtggttcatctgtgttatggtaggtgagtcccagggcatgagctggggtgcttcagcaagcatagcaggagatgaggccaggtaaatagtctgagttcggcttattaagggcttatttggtgatagggattggttgatggttgttaagcaagggaggggctggcttaggtaactggcagacatgtggagattggattagggtgagaaaatgtgtgtgggggagtaagaactagagttttctcattcccctgatgatagcactctgatggctttgcattgctctgttagataaattccagaaactgaaacatggactagaaaatggtgcatgatgtcatttttacctcttcctctctcgtcactgtttgtcttttacatcctagctcactatatcccatctacaggaatccacttagagttttttgttacatgagtcttggctagaggttggcagactatggcacccaggccaaatctggcctactgcctgttattggatggcttgagaaaatgtaaatggttttacattttcaagtggttaagaaagaatcaaaaggatgatattttgtgacttatgaaaataatatgaaattaaaattttagtggccgtaagtaaagtttgattggaacacagccacactcatccatttatgtgttgtttatgtctgttttcacactacagtgacagctgagtagttgagacagagactatgtcgcctacagggcagaatatatatgtaccatctggaccaacagatgaaaagtttgccgacccctggtcttgacaatgctgagtctttcacctacagtgttcttccctctactcactgctggttcttcctcatcatttaggtttcagttttatttttgctctcttgaaaagcctttcctgatcctcaaatacatcagagtctcttgttattacactcttaattttacttcattatatctttcgtaaattgtaatgctacgtcaatttttgtggtgatttatataatgcttgctccaaccattgtaatctgcaggaggatagagatcatatccacctcgttctttgctatgtcttggtccttaaccaaatggctggtgcacagtaggtgctcagtacatattttctgaataatttgaatgactcaataactcaataaggggctgttacagtactccatgggagaactaatgagacctgaatgaggcactgtgagatggcaggagatgggtcctagaaatttttagaggataatatcaatagaacattgacactgattggctgtgaggagtgagtcagatggaggagccagagctgaccactcacttcgttattgctgtcatttatcttctccttgtccttagcctagagtcagatgtcagaggaagttgggcagaatttggggttttatctgtcttgagatgttctaggaccaccatagctcttgaacaaagtcacctggatcctagtcctgcaaatatggaatttaatcatgtccttttcatttaaagtttatgtgtttcaggttgacatttgtctccttaataagaattgtcagatgaaaggaaaaatgccatttgaatttttcataacccccagcagtctggcttttccatttggtctcaatgattctgactctcatcttaatgaaggccaaatgtaaattaagttctgtcaggcttgagcagctggggtctcctatctttataaacatgaaacattgtagggttaacaaggtgcagactgaggaaggtcaagagagttgctgagctgatgtggatcctgacagctcaatgttaatgggaggtaattaacgtggcttgtaggggctacatggagatcttccaagctgtcttttaactcatttcctcttttgccattgtcagcagagcagaaagctaatcattttatagtttgagatttttcttgcttattccaaagttctggaaccaactgtctggaatgtcacaggattttgttgatggattcaggaaatatacctgctgcttctctctcccctgtctgtgcccctgtgcttctgtcctcctgataacatactgggaaaatgaggaaatgattctccaattggtagattctttggggggaacctgggggtttggatggctagagaggtggtttgataacttcctgctagctgtggaagctgtcacttgagtgctttgcagtaggaactgctgaaaagaaaaccctgctgcaggtcagggaagcttggttcttctagttctttctgtaacttgagaggctggacgaagctaatttttaaaaccttatttggccttattttgtcactcttgttgatgacataataacaccttttctctatcttaaaccttagtctaatcttgaaacttcatgaaagatagacaatataagtttctttccttgaaatgccatcatttaaatagatggcagtatggtggaaactagtctttcttagttagttactgtctaattactattcaactgtgttcatcaggtcttaatagtagcactaatacaagatattgaggaactttgggagatataacacaaatctatacagaaaagtacaggatttggagccaaacttgcatttaaatttttctgtaccacttaccaattgtgggatcttggacaagctaaaatcaacttctctgagtctcagtgtgctgagctataaaatgaggacaatagtatcagtcttgtagagttatgagttagtgaggtatttgtaaagtggcttatatagtagatactcaaatggtactttattttcattatcattgtgtttaaaagtgcttgtttctactgatgggcatttcagtaacatcctatcactaactgagataattttaaagactaaaatatcctatttcatggggctggccataatgagtgatatgttttttcctgttttattaaggaaaattctagaaaccatcatcaaagtttctagagacaatcatagaaaatagagaatagaagagcacagaacatattttcagtcattcatttatttgaatcacccacatcctatgtgtaataccaattccaaaggcagccaacttcgagctgtaaagctgattaacttacttgagtaccttctacttgtttcccttgacatttaccagtgccgccagtctcagaatgtttttacttcacaagagttattttatttaatctttacagcagtctgtgggacagatattatctctttttatattaccagatgaggaaactgaagctcaaaaaagttaaataacttactcgtggtctcatactatgtaagcaaacccatgtcaagagccacaccattagctctgttccctcatctgctaccttatgggaacctgtgcactttcagtgtgggaatccagaagtggtctctgccaccaagaaattacagtctagttaaagaataaagatacagagcaaccaagcagtaagagcagaacaagaaaatagatgaaaataagagctaaagcgtatgtagtgcttgttaatacatctggtacttttctaagcattttacccatgataattcatttatttctcacagctaccctataattattgtatttttcttttcttttcttttttttgagagggtcttgctctgtcacccaggttggagtacagtagcacagtcttggctcattggaacctttgcctcccaggcttgagcggctctcccaccccagcctcctgagtaactgggactacaggcacacaccaccatgcccagataatttgtgtatttttttgtagagatgaggttttaccatgttgcccaggctggtctcaaactcctgagttcaagtgatccacccacctcggcctcccagagtgctgggattacaggtgtgagccactgtgcccagcctaattattgtcttttacagatgaggaaacaggcacagagactttaagcaacttgcccaaggtcactcagctaataagtggcaaggctgggatttgaactttggcatttcacatccagagtacgggcttatcaccattttgctctactgcctctttcagcgtttgctttgcaggctttgcataaactagtttagggaagaaatttgtgggtgatggcttcgggaggatctgaggctgtgaacaatggtcagtagcttcattgtttcatttaagaaatactgagtgtctcctgtgtgagaggcactttgctgggcgctggagatgccaaggtgaatgagtgggataagggccctggggtaggcttctgggaacttagagtctagtgtagagaggcagaaaatagacacacacaaagtaattttgttttctggaaaatgctacgaaggaaaaacacagatgaacagatttggcatagcgagtgtgggcctctcttgggagtttttgtttgacctgaatgatgagataggaaggaggagcaacagattcactgtgggggaggaaagcacctcatgagatcagcaaaggaggtcagctgggccaggagggtatgagcaaggcacagaggcgtaggagggggtttggcgaagtgggcaaaggctgctgcatgcagccttgaggccaggggcaggagtttgagttttattccaagatcagtgggaaatggttgatgggctttaaacatgggtgtgacacagtatgttttatgaccttaaaaaaatcattctggcatatgtgctaggtagatagtaaatatttgtatagcaacaacaaacttcatactgttttttttttattattatactttaagttttagggtacatgtgcacaacgtgcaggtttgttacatactgtaatgttaaagggaagaaaagttagaagactaatgaacagtcttataaatacatttgtttaaagaaactatcagtatggaaaaaaagactggccatatacacacaagaaaacattaatactggtacactgttcatggttggaagagtttgctactgttttagcacaatgctcatgcttttattacttagtaattttccattcaaagcttgtagtcatagctaacctttctggttgacaacacttcattattgagcaagggattttttttttttctttttgggcttattttcctaaaaagcaacatgctagggacttcacaggcagaattttatctctgccctttagtgacacagtgtaacagcatgctgttttactgtatctgtgtggcagtatgaggaaaccaagactcagaggacttaagtagcatccccaaagctacacaatagtaggttgtagagcccagattctcacctagtccagtctgcctccagctcctgggatctaactattgcctctcactgcctgcttttaaagggcactcatttcttcccacttgccagggctacaggctggcagaccactggctgaatctggtccccaatcaggtttagtttgacctaccatgtgcttggaaaaaaaaaataaacaattttaaattagtttccaatatttaaaaattgagaaattttatctgaaaattcagattatttattttcctgaataaataatgaaagaacttggcaatacagggtccacacttccatgcagaagggaacggctggagctgaataggggctgccttctttagaaggggtcggcattcttcattttgcagcagtcctcacccagcctgctacactcatttcctttttcagccctacccctctgagcacttgaatttgagacttaggctgtgggaatttgttcaaggaatctgtcattacttttcctctagcaagcgcttagagaaatggaaaggcattccagatggcgaatttcttggtccagggctctcatgattccatgcctgtattctctcacacctctgggtctttgctcaggtttttccttctgcctggcaaacttatagtaatttcttccttcaccaggaaaacttataataatagttcaaaacccagccttcactgcctccaggaagccttccttgacttagggtcctacactctgtcccctgtggcattctatgcttatctctaccctagaatttattgcattacattgtgctgtatttatctcagtgtccctagcctccagagcaatgtttaaattctaacattaataacttattatatattttgatgggtggatgaatgagcggatgaacttattaaatcatctcatgccatttttgatggctaggtgcatttgtccaatcatttcattccaaactaaaggttcactgtatgcccaacataagttaattttctcttcctcattgtggaaaatgagatttgagcattactgttcctttccatcctagagccaccccttggctgcagtcctgttaccggagtcacagcttattttgtatgcaaagtgaaggctctagactgagacagtaactcctctgggcctctccactgtgtctttggactcctgtgatggataccactttaagttgctcccttcaccccccaggagaatccaagactcatcttctcaatcagaaagactttctttagaatgtttataccagggccctgtatattggaccagattcctcccagcctttgaggaatgaagacagtattgtcagctgctgttagggcatgtgttgtggattttctctccagggtgggtactggacttgtaactaaatacacagaatgttgaggctgatggcttgccttcatctacctggacagtgaatcctttccttattatcctgtatttgcatatttgatttataccaaatatgtgttgcattcttttagttttatagtccagcaaagtaatttttaaaaggcagacaaaagaaaaaaagttgttggccagataccttgtaacatttaataaatgtcagctattattataatactttaaaaaattttactttatggctatggcagactttcataaatatttcctttatatgatctatgacatgaccttgtgggataaatattactacttctcacattttacagatgaatacaagcctcaaagaaatgaaatgacttctctacaggtatcaaatcttggtgaaggtcctttgggcttaaactggagccaaatgaagtcccttggatcttaatgaaggtccttttggctttaaattctggtatatgtgtgtgtgtgtgttattctgctgtaccatgtttcttcctcatttgggttggtggattttcagctccataaaagcagggaccaaatctatcttttcataccttactgttttatatccccagagccaaacacagtgtttggcattgaaaaaatactcaataaacatttactaaatgaattcatgtcccctggccagccaggagctagccatgtgactgtagtgctgaagaccacatgcctggcttacctgttgccagtcttcctgacggctgtgcagggatgttggccacctctaggagtcattagtgtaaccagagaggtacgaggaaggattgtgaagttaggcttgctttatgtacacatggtatgattctgtgtcgatcaaaaattgaacaaaattcttttctcatagtggctaaaatggaagtcacacttactggaggaaaatacgatctttatagaaacaacactgaaaaggacaatgcatttaatgtgtgttgtgatacagtaactcatagcgtgtaaactgtcaacttggaaatctagaggctcagggtcaatggatgtccactgatgcaaggaaggtggcaggctagaagtccaaaaaggtgcaaaatggtattcttttggaggagtaagtaaatctcatttctctgaacacctgggctgttttactttcttttttcctattatccaaagtgaccataattgttctgttattgtagggatatattcatttaatcagtgaaagaaacttttgtctggtaactactaggtacaaagtactgtgcttggtgatggggaggaaaggaggaagccaagctcaccctttatctcaaggaattcccatatctagtaccaagagcgagaggctgtgaaagccattacccgccctgccacccccccgccatgttttattatcaaaatttcaaacatataaaaaagttgaaaaacttttacagtgaatactcagagccatcacctagagcctgccatggacatttactgtccttgctttatgacttatgttgtttccatctgtctgttcctctactcagcttacatttttggaataagttgggagattgttacacttgggaaggcagtttgaaatattaaaagttgtttacatttctgaaatattaaataagttttagttaagatattgactttgttttattgctatctacatacatggccaacacctgtactagactttattaaatatccactgtgtgctttcaaatcttctatcccatttattcttatgaaaatcctgtgaggtagatgttatcacttgctttgcagatgaagaaattgaggatggagggagttaagtagattgccacttatcaactttattacctctggcaacgttggaatgcaaacccaggtttctgactctaagaaatgaatttgaaaaattattgtaaaggttagctggtcaaacaccagcctttatcacacaggtacccctgtctacagataagacatcattggagcttacctaagtaaagcaaagcaagcaattagaaaatgagagctctcttattttgctgattaattattcattattttcttaataatgactttatttttctatcatttttagtattattacttcactttgattagagaaagcaacttctgatggtttaagttaaaaatcccagataacacatttgtttggcataaatttttaaggtaaatatgaactctagaataaaacgttatcaaagttattaaaagtttagctgttcaaagttagactcaaaatgaaagaatcatacttgagactgggtgagatctgtttcccaccactatgcaaactctgacccagggcctcttttgtttgtattccagcacattatagttacctctccaagagctgactttgtcctcttctttgcattcccctgaggtatttgtagtgagaaagaatgactaaatgatggaatgagttcattacctcttctgaacccaggggtcttggaagtgctgacacagctaagacctccctggaggcttgtctgttcatccagaatggccactctggattcctataaaggctcctgtctctctgaatcctccctgtatggagaggctatggattagataaacttcagagtgtttagtaataaaaacaagcttgatctcaactctgtggccctgtcaatacccatacctgcaccctcttgaaaagctacatcagtgtagcttctaggcttgtaatctgaatgatcagtgtcttttggctcaaaaatgcaaagtgaaggaatattcagaggaaattagagagctgcctaagtggctctatcctacctggcctccgtttctcattatggctttgctaaagggtctgaaccgtggcatggacgtacattttttctcagtaacgccacatgtgtagagtattgatgcttacccaagcaaagcaaaacaagcaattaggaaatacagtctctctctcattttaccgattaattattcataattttattgataataagaactttatttttctatcattgttattattattattattattattattatttcaccactgattagtgaaaattattggtcctggactatcaccagtccctgttctggcatttgggaacaactggtgcgtgtaagccctgaaactctccttcgtgctggcattctgtgaacctgagagagatgagaagagaaccagggactagagtgaagcctactgcagttgtcttggcatgaggctgtgtggcttggctttggctgggagtcacagacaagcccacggacctgagaaagagagtgaatcactgtacaagtatttatcgagcacctcccatgtcctgggaagcagtagctggagagtggtgaaggagtactgagttttggggttcaagtggccagggctttcccccaggctttttacctattatctgcattatctgggcaattcagttcacttatgggccttagttttctgtctaaaaaattgtgttgatatactattatgtatcagaaggtatttgataaattgcagaatgctggtggtattgatagattttcagatgatagtgacagaaaaagttgattgttggaaagaaaattagtgaggtctatttttcatatacttacctttagaggcaggtaagaaatctaagagtgaagggaaatggaattcacattgtttgaagggtaggaaattttaaaaatagtgctttttaatcgtccggaagacttggggagagggtattattcctgtttgagtgggtgggaacagtctgagagacacttacctcatgcagctactgagtgggtagagctggggcccagctcagatctaactccagcctgtgctgtttctacagcagctcagaaaccaaagttcaggggagcagaggagctggagacagtgaatccatcctgaggcccccctgagtaaatgcttccagggcaattccacttgcactattattaataccttacagggtgtccttcacaaatttctcagaatgatggctgtaaaaatgggtgtgtgttttagaaataaaaatattgtggtgctaacaagttcctgccggagttgttcaaggacgttcattcattcagcaaatatttattgaaaatttgttttgttccagacactttgttaaatattgggaatatagcagtaaggaaaacagagtcactattcccaggatgctcatattctagaaaggagataagagataaagtcacagtacagcattagtgcagtgggaacttgggttactctagaaatacagcccagttaggatcgaggggctcggggaggtaatatgtaggttgtgggccagtggatgaattggaattgggtaataagcagttgaggtgaggcagtttgtaaaagctagtctggtggcagtctgaggaaatgagacctccgtggggctgcaaatgcagtatagtgagagcttagactgcaagaagctctgtgaatccgtcaaaagttcctttaagtcccttttatatattccatgctattaattacaggattctttgcaggggtgaagggggacctcatgggatggagccagttcaccctagccacaatcagagaaaggtcagaagctatttgtgacatttttcccgactcttctatctcaaagacctggacctgagaactccggagaagatgagctttgagcactcacgtcctcactgggcagacagagcagctctcctcatttcagttgtctcaagactagacagtgtgcctgagaataaagcagtgaattaaccccacttgtccaagagggtgggactgaatactagacagggccctttccgcctctcttgggtggtggggggtggcgtgtgactcagaggcagtgacatcagccatgacttcattcatccacaggaaagacagtgtgcagaccgcgaacacggctgatttctgccctcccttctcgatgctttgtcttgctggggacattgtcatggtcctgctgttatttcccacacattttattcacgtctcatgtttaagctgttctttttcttcaccccattctttttggtctctttgttcatcttttgcttttgtctttattttcttctttctcctatttaatttttcttgtttcattttctttcctgtacttcttctcttttgtctccattttccattctttccatttgctctgtcctttctcttccctctgtgtcagaaatgtatacaggaacacatcctcctgcctcctatttcttctctcctctgggcttcccactaggttattgctgtcctaacattcctaaaactgtgttcacaaaacactctccacacaaggactgatggtggctcccattcttttctgactcaagtatctaatacaagtccagatttacctcttactgcatctcaacacaggtctctcagactgagcttctcatagttccttctccatggccatggatgctgctgatgcttctgcctgcacttttactcaggccattgcctcagtgtggactgacctccatcccatcttcctcagtctttgccttccctctagacacatatctgacattgcctcctaagtaacccccttacttacctccttcccacagcactgtctccttcatgatcatacagaatccatagtttataaattatgtattttagaacttgaattattctgtactatttatacattcttcctgcatgtttcatatgcatagattctttgttccacctagccagtaactaacctgaggataggaagtatattcctgcctttcatcttctatgagcatacctagcacatagttggccacaaaccaggactgacagaccatttttttgcaaagtcaagaaatattttacttgaaaaatagttatttgatgctaattctggggagatagatgaatgaattatagttctttcctaaaaaaagagctaagggtctagtagaagagacagacccacacgtaatttgagaagaacaaggattgtggaggaaactaatgtttactaggagtgtacaagaatgggcacatgaacatgtataatctcactgaattgaattcggctaacaatcctatgagttaaatgttgctaccaatgaacaaagtgagactcatagacattaggtgactactagtcagaaataacaccactaataagtaggagaaccaacatttggactaaggtttgtccgactctaaagcccctactctttcctgaagagggaaggatgtagtgaaagtgacattctaagtaataataagaacaatcgtaggtaaaaagtgcttactatgtgccaggtgctgtaaacagattacctatatttgttcatttgatcccccatcaaccctatggcataggcactattattgtcctcagtaatttttataggatgaggaaattgagatgaagagtagttgagtagattgctcaaggccacatagctacagagtactagagccaggatattcactcttgcattctggctctggagaagaggcagcagaatgtagtgaggccctctacatagagtagcatattgcatgatcagaactgctgttggaccagtctgtttggagaatcagggactgtggagatgctgacaggtgaaggtgttgagaggtgaggctaaagaggcagccaggaatcatcacaaaggaccagtgccctcctcaaggacccgtgacaaaacatgcaattttcctagaaatattttctgtgaggttggaccgttagggatccatcataaggaagagtttaagttgtggtcttattctactacttgagttgtgaaggaacttttgagttgtggcctttgtccatgcccagcgggaaatcacagtggaactctgcaacagtggtgtaaatgaacaagtaaggatgcacatacccaaatagactccaaagaaatgccagttgaaacagtaaagtacgcctgtcctttacgggttggagatgattaagtttgggttgaaggacatttgggaagaaagaagaagggacatctgtgtgagccagcttggaacagatgccaggttatcctcaggtgtcccagagcgctcaacatttgatggagcactctccccactgcagcccccctctccattggtacttggcagcaattcagtggtgctgcactgacctgggagtccaagccaggaagtgaatgaatccattttccaattaaaatgaaacttctccaaaggacctgctaaccctgagagaagaaatttatcttcctggcagtctggcttgcctagaatatgtctctgctcctgaaacagactgagaaaagccattagcttgaatgaaaaaagagaaactgggacagttcttattcacaacctcattcatttatccattcattccttttatttctgcagactttaatttggcttccacatgtctgctcattcattcatttattcattcattagctaacatgactcatcatctatagatcagacaaactgctgtgtcctaggagtagagatatttaataaaaaacatagctcttgcctttgaggagctttcagtctagtgagagagacagacaaatgaacagatgatgggaaatgcagtgatagggatattcatagagtactataggggcatagcataagagcatctgactcagcatagggatgtcatgggtgatttcatggagtaggaaacaccagagttgagtcctaaatgtgtacacacatagacatatacatgctattgcttctgtttctctgaagaactctaatacagggtgatgaggtgggcacctcttcatgaattaattgggagttgaaattagaatggtggttgaatgtaaggaatgagagaagaggtagaagatgactcctttggtagaggtagaagatgactcctttggtaactggatcaactggcactggaaatcaaggaggaggaacacacttgggggaagatagcagattctgtcttggacgtgttgagttggaggtacagtgggacatccaggagacatgtctcagaggagagtttgaattggagtttcagatttggcacgttattcagcgtgtagttggttggaatcacaggagtgattgatatttctcagagagcatgggaacagtgaaaagaacatttggatgaggtaagatccctggggagcagctaaagaaaagagcagctaaagaaaaggagcccatgaaggagacagaaaagcactgatgagaagggcgtgagaaggtcccggagagtgagaggttgaggaagacttcctcatttctcccctggtcccagtctttgactttctttcatgtctgctccaagacctgttcaccctttccaaagccttctcttcctattaggactgtctccctctctcccatagatggtaccacccacaaggcatggcttgatccaggtcactgtggcatctctctcatctcctccagtaagaaatgcacttctgcattatattatgttttagagaggcagatgactgaactcaaacattgggctgggcattagcgatgcaaaatttggtctgactttccatttacccgttgtgtgggacctggggatagtcttggtcccttcctgggctttaggttcataatctgcaagcatagttttctgactccttgccttgcctgccttgaagaattatacaggtcagatgagatcatgcatgtcaaagtgctttgaaaactgtgaaactctgtagcagaagagtgaatcttgttgacttatcaggcactttatattatttcatttaattctcacagcatccttgggggaagatgctaggaatgtggctttgaggaaactggggcttaaagaaattaatttacctaaagctacacagctgttaagtggtgaggacggcaatcaaaatcaggtatgccagactccagagttcttagaccccatctacttcagccttgttttcctaatacgtacagtggtgtcacactcctgggtaaagtcagctttgctgagtatgatgagttttcattaaaatgatagcatattttatggttgggaaatcaactctagtgtggattataagtttttcttttcgtacaagaagagcaaagcccttcagggggaggaaagtaggggaaagggatgcatataaatccagtttttgaaaattaaataaactatacagtggaattatttcattttacaaataaattctatgatgttaccgttaaacaagtcctcatctaatgggggtaatgcgtcttgtctattcaggtttttgtttcttgggtctttctcggcagtgacataaatatttattccacttgatgtttaggcctctgcttgcatctctccccggaagcctttagaaaagcctttagaaaagcctccccaggtcccaaaccctttccccgctctgagccctgtctgtgattactcattagaggcagatatatggccacacacaaaatattacaataatgttatgaggctgactcatcaaaccttggtatcaggcttattacgttattgtcatatatcatcttattaattatctcttcctttgtgtacatctttctctcgaaaggacctggctttagattttcttatatctcccaaaactctgcattttttttttcatgagttagacttggctcttgcccttcagaagtttgtcatttcaaggtagatttaggtatatcaatgaataattagggtacagcatgggatggagaggttcacagaaaaggtgacatctgagctggatttgaatcaagggcagaggtttgataaagggagaagatgggaaagtcaattcaagtagagataccagctgtaacagaggactggaaatatgaaagtgtaatgcatttgggaaagtaaaagaggtgagaaccaaatggagggtgttaggagatgagcccagaaagtcatcatcataatgatcacagccaagttggagccaggttaagagtcctgagagccagactacagagttaaaatgggattctaggccatgaggagatgtcgcaccatctttaataaaggaatggaatgggaagctttatgtttttagaaagatgcctctagtagtgcagacctctcagcttatctgcctatctgacttgaaatatttctgatgttctgtctctgtgcatgggagtttgaaacacacaattattttattcattctgagaagtttctggctgaggtttatgacctactccatgcttccagcgtcatatttcttttaagaatgacattgaagattacgtctcttcctgaaactcttttctctctgggctattggcctgtgccctaatttggagtcttgaacatagagtgaggataaggtctagctctttcttgggtagttgtgctggaaaacaacagcatgagtacttggaatgtacaggcagtactatttattgagtggggaattagggagctgttccctcccttttgtttactgctcacagcagataacccagatagaatccctttgcaattacacagtagattacttggataatcctttgtaactggtcatgcctatcttctcatgttgcccctcgaccctggtgtcactgcagtagctgcctcatttccctcacgagttccctaggtgtctagaagcagcagaaacctcacagcttccctggagtgggagggaaagggtgaaagctacttctctctgtcctgaggctggcagggcggctgcagccttgaatcttggacatactgccctacctccgccctctgcttagacccacagctgtgtgagctttgagtagtagcctcctcccaacaaatgctgtggtttgatgaagtaataattttttcttttttttaaaaaaagctgttctctttggttgctttaagctgagggattgcttaactcaaaggattgttgttggaatgcagaaggcttttgtgccaagtcatataacccaaatcacttttctttttttcttgaaaagactagtttttgttagttgcctggtaactggaggatagaaagacttaactcattcagcacagagagctcctagtttgaactctattaggccatcacctaatgagatacatctgaaattggtgtgtgtcgagggcctgctccttgcactctctaatccgtgcaacattgtgcatgggagatgataagtacataggagttacatgagctgtccaggattgaaattgtacggaaatgtgcttagaagggcttttgtttgtcttttcttctgtaaagagtggcaatagcttccattatgacatttccaaaaggcccaaaatcacacctctgattggactgggaggttcagggtggtaactgtggcatagtggaaggaaagaacatttactttagagctggaagccctgtgactttgggctaagcccttgtggtctgacccccagttccttaatgtgtgagtattgtgtattacctacacgcctctgcatcactctgtagattaaatgagaacactgttgtaaactgtggaggacttagaggacgatcactgtgtcctaatgcaggcccagtggttacaagtagagaattaattcagtaagattgaggcctttggctgggattgtatgggccagagaggaggagggacagagagatttttctgcagaactagactaaaaatccatctatgggggtaatgtgctgttggccaatatggcatttgatgacaaagcacttgtgaatcaggtagcctaatataaaaaactgcatgtggctgggcatggtggctcacgcctgtaataccagcactttgggaggccgaagtgggtggatcacaaggtcaggagttcacgaccagcctggccaacatagtgaagccctgtctcggggaggagccaagatggctgaacaggaacagctccggtctacagctcccagtgtgagcaacgcagaagacgggtgatttctgcatttccatctgaggtactaggttcatctcactagggagtgccagacagtgggcgcaggtcagtgggtgcagcgcactgtgcgcaagccgaagcagggcgaggcattgcctcactcggaaagcgcaaggggtcagggagttccctttcctagtcaaagaaaggggtgacagacggcacctggaaaatcgggtcactcccacccgatactgcgcttttccgacgggcttaaaaaacggcgcaccaggagattatatcctgcacatggctcggagggtcgtacgcccacggagtctcgctgattgctagcacagcagtctgagatcaaactgcaaggcggcagcgaggctgggggaggagcgcccgccattgcccaggcttgcttaggtaaacagagcagcctggaagctcaactgggtggagcccaccacagctcaaggaggcctgcctgcctctgtaggctccacctctgggggcagggcacagacaaacaaaaagacagcagtaacctctgcagacttaaatgtccctctctgacagctttgaagagagcagtggttctcccagcacgcagctggagatctgagaaggggcagactgcctcctcaagtgggtccctgacccctgacccccgagcagcctaactgggaggcaccccccagtaggggcagactgacacctcacacggccggatactcctctgagacaaaactcccagaagaatgatcagacagcagcattcacggttcacgaaaaacgactgttctgcagacaccgctgctgatacccaggcaaacagggtctggagtggacgtctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcccctctcctcctccaaaggatcgcagttcctcaccagcaatggaacaaagctggatggagaatgactttgacgagttgagagaagaaggcttcagaagatgaaactactccgagctactggaggaaattcaaaccaaaggcaaagaagttaaaaactttgaaaaaaatctagatgaatgtataactagaataaccaatacagagaagtgcttaaaggagctgatggagctgaaagccaaggctcgagaaccacgtgaagaatgcagaagcctcaggagacgatgcgatcacctggaagaaagcgatggaagatgaaatgaatgaaatgaagcgagaagggaagtttagagaaaaaagaataaaaagaaacaaacaaagcctccaagaaatatgggactatgtggaaagaccaaatctacgtctgattggtgtacctgaaagtgacggggagaatggaaccaaactgaaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcaggttacccacaaagggaagcccatcagactaacagcggatctcttggcagaaactctacaagccagaagagagtgggggccaatattcaacattcttaaagaaaagaattttcaacccagaatttcatatccagccaaattaagcttcataagtgaaggagaaataaaatactttacagacaagcaaatgctgagagattttgtcaccaccaggtcggacctaaaatagctcctgaaggaagcactaaacatggaaaggcacaactggtaccagccactgcaaaatcatggcaaaatgtaaagaccatcgagactaggaagaaactgcatcaactaacgagcaaaatcaccagctaacatcataatgacaggatcaaattcacacataacaatattaactttaaatgtaaatggactaagtgctccaattaaaagacacagactggcaagttggataaagagtcaagacccatcagtgtgttgtattcaggaaacccatctcacatgcagagacacacataggctcaaaataacaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaggaagagctaactctcctaaatatatatgcacccaatacaggaacacccagattcataaagcaagtccttagagaactacaaagagacttagactcccacacattaataatgggagactttaacaccccactgtcaacattagacagatcaacgagacagaaagtcaacaaggatacccaggaattgaactcagctctgcaacaagcagacctaatagacatccacagaactctccaccccaaatcaacagaatatacattttttttcagcaccgcaccacacctattccaaaattgaccacatggttggaagtaaggctctcctcagcaaatgtaaaagaacagaaattataacaaactgtctctcagaccacagtgcaatcaaactagaactcaggattaagaaactcactcaaaactgctcaactacatggaaactgaacaacctgctcctgaatgactactgggtacataacgaaatgaaggcagaaataaagatgttctttgaaaccaatgagaacacagacacaacataccagaatctctgggacacgttcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcgagaaataactaagatcagagcagaactgaaggcgataaatcgagacacaaaaaacccttcaaaaagttaatgaatccaggagctggttttttgaaaggatcaacaaaattgatagaccgttagcaagactaataaagaaaaaaagaagaatcaaatagacgcaattaaaaatgataaagggaatatcaccaccgatcccacagaaatacaaactaccatcagagaatactacaaacacctctacgcaaataaactagaaaatctagaagaaatggataaattacttgacacatacactctcccaagactaaaccaggaagaagttgaatctctgaatagactaataacaggctctgaaattgtggcaataattaatagcttaccaaccaaaaagagtccaggaccagatggattcacagccgaattctaccagaggtacaaggaggagctggtaccattccttctgaaactattccaatcaatagaaaaagagggaatcctccctaactcattttatgaggccagtatcatcctgataccaaagcctggcagagacacaattaaaaaagagaattttagaccaatatccttgatgaacattgatgcaaaaatcctcaataaaatactggcaaactgaatccagcaccacatcaaaaagcttatccaccatgatcaagtggccgtcatccctgggatgtaaggctggtccaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagctaatatcacactgaatgggcaaaaactggaagcattccatttgaaaactggcacaagacagggatgccctctctcaccactcccattcaacatagtgttggaagttctggccagggcaattaggcaggagaaggaaagaatgggtattcaattaggaaaagaggaagtcaaattgtccctgtttgcagacgacatgattgtgtatctagaaaaccccattgtctcagcccaaaatccccttaagctgataagcaacttcagcaaagtctcaggatacaaaatcaatgtacaaaaatcacaagcattcttatacaccaataacagacaaacagccaaatcatgagtgaactcccattcacaattgcttcaaagagaataaaatacctaggaatccagcttacaagggacatgaaggacctcttcaaggagaactacaaaccactgctcaaggaaattaaagaggatataaacaaatggaagaacattccatgctcatggataggaagaatcaatatcgtgaaaatggccatactgcccaaggtaatttatagattcagtgccatccccatcaagctaccaatgactttcttcacagaattggaaaaaactactttaaagttcatatggaaccaaaaaagagcccgcatccccaagtcaatcctaagccaaaagaacaaagctggaggcatcacgctacctgacttcaaactatactacaagtctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccaggagaaagctgaaactggatcccttccttacaccctatacaaaaattaattcaagatggattaaagacttaaacgttagacctaaaaccataaaaaccctagaagaaacccaggcaataccattcaggacataggcatgggcaaggacttcatgtctaaaacaccaaaagcaatggcaacaaaagccagaattgacaaatgggatctcattaaactaaagagcttctgcacagcaaaagaaactaccatcagagtgaacaggcaacccacaaaatggcagaaaattttcacaacctactcatctgacaaagggctaatatccagaatctacaatgaactcaaacaaatttacaagaaaaaaacaagcaaccccatcaaaaagtgggtgcaggacatgaacagacacttctcaaaagaagacatttatgcagccagaaaccacatgaaaaaatgctcaccatcactggccatcagagaaatgcaaatcaaaaccacaatgagatatcatctcacaccagttagaatggtgatctttaaaaagtcaggaaacaacaggtgctggagaggatgtggagaaataggaacacttttacactgttgttgggactgtaaactagttgaaccattgtggaagtcagtgtggcgattcctcagggatctagaactagaaataccatttgacccagccatcccattactgggtatatacccaaaggactataaatcatgctgctataaagacacatgcacacgtatgtttattgcggcactgttcacaataggaaagacttggaaccaacccaaatgtccaacaatgatagactggattaagaaaatgtggcacatatacaccatggaatactatgcagccataaaaatgttgagttcacatcatgtcctttgtaggggcatggatgaaattggaaatcatcattctcagtaaactatcgcaagaacaaaaaaccaaacaccgcatattctcactcataggtgggaattgaacaatgggaacacatggtcacaggaaggggaacatcacactctggggactgttgtggggtggggggaggggggaggggggagggatagcattgtgagatatacctaatgctagatgacgagttagtgggtgcagcgcaccagcatgtcacatgtatacacaggtaactaacctgcacattgtgcacatgtaccctaaaacttaaagtataataataataaaaaaaaatccacctagttttcatcaaaaaaaaaaaaaatggcagggtgtggtggcatgcacctgtgttcccagctactcgggaggctgaggcaggagaatctcttgaacccggggtgcagaggttgcagtgagctgagatcgcaccactacactccagcctggcgatagagtgagactccatctcaaaaaagaaaaaaaaaaaaaaaaaagaaacaaacaaaaaaaaactgcatgggatcctcacagatgcctgctggcatctcaaggtaagggatcaggcttctggagacatttcctctcattcagtccttattcctctttgctggcctatctccagacttttcttttgtagagaaagcagggaatattgctatcttcccttctgagaccatgtgcatacttaagagtacctcagacttcccacaacatgttatttctagttgctcatcccacaaatatttgttgaattactagacaaactgctcagcttcatcttccagttcctgttatgtgaggagtacttcagaggttatagagggcttccacatgtgttatctccttagagaggagaggttggactgggatctccagctttgattggtgacggttagtgtggtctcaaaaagaaagaacgcagggactccttgctcctcctattcccagtgtctctttttggcaaaaggcttgagttctttgtgacattctacttgggttctgttgtcccacagtggctggctgtgtggctacaggctaaaagctgtcgttatataatgtctttaatgaccacacacaagatctaaagtagtttttttttttttttttttttgcctgaatttaagaagattgttgtgctttggcttgaagcactggttgttgctgcggtggtttggcggttcatatctggtcactggcctttgatttctggaacctttagaaagaggctgccttttctcctctccctgaccactgattgctgaaaccacaagacatatggaaatagatttcagggactagccaaaagccattctggtagtttgattcacatcgtctcaaaggctaccattttctgactgtggcttgttagatcctatacagagatactactagttcttagctgtgttaggaatatttagtatctttaagttttgcttgatttaacattaacatcttagaatgggcgttcaaagagaagtttagggcaggtccctttctagacacaagctttcacctagatgtttaggaagttaaaacaacaacagtaacagagaatcagcttgatactttgccttttagatctgaactcttttgatattgttttgatagggccagcacttgggatagtaccgtttatctgctgtaaatagatgttggtgtttatatagtagtgttagggaagcactatgtaggaggaactcacagaattctgataaaggccagttgtatataaaatagatataataatacccaggacttttgtgttgctctaaggagataacacatgtggaagccctttataaactgaagcacccctcacataagaggaattggaaggtgaagctgagcagtttgtctagtaattcaacaaatatttattgagttcctactgtgtgttaccctgcggcaggtactgaaatatgcctcttttggaacttctgcattgttgcctttaggttcccagagatactcctatgcttataattccttttatagctttttggagagggagtaatagaaaccaggacatggaaagttatctggatggtaggaaacctttcttgctagttcctctgtcttctttactattctgtttttgaaattctacctcttcaggtgtttgacagaaaatggccacttcatgcttttcaagtttatctcacctccagttccattcataggcagaagtgaaatggttccatttgggtcctgattctaagttcttgggagaagaaatctggttggtacaactaggtcacatgcctaaacctggtccaaccaagtgcttgtagtaaggggatgagagttaagtagtttctgcttggcagctgagggtcctctcagttggggtggagaagaggagacaatcatccaatgtcatggtgaacatgactgacaagatccttgacctcacagagcttatagtcagtctgtcaggaaagaaagacttttgtattagtctggtcttacactgctaataaaaacatacccgagactgggtaatttataaaggaaagagatttaattgactcacagttcagcatggctggggaggcctcaggaaacttacaatcatggtggaaggagaagcaaacacatccttctgtatttggtggcaggagagagaagtgcagagtgaaagcaggggaagccccttataaaaccatgagatcttgtgagaactcactcgctatcatgagaacagcatggaggtaaccactcccatgattcaattacctcctacagggtacctcctatgacacttggggattatgggaactacgattcaagatgagatttgagtgaagacacagccaaaccatatcaacattacacaaatgattgtgggggtggtatgggttgtatgacaactagacctaaactaacaatatgacttaccggctttgatttccaggagatcctggaaaccccctcaaggaatggtggtgtgtagggttaaccaaatgaggaaggggatgatgttgatcctgggagggcacagggtggtgggtgaggaatgaatgttttaggcagaagtggcaaagtaaagaaaatgcccagcagtaagaaaaagcctggccattttgcaatacagagaaccaaatctttaaaatgtacaatggcttgcttatgtggccattctctttgacttagactggaagttctttgagggcagggactatcatcttttttctattgcctttgtaaccagttggcatgtggagaattttatatggcaggggacatttagtttcattgggcagtttctgagtacagcttctttccagcttatatctgctctgaaatcttatatgtccatcaccattcactgggaaaatggattgcataccttacagactgtgcttttgatatggtttggctgtgtccccacccaaatttcatcttcaattgtagctcccataattctctcatgttgtgggagggacctggtgggagataattgaatcatgagggcagttttccccatgctgttctcgtggtagtgagtaagtctcacaagatctgatggttttataagaggttttccctttctctgggctctcatttctctctgtggtctgctgccacgattgtgaggcctccccagccacgcgaaactgtgagtccattaaacctatttttctttaaaattacccagtctcgggtatgtctttatcagcagtgtgaaaatggactaacacagctttctatccttccaggttggcaaagagggttttaagggaaattacgatcatttttggaaggatcaagcattgtcagtttttctttcctgtataagtactgcttttatattattcctacccccaccaagctcctgaacagatgtttcaatgggcattgttggctatgcttttgttttgaaaaatttgaaacattattgaaagaggagatggtagaaaaaccccctaattgattctaatatatatttaatttggcagaacttgagagagatttgctgggataaggcgggacatttctttgatctcccggacttcttatcgtggaaggcaacaggtgtcacagcacggtatgttaattacaagttggattgtgtttgcgttcttccattcttggatgtctgtctatatattgctttcttaactctctttgactggatatacttttggtacatctgcatgtgattttgcatacatgaaacatcttgaatctatcttcgacctccactgcacatgcccaaacactgttgttcctaagagccctggaatgtgagtatccaaggtgaagaccattcattaaaattggtcatatttgaaggagatatgaaaaatccagagtgaaatgtggatttttccaaaggcactttttacatgatgaataaaaggaaaaaataaacacacacacacacacacacacacacacacagagtcacgcattccttaaggacagggatacattcagagaatgtgttgttaggcaatttcattattgttgcaaacatcatagagtatactttcacaaatctagatagtgtattctactacatacctaggctgtatggtatagcctattgctgcttggctacaaacctgtagagcatgttactgtactgaatactgtaggccattgtgcacagtggtacttatttgtatatctaaacatagaaaagatatcataaaaatacaatgtaaaagataaaaagtagtatactcatatagggcacttacaatgaatgaaacttgcaggactagaagtttctctgggtgagtcagtgagtgagtggtgattgaatgcagaggcctaggatattactgtacacttctatagactttataaacactgtacctgtaagctacactaaatttattttaaaaatttgtttaataattatcctttgcttactgtaacattttttacttcataaacttttaaactttttgacttttttgtaataacacttatcttaaaacacaaacacattatacagctgtacaaaaatattttctttgtattcttattcaatatgcttttttctttttttttcattatactttaagttctagggtacatgtgcacaacctgcaggtttgttaattatgtatacatgtgccatgttggtgtgctgcacccattaactcgtcatttacatgaggtatatctcctaatgctatcccccgcctccccaccccacaacaggccccagtgtgtgatgttccccttcctgtgtccatgtgttctcattgttcaattcccacctatgagtgagaacatgcagtgtctggttttttgtccttgcgatagattgctgagaatgatggtttccagcttcatccgtgtccctccaaaggacatgaactcatcctttcttatggctgcatagtattccatggtgtatatgtgccacattttcttaatccagtctatcattcatggacatttgggttgattccaagtctttgctattgtgaatagtgccacaataaacatacatgtgcatgtgtctttatagcagcatgatttataatcctttgggtatatacccagtaatggaatggctgggtcaaatggtatttctagttctagatccctgaggaatcgccacactgacttccacaatggttgaactagtttacagtcccaccaacagtgtaaaagtgttcccatttctccacatcctctccggcacctgttgtttcctgactttttaaagatcgccatcctaactggtgtgagatgatatctcattgtggttttgatttgcatttctctgatggccagtgatgatgagcattttttcatgtgtcttctggctgcataaatgtcttcttttgagaagtgtctgttcatatcctttgccccctttttgatggggttgtgtttttcttgtaaatttgtttgagttctttgtagattctggatattagtcctttgtcagatgagtagattgcaaaaattttctcccattctgtaagttgcctgttcactctgatggtagtttcttttgctgtccagaagctctttagtttaatgagatcccatttgtcaattttggcttttgttgccattgcttttggtgttttagacatgaagtccttgcccatgcctatgtcctgaatggtattgcctggctttcttctagggtttttatggttttagttctaacatgtaagtctttaatccatcttgaattaatttttgtatagggtgtaaggaaggaatccagtttcagctttctccatatggctagccagttttcccagcaccatttattaaatagggaatcctttccccatttcttgtttttctcaggtttgtcaaagatcagatggttgtagatatgtggcattatttctgagggctctgttcttttccattggtctatatctctgttttggtaccagtaccatgctgttttggttactgtagccttgtaatatagtttgaagtcaggtaacgtgatgcctccagctttgttcttttggcttaggattgtcttggcaatgtgggctcgttttcggttccatgtgaactttaaagtagtttttttccaattctgtgaagaaagtcattggtagcttgatggggatggcattgaatctataaattaccttgggcggtatggccattttcacaatattgattcaataagcttttttctattaacttttttttcactttttaaacttttctgttaaaagctgagatacaaacatacacattatccaaggcctacacagggtcaggatcatcaagatgtcactaggtgataggaatttttcagctccattaatatcttatgggaccactgtcatatatgcagtctgttattgactggaatgtcattgtgtgatgtataactcgtgtgtgtgtgtgtgtgtgtgtgtgtgtgtgtgtgtgtgtgtatattttggcctctaatattaactaggagatacatttttcaaggaagctgattcagctggatggatgtgttatgtacttgtttgctttttatgtaaatgtacctcagttatcccatactgtagaagtatatatgttgaagtcaacaactatttttcagtaagttatgaatgttaaaaatagagcatatgctacacaatagagacttgtataaaatactcattgagtgtgaaattgtggctactataattaacagagtgagtgtatgtgtggggttacatagacaggttggacatgaaatctttaagtatgacgagcctcttgtcatgatgacctcagatttaaggagatgcctaaggtcaaggcaggtcttctcatcttgaaaaagatttagaatctgggttgaacaaacctgtgaagaagggaatcatttcccagaggatagataaacctctagtaattagggaggcaggtattgtatcttaaaatcagcttattcagagaggggtcagatcttaccctctttccttcttgtttgaattcaagggaagcgggaaatagcagtaccatttctcctatctcattcttttttgtagtgagttgatagggtgtgataattcagcagcgggggcttccagcagggagacagcagagaacatttcagaagcatgtcattcttaatgtcagcaaccccgaacctccttgcggtgaaacaatcattagccaaaggtcctggggcagagagatgcatatgcttgtgaaaatggcctctgcaaacctcaggtacatgccatctctggcaggaggtccctggaggagtgttctcaactttaccctggaaggtgtaattagtcaccattatggttatcatcagtggggagggcagtgtgtaggtgaggatatcatcttgggcattcctcttttggtgtgatgttaattgttcaaagttatttctgagagaatctttctctaggttttttcatcattgtacatccgtgaaagaaatgttttgatcattttggccaaatggtcttgtttgttagtcaagcagtgctagttgtcatgtgtatgggcaataccccattggcctgcaaatccagaggactcaaagctggaacaagagatggaggagaacgtggctttccttctctttttctttgacattttactcagcactttgactgcctccctgattctttctgatggctctgggtattctgtgtcccatttcctggtttccggtgccatattcaggcaccaaggagagggctttttgaagttagctgtggctcagataaagtgtggtggcatgcatacacacggtggactaacaatatgacttaccggctttgattttgccacactagttgtgtgaccttgggcaagtctcttcccttctttgattgtcactctttttgtctatagcatggagattgttatacctattttgcaaagttcttgtgagaatcctattaaagcaatttttccaaattagttggagtataggaattacctgaatgatttgttcaaaacatgtatccccaggtcttctagttttcagcctaatgaatcagaatctccatgggagatgtgggaatttgtatgttaacaagtgcctaggtagtatatgatcaggtaactttggacaacactgcctaacagaatatacatgaaggtaggatgtgacactgagtgagagattggaagtgttttaaaggcctaatgaattttttgaatttaaaagttgtaaacaaaaaataaaattctaaggccccccgccatctgaatggaccccttctcttggccaaaggcattccaaatttaacctgaaaaaccagttcaggccatgatgggaagggtgtgggtaagacattcccccttatacagtcctcccttttggaattcaggacaagccaaccaatactaacatcaacaaaccttaagtctcataagaaatgtttacagtctattctctctgaagcctgctaagtggaggcttcatctgcatattaaaaccttggtctccacaactccttatcctaacccagacattcttttctattgataataacactttcaaccaattgtcaatcagaaaatttttaaatctacctacgatctggaagcccctgctttgagttttctcacccatccggatcaaatcagtattaaccttacatgtattgattgatgtctcgtgtctccctaaaatgtatagaagcaagctgtgccccgaccaccttgagcacttgccatcaggacctcttgaggctgtgtcacgggtgcgtccttaaccttgggaaaataaactttctaaattgattgagatttgtctcagatacttttgggttcacaaagtggagggcgtcttgttaacttatcagaacatgcttgggggcttctagccttgcctttgacaatctcaaaccttgaggaagcagaaagtttaatgctcagaaatgatttattggctgtctaatcatccctgccatttttattggctgtgacactcatgactcattctattttcattagtataaattaatcatcccgttcccccacccaccccgtacttgtgagcaccttcagagacctcccttcccatttccctctcttccagagagcaaagcctgtggaccttgggtaccaggttcctcttgcaaaggtggttgccctttcccttggcccacttacagcttgcatctgtgtttctctctcttatttactcaatatttctgccttctctatttctacttgcatatcaaggtgaaacaaggaacccctctgagcttccttgattgtagatggaaataatgacaacacctgctccatggggttattgtagagaaagcttctaacacaatgctgagaaagctttttaaaggtattagcgatttcatttagttccctttctctatcagttttggcaatgagtctttacattaagcatagaggaaagagggaaatccttgtggtcagactgatctggtttcagtgtctccatcatgtgcagtctgtaagaacctggagcaaattatttacctccctgagccttatttcctcatccataagccctctcagggctattaaaacagttctctgggtaaaacctctgtttttacacaataaagggttcttttaataaaaaaaatccacattgtctgttctcttttctagagtaaggaagatgagggtctgaatttgaatatgccaattccaaaaaaactttgggtaataaaacaccaacttggcatcctctgggccaaggagagattgaaatttggtgtttatttggctcttacatgtgattattttgggaggctttggggaaaatgattgccaaaaaggctagagggtcttttttaaaaatacgttttagtagagtcaagactaacaagtgatcgaatttcaccctgtcttaaagctttcaaacttgtttttggcaatgacagtgtgtaagaacacctcctcccctttctctcttccttctccattttcctctcctctctttcaggttttgtttttgtttttttacccattctccccttttattgttctcatcctccgaaatatggcagctacttttctttatctgggtcactgagaaaatcaccatttggcccatgattagtttgtaattcagctccattctttttcttatattaatgaaaataattattgctatttttgttaataataataatggtaattatcacttattgagtgcctttcctttatctgtgctaggcatatttagcaaatgttaactctgttagtcctcatgaccatccttacagcaggtggtgtcattaccgctttgcaattcaagaactgaagcagaatgctttagtaatttgccacattcttgctattaagtgggttactgtctacaattttgatgacatgagaaatgggaagtcaaacatttgaatagtaggaattttttagtagtcagaaaaatatatgtataaattctccctctaaagagatttgaggtgactaataataataatataagaaaaagtcgtacaaaatagaaaaaaatcagaatggagtgaaaataatgataagataactgagctgaagctaagagctttagagaacctttagagaattcataattactaataactttgtttccaagcttcctagtggccaaagcaaagacagagcttaatcaagattaactgagtgaacagataaaaactttactgctgttcaagggaagtagaactttttctaacattgggagtctgagagaaattaatcctagatgatcaagggtagacaatataaattatttaaaagtatgtgctattaaatttagttataattttgaacaaaattttaattttaaaatagttttaggattatagaaaaattgtgaagacgctacagaattcccatatacttgatgtccagtttctcccattaatatattattatgatacatttgtcataattaatggactgatattgatatattatcattaataaaattccatactttattccgatttttttagtttttacctaatggcctttttaccatgttacatttagtcacgccttctcaggctcttcttggctgtgatagtttctgcgtctttctttctttttgatacccttgacagttttgaagtgtattggtcatgtatattgttggatgtccctccattgaaatttgtctgatgttttctcatggtgagacttgggtagtttgtttttcggaggaagaccatagagataaaatacctttctcaacctatcaagcgaacacactcttatcacaacttaacactattgatgttcaacttgatcacctggctgagatattgtcaggtttctccactctaaattactcttccaccccccaccccccaccatattgtactttttggaaggaagtcactatgcacagcccacacataaggagtggggagtagttatgcttcattttcttgagactgtagtatctacatatattactttgaattattctttatgggagatttgtcttgtctcagttcaccttttttatggctttgaactaaaataaattatttacaaggcttcttatgtacaaacaagagacactgtaagtaagtttggtttactggttaaatgttagaatttctgagacatttctgtggcatatgcgaaaacggttgaatttctataattttaggtttattatttcttatatttctttatattaaatttacatattctacttactcattttacttttcctctcccctccattataatgtataattctgtatgggttattagtaaatattctaccttttcctttaaagagatgaattcatggcttttagaaactgaagtctctttaaaataattattacgtttctgatgtgtgtggttctctgtgttttgggtttataagggatattattgtattgttattcatcttgtgggtttttaccagtctgtcaggagatgattatgttgggttattgatctgtagtcattttctaaatacaattcataggatctcaaatacaaaaccattatttagactcttattctactgatttttcttttgttaaaaaattggaaatatgctttgtacaacttatttttttacttaatatgttgtatttttcatattaatgtataaaaatatttttgacatctgtatagtatcctatcctatgtcagtatcaattttgtcaagggtttgggcttgaaatgggatcttattttaatttgcatttttgattattgaatgcaattaatttttcttatatttatcaaccacttatttatgtatgtcattgtcaattactaattatgacaattagtgttatatatttcaatgatgtttatgtcaattgctaatatttgtattgggagttcagtgttttcttcaattttggtgagaatttaaaaaaaaatttttttgcagtataatttccagaaaaatttaaacctacagaaaacttgagagaatggcatattgaacacccttataccttttacctacgttaatcagttgctaacattttattacttttgtgctctttagtgcacaccttacctacctctgacacacagacctgtaattattttgctgaaccatttgtaaataaattgcagacctcacagtattctccacctgatcagccaatactaacaacattttcctttataaccacaacatcattatcacacttaaggcaattaaaattaatcctcatactcccttacaggtatccctgctgttaaggattcagagggccactcactctttcttgctattggagttctgactgatagagactacattaaaacatattagctaaatgaggagtgaaaagttgtcttattatctcagaaaatactctttagcctctagtgtatagaacttctaatatactagatggataatacagctcagaagtgcagttaaaccccgtctgcatgttcaggtatgtgtacatacataggagttggggcaggaaggaagacccgatttgccaaccctatctcaagtctagcagcttagcaatatgaatccagacctgcttgggtatgattaccacatggcagtgggaagccatgctggtcacacttgggcataggaggtgaaagtgtgagctcattattatcaccttttctttaacacagtgacccttaaaatgtggcttaatctattccagtctcttaatgattacatgaatttcccttaccgtcttggagaaaattgagtaagaggatggggtgcaaagtcaactctgtgtctctggtgcttctctgagtggagagaggaggtcgggtggaagtctcattctccccagagagcagaggcagcagcaggagaagaagggagaaacttgcaccttaatacgtgcctgcctgtggtgactacagtccacatcccttccttggtacttggcctcttcatctcctgtctcattagtatatctgagataagagttgatttttttagaaaacatctttagatgtatatagtatacataattacatataattcacatactatatgattcactaatttaaagtatactattcaatgatttttgcagattacattacttatttttattaattttaataatacatatagcataaaatttgccattttaattatttttaggtatataattcagtgtcatgaattacattcctcatggtgtgcagtcattaccactatctatttctaaaacttatttatcaccccaaacggaagctgctactattaaataataactccccatttccctctttacctatcccctcttttttttagacagggtcttgctctgtcgcccaggccggagtgcagtgtcgtaattttggctcactgcaacctctgcctccagggttcaagcgattctcctgccttagcctactgagtagctgggactacaggtgtgtgccaccacacctgactaatttttgtatttttagtagagacagggtttcaccatattggttaggcaggtcttgaactcctgaccttgtgatccgcccacggctgagtgaacagataaaaactttactatttttatccctccctctcccctcttaaactctaatctactttatgtctgctatgaatttgcctattccagataccccatttaagtagacttatatagtatttatccttttgcgtctggcatatttcacttaacataatgttttcaaggtgtgtctatgctggagcatgtgtcagcctttcttttttatgactgaataatcacatcctattgtgtgcatatactacattttgcttgtccattcatcttgtccaaatggacctgttggtggacatttgcatcgtttctaccttttggctattgtcaatgatgctgtggcgaacattggtatataagtatctttgggtctctgcttttagttctttttggtgtatatctaaggagtgaaattactggttccatagggtcattctaagtttagcttggtgaggaaccaccagatgtttccactatggctgctccattttacattcccaccagaaatatatgaaagttctaattcctccacatcctccccagctcttatttccctctcctttaaaaaaattatacccattgtagtagatataaagtagtctcttattgtggtttaagaattgattttttaaaatactagaaatctgtgggatgaaagtaaaattgattgaatttatatcatcctagaagtaactttttttggcaaggataccccagggagtgtcataaaattaaaaattaaaggtgtctgagagtaaggggagaagcacagttacttctgatgtgcttgatgctaaagctccttgatttgcattgttttatggttgtgttgaaggatgatttctcagaacagtggtatttaaagcagctcttctaagttctaggaaggattcagtcatcctctctcaccagcttattttttagtatatttaatagtgctgagaaataaccagtaaatattagatattctttacccttatttttgagaaagaagagtgttttcactctctacagaagaaatatccttatctcttcactaatgatagtagaaataataggcatttcaaaataacagttacttaaacacataagggctcattctttcctgtgaataaatatagatatatggagtcttgggctactgtgatttccccataaagtcatcaaggacactagcttttttgatgttttttagtcctgagttctattttcaagatcacctcatggtccaagatggcggttgaagtttccattatcaagtccacagtccatgtagcaggaagaaggaagtgggtgtggtgcatacaaaggatgtgcctcacattggagtgagccttctttaaacaatcttcttagaagatctacgtcatacttgtgcttgtatattattgaccagcagctaggtttataatcaaactgaggtgaaggggaatcggggcagtgtaggcttttatctgggtgtcttcctatccaaatattggggttttcttactaaataaaaagggagaattgatatggggtgggtaaaaagacactcaaaatcataatttctcagcaatttacattgaccagtatcacagacaccaatttatagtccaatgatagtcacaaggtaaagggagaaggtggtgatcatgagggagatagtatataatctgagcaatgtaactcacaagtttcattattcattaatacattcattcattcacttattccttacatatatattagtaaagcatctgtgaggcattctctccctaatccagtaattgataggtacacatgtatttgactattcaaacccgtataagagccaaataatccttagttcaaagttttgctctgccacttttaagataaatccgaactcagttaaatagcttgtggatggggtgaggaagagggaccatttagaaacctagtaaacctgtggttcgatgacctttttctccacctcctccctggcttgggatttgattttggctacctgtggagagagtcatccactgaggggtctcagagacattgtgggggtgaagaaatgggtaggtgcccaggagatttcaggccagcccaacctgagttcagaggcttaaagtccagggagggcgagagaggatgaagcatgctgggtcagtcgggctggaggcagtgggggagtcggagggagtaggaggaagtaggaggtgctaacatcatgagaagcatgagttaaggcacaggttctcagggactgtgccttgcacttgtactcacttgttacatcactgactgtccctctctgctacattgaggcaaagtctgaggaaggttgaggttgcttctttctcttttcattagtaaagcaaatctggatagaaaagggtgagaagccccatctttgtcctttggaggaaagggtaaaactgtgtgacctcgacgattatgatgtgcactcttcactgagaaccactagtctgaatctgttccatttctataaagctttttccccagttctctgctgtgtacgtctagatgtggattttatgtggctgaaagatgatctctagcatgactgtcattttccaactgagcagcagtatagcttttcctttactgaacaattttctctgagaccttgaatcacttttggaatttaatttcatttgctttttcaatatgataaagtagaactctctctgaatttgattcctcacttacaaatagatatgatactatattctctgttgaaaatgttttggaactgtgaagatgctagagagttagatctcgtgtttcagggaacagaactgaaactcagaagggtttcattctgagggtgaagccagtgtgtggaataagagttaaattttaaggggtacattcctggatcatgccttgttcaggagtctttttcctgacccaagaaggcctccctcaggatacagtgggcatctcagtctttgtgaactcttaaattcatttcttacccagggtggctaactctgtcagtggactattttgtgaacttcatactttcggaatatgttatacttatgtgattcttggtagtctcaagaaccttggtagaggttcaaatcagtcaatctggttaaaggtatcagtattcagtcttggaatcaagtggcactagagctcttaaggcttggcggttttcaggacctacatcacaagatacagaagtggtgtggcttggagctcgtaagactcgtgtctggtccaaccaggtaacttggggcccctggcacccatatcagacttttctcatctgcaaaatgtgctgcttggagtgggtgatttatttagtacttcccaggcccaaagttctgagtctgtaagatgtagtggggttgaccagcatctccttttggattctcctttaaaactcattcctttgaaaggagattgctaaagtcaaaccttagaatccaaccctttgggctatgatttaatgttaaaatgctgtaccctttcctttcctcctttttctcctttactacttctattttgtttctttttcgaaaaaatataccttcttttaaaatttttcttcatttttccttcttctctgtaaattatcaagggcctttgaagagaattcttacatgttattaagaaattgcagtcagggagccctctgttcccagatcatttagaagattgcttttccttttgttaaatacaaaaaattgtcaacctgtattgttaaaatgtgccaaaaactgcattcaccaataaaaaatgtcagctctcattattgcccagatattattcttttcaaaagcggagcactcttgccaggctttctaaacaatcttcagctcattcatcttcctggttttgttacattttgaacctctctgggtctatataaggtggcagcctgtcttttaaaaattaatggattccaaatgccattcaaacctatttccgcccttaacctcctcctcttctccccaaccctgcctgttaggagtcttatgttctgtataaatattgagctggagatagtttctaaagaggtgtttggacctttaattaacattgacagcctgtctgcttaggattttgctctgctgtctccatggaaaagtcaggtaggtcagtatgtgggggagggacctctgcagtggatgtgttcctggcggctggccctagagacactgcactctgagccaaccgtgaagtcattttgaatttaaggagtcttgctaatccaaggcaatgtgtcttaatttgacaaagtaaaggctgcccgataagcaagcctcactacaagttctgtgaaacagggggtgtttgtaagtttagattgtgctagagaaatgtggtgatgtggaagaacgggctcattttctcctgtttactccctttcccaccccatccccctcctctctcccttctctcttacttactttggcccaaatcagccctgcagtctggcctctgcagtggcttgatgtgaaatttgagaaacatatgtagttttctatttcaggaaaatgatctcagggattgaatgtgtttttttgttggctgttaagctctgatcttgcccagtgtggttttttgatgatgggaaagaggcttcgaagtgctttttatcagaatttcatgtaataaaacttaaggtttggtttctttattttggcccccaaccccctcccaggctcaggacacaatgtcgtctattctgtcagaagtgggaagaagtacacattgttcatattacaatcacttctttgctgcttgcacacacatatataagaatggccactgtgtctatccttcacaaaagctattttaaatgtagttcagtggaggaccaaaggtctgcgtagtgtctcttacaaaggaaaagggatctgttgggggaaaagtctgcctttgttttgccttggaagggccagtatttttctttgttctagaggtgagtgccaataatgggcctagtgccctatcaagcaaacttcattaatccagccctgcaaagggtacactgatcagataaaagggacctacatcctcaaagctcaaggtatttgtttttaaacttttttcttactgtaaataaatatcactattgtacttaatctcatattcataattgtattccttttcttaaagagcctttacataaaagcttcaggccctacaaaatccgagagcatccttcatggaggaaggatagtagactcgagggtgagtggttgaactttggctctggtgtaaaatgcccaccctgggacttattgtgtgaccttgagcacgttacataccatttctgcacttcattgtcttatttatatttcatgggcttgttgcgggattgaacaggttcaagtgtataaagctcatagtacaacctgctaaggactcaacattagctattcctgctgctgtttttattatttgttgctggcgtataagacctaggcaaatggagctaaatactattgtctaccattaaaatattcaccttctggagggaatagtgcaagggtaacttcagatttgcattgaaaaacccatggactatcactttacatatttatttccttaccatcttcaacccttatccagacagctccaaatgcacattattcagaaaattggtgatattttcacagcactgagactaagctcatctcctgctggtccttatcactcaccagcctttcagccacatcagacatctcctcaatctctgggcaaaccaggccttttcatgtcttcttgactttgcacgtactgtttcctccccgcagagtatcatttgcccttttttctgcttgtcaactgctattcacccttcgagacccaacttaaatattatttgtgaattttgggcagttacacagactcttttgggcagttacacactactgtttcatttttcctatagttcttcaagaacttctctcattgtagtgtaattatttcttgacatacatttttcttctaacagcctaggaggtctttggatgaagatactacagtctattcacttttataaccccggtacagagtgcatgacacgtgttaggtgttgagaaatctgagaaatcgactgggaagagttttttttcataccattatattttaaaagctgcaatagtttgttccagaaaagttatatttttcccttggtgtatattctaatttaaaaggtgtttttaatgcctgattgatctccaatctgtaatgactttgtagcattttctttgtttccctgcattcagccttctgatttaagcagataatgcttggaaacacctgtttaagttgtatcttctttgctagttgtaacttcatgagtacagggaccatatatgttctgttcacagctctatccccaagtcctaatacagtggttggcagttctagaggtagaagaaattataataataatagtgcttgtattttatgcttaacagagcacttaacatgctggccactattgtgagtattttagatacattaaccccttcagtcctcccaatattcttatgttatatgtattataattatcatctgttttctacagataaagaaacagactcaaaagaggctaaggaacttgccggtggtcacacaatgattggcagagttgggattttaacctgggcagtctggctccagaattcaggctgtttgccataatggttccttgcctctgattagtactaattagcttagtacttgtttgttaactaattattaaaggaatccaacagagacctatttctctaatgtaaagagttcattcattaggcaaataatcaccctaagccagttgttctggaagtatggccttcagaccagcagcatgagcagcgtcacttggaaatacattggaaatgcaaattctgtggcctcactcccaccctactcaatcagaaactcttgggagtgggaccaaataatttgtgttttaaaaaaatcctccagaagaatctgatggatgctaaagtttgagaaccactggccaagactcagccattttctctggaattttacccctgatttttgcttttcttaagaagtcataattttgggtgtctcacttttgcatactcctgatttttgtgacattaatgtggggactaagctctaacctcagtgaatgtttttgctaaagtttctgagaaattttgaaggtttcaggtgtgtctgtagcttgacagtgtttgtttcttttgatttttttttcctgtgatagcttttaggatcaggaaatttaaaaaatatagtacctcctccattcagccctgctgtctcagactcccctaactggtgagtgaagaaggagcccagaggtgcagggataacagagaaaggggaagtagcagaatcagtgagtggggaatcaaagtttgatgttatcgcacttcctagaagtggcctcaggtcctttggactgttggtttacaaatggtagaaaaaagggacactggacttcaaactggacttggaatcccagttcagtctctctatctatgtgattctaggaaagtaatttttctgagcaacagttccctcatctttaaaatggggataatattactaatgttttaatgatgtgagaatttatggagatgcatgatgagcactcaattcatgcttgttgtatctatactgaaggaagctgtaagagatagagttagtcactagcatatttaccagtgagtgttctaagaaatggattatagattttgcagagcaacaaggaatccacagcattccacaatggctggtattccaaggatcgaaattctgggaggttcagttgcagagaaaactaggcaccagtttgaatgcattatgtcttgagtctgctttttttttttttttaaaagaaaggtatctaaaagtgatttaacaatgtcaggatttagacttaagtttttttctgttaaagaggccattgctgaaagtcaagacccaaggactgtacaaatattgatgcaactgtcagagatacatggtatttgaccttctattaataaagacaaattattgcatttctgtgatatttgagtctgcaggaacttcccttaattccactggtattccattccacggctaccagggctgctgggacaagggacgtggcgttgtgtttctgatttacgaggtggaatattagtctgatttactaaactgaaagagcaggttcagataacaaacaacatagtgaaacttcctgaataacagccacagaaacaactcatgtatttggtggtatcacaacaagtttggctagatttatccacagactagaatacaaaccatggaggaaagaaagcaggtaagcacaagtaaatagagggcaaggcagatactagtggactatactggatgtaggaagactttgaggaaggcttttttttgcagacatctgcagggtgtaggcagtgaagtgtttgttgtgactatttgccagcaccatcccacttcacaggtgggtgggtggttccttttcaccaagattttaatggcaggttgtgccccataaaagggcggggcagtataccctgtattagtttaaaaaaggtctcagcttacacgggacagcatttttactttttacccttgcctttgctcattcacagggagtacttcggaatcagcccatctaagcctcagacttcaaagggagctcattcctatttgacaacagtcatatccattttgccaactctttgacctttgaaatagcatctactcagtcaggtctgacctgtcaactgtctgtaaaaacccatccagatcaagaacttgatattttcaagaacacatctaaaggatgggggcccttctaattttgtttctccaggacttgttttgggagaagccagctgcttcttctggtcttaatgggatgggattatagatgggttgagtctgtgaggcctcaacttacatgatgatcctgtgtccttttattataggttgcacatgttttagccactcatggcagcatttttctccagctacagtcaattttgtctaattattgttgatcatgattttactgtaaaaaaaaatttttttttttgagacatggtttcactcagtcagtctggattgtgcagtggcacagtctcagtgcactgcaacctctgcttcccaggctcaatcgattttcctgcctcagtctcctgagtagctgggactacaggtgcacgccaccacgcctggctaatttttgtatttttagtagagatggtgtttcaccatattggccaggctggtcttgaactcctaacctcaaatgatccacctgcctcagccttccaaagttctggtattacaggcatgagccaccatgcccaggttgtaaaagtatttttaaaaagtgttttcagaggccatttgccatgggaaaatgggatatgttgaccttcctgtttacctccatttgtgggcttttggttgtgagcatcagttcatatccagttttggggaccactcttgggtatactttaaataattcagatgttgaaatttttcagaatgagaaaatctagagagaagtccagtttgattatactagaacctcatttgctgattaaattgtaaaattcctaattgcaacttggtcatgtctttgcaaaatagtaataataatattaacttctatttatatagtgactgtcttctcaaagaactcaaaacagtgtccttttctgtatccctgctattcccaaaacatgtttgtggcaatgtatgtggcttcaaaatgtggatgtatcattatgaaatataaatgcatgtggtgatggtatttattagaatcatatgttattggaagtacctaacattgggtgtaaaggaagcctggtcaagtttccaatagagatttacaattgggcctctttgtatctcagtttcttcatctgtatagtgggcataatagttcctattttatagagttattgtgatgattgtgttaatacatttaaagcattgacacagtaatgctgggatagtcctcaaatgctattgtttgcatcggttttagaatcagtctaataaatatgagtttaaatacccctttgtcccttgcttgttgtgtcgtcttgggcaataacagtaacagtcaacacagatgctatttattgaataatacttatatgtcaggcattatattaggcccaggatataagtgattatttatcacttattcctttaactttcttaaataggtatgattatactcattttatagatgagttaggtaaggtttagagaagttaagaaactttcccatagtaacagagttagattactggcaaagcggactctctgaattcttgtttttggttacctacttaggttcccctgaaccacagtttcatcatttgtaatagggatgacaatagctctttgtaaggattaaatattgtacataaagtatctagcacttactgtgcattcttgacatgatatacaatgatattatcctctccaattagagctttccatataatataatttttttctttgtgttccttatgccatgcatatatctttagagattaaaagacacttcttaagaatggattcttgcatttctgagaacttcagaatcacacttgtgatctgacacagtatatatacactcaggtattgatgtgtgtatgtgtactttccattctgttcagtctagaagtgtatagatgctcaatctgggtgctttgtaaggaacatcacaaatgttcaaaatcgtggatggacttgaacatgaaaatgccttggcctcaaagttttgcttttctgttctcaaagttgttgaggaaactggcttagttaaagctaagtgtttagaaaccaagtgtgttttggatggtaaggtggagtcagcattatatatattaatacatttttggtaccagaaacagcaacaatcccttagtctggtgtgtgcagatgtaatatgtttcatgatatttcagcctgtattttctgtcttaataagtgaaagcactgcagaattgggctgcaggccactgccccatttctctccttttgtagtcagatctcccttgtgaatgataaacacccactcctttcatttattcacccattcactcaacctcctacaatctaagctgcatgcttaccacctaccttaaagaacaccagtgattgcttattgtgacttacgtcataaatatgtattctagacatgacttctcacctgaatatcagtgtcacatccttcatagcctcaaaactttgaggaaatatcctcttatggcatactttaaaatttgtaattttaaagtaagcacaaagtacgttttgagaccttcatttttttctctaacaattctgttttgttttttttttttgtattctgtattttttgttaagtttatatcaggatgatttgtcattagtgttcttgtaacatattttggagttttccttgtgcaatgtggaaatagtaaggttgacattctgcttttaactcttctttataaactatgaggaattcccaaatagaatgttaccttgaaagactcttgacataagtagaactaaaccaaatattttatataattatttttattttttatttttgagatagggtcttgctctgtcacccaggctcaagtgcagtggcgtgatcatggctcactgcagccttgacctcccaggctcgagcaatctgccctcctcagcctctcagagtgcttgggattaaaggcatgagccaccatgcttggcctctgtaattcttaattattattttatatatgttatgagtatgagaactaagcagttccataaagatgagaattataatatctcattttagtagtattttgctttgtattatttgacattttataaaaattcatagtctcaaaaaatatacaatgttcttcgtcaagtagctaatactctctttcttagtgttcggtttaactattaatcttatcctgttaaattatttaaaatttcctaataattggcacataataacagtttttaatgtcagcattgataacatttttctgtcataatattcaactaagggatgcatcttcaatgtataaagcccataagtaggttttttcaccctagattagatctaaattgcttacctgtttttggaagtgaatattatgttattaacaataaattccaaactgctttgtattactgacattgtaacaatgtcttgatatgatggagacccttgctatcacattgtcattgatcatgcacattgatcatgcccgtgttgaaataggcaatgccagagacagaccaaagacgaaactggtagtgattttggtgaacattgttgccatgttaaacttgagtatatttcttgttgaacaaccccattttagagatacggaaaatgttgtgaggcagagatattaagtaaccctgcccagagtcgaatggttaataagtccttgccaggatttaagtgataaaacaaaactcatgcttttaactactatagtcttgtaagccactcaacaagtattggccagttaaactaatgaattccctcaaggaattgattctagtaatagagataaataatcaagtcataagtcatgactcaatgtgaaaagtcttgtgactaaggaatgaacagtacaataaaggaaacatgaggaacagtgaatcgtggtaggattatggagaggaggaggaaggaatgggggagagtggggcctcagagaggtgcaccaagactggggcccaggccttgcttccaaggtaccatggcgttctgtgtttttccttgtcttgggcatactattcagtgtttcgatttatttacttgtccttacctcccactaggctataagctttctgactgcagaggtaaattgtgtgtcttcatcacttagtgcaggaagtggtagctaatgagttggatatgtaggggcgagtacagtggacaggtgaagtcaggacatgatggacaaaagcatgaacatgaaagaagatgtgaacattcgttgcctctttaggaaatggtcgacagtgtggagtggacagagcacggacatgtagcttggggtattgtgaagggatgggtcagccgtgtatacttatctaccatggtaaaaagtgatattattagatttctgagtgcttgcctttccctaatgcatcttcatgtctttaaggacaaagatgtaggaccaagagtgggctacatcacaggagatgaaaagatctgtttgcatatttgacctctgctaattatcagcagtgtgatagtaggcgtgtcatctgacatcatcttgcctgttgcatagtagacatttggtaaagatttgttgaatggattaattaatataattatatgtttttgcggactctgaagaatttgagatacagctatataaaagagttactatttattggtacatattgcttagtatttggaataagcttggtaattattcactaagcaggaaacagggtttagggatttccaggcattagggacactgagccttgagacagggtagcagctctgtggttcagagtgactggtccaccaggaacagaaacaagctagtattgggaggtgagggagtaacattccttgggaggattatttggcaaaacgaagtaagaatcataggggcatagggtcatggaaaaggcttcattcttagtagagctctggagtacccatcaagtctgggtgaagatgcttacctccctgagagggcaagcatcaggaaagcctgggtatgggggtcccgggctcctgaggcccaggactcattgctaggatacagattgcactgtcaagtccagactgtcacgtgtgagtctaagcctattgttttggggcttgccatggtctggatggggcccctcttaaaggttatagagttgtggaagaaagggactgacacattttgatagtcaaagagtaaaagaagctatgagttaccagtgtgctggatgcttctgaaagcgtttgacaagtgctttttgagtttttaaattaaattacttttttatttttgtcttcctctctataaatcataccagagaaggtaacatttttctctatactgactttgacaagcctagactatgctttgtctatgtccagtgtacaaatgtagagaacccattcatttctttactcctcacatatttagtaaagtccggctgtgtgccctgcctttaggggacactgagcagaaagcagactcctccagacgattgcattgcagtataattagcaccataacaagagtctggcagattctagtctgtagtagcaaaatgaagagcaatcaggtctatccagggaatgaggaaatacctcacaagataggaagtgactgaactcggacttgaaggatgatcaagaatctgccaggtgggtatgggggccacctggcaaaaggacagcatatgggaaagcagaggcatgaaagaccttggtgcatccacaaagcgttgggcacgtgagtctagccagatcacaggttgtgtgttggggagcatttagagaagagaacacaaagtcctcacgtgctttactcaggctttgggcttaaggagtgtttctgatgtgggctctggagccagactgcatggctgtaagccccggcctctctgcttcacacctctgtgatcttggacaagtaccttaactttctgtttctcagtttcctcatctcagatgataataggacatgcctcacagggtggttgtgagaacctgaataacatcgtaaagcacttcaaacagtgtctggcacatcagttgttattaataataattatataagataaaattatataattcataatgatgatgtttaatttgtaacctgtagtcaaaaagtagaaccaaatacaacttgcaagggaactggatgcttctggaagagtttgataagtgttgtttgagtttataaagtaaattaccttttttactttccaggtaaaaaaatatacctttgggaggggaacaacacacactggagcctgtcggggggcggggccacaggagggagagcatcaggataaatagctaatgcatgtggtgcttaatacctcagtgatgggttgatggatgcagcaatccaccacgcacacatttccctgtgtaacaaacctgcacggcatgcacatgtatcccggaacttaagaaaaaaaaatacattttttctttccaggacagcgtcagtccttaagaggctagctcaaagactagaggaaaaatagactactaaataaatcaaaattatttagtagggtatagagttatccataaagtgctgggggtcactaattattaaagcagatagagcacaggtagttgttgagcgtagaacagcccaatcagaatgatgcctcagaaaggcagtagttggcctcccagagtggagcatggattgcagcagggggctgaggctggagggggagaagtgttgaactaattcaagggatgttggagggctaaaccagtgtctcttctgctaaatctgagcagaagagacagatctggaagcttctggtaaggtaggcttgattgagtttggtgagaagttagatgaggagggtgagaacctagcatctgggtgtctgctagatagatgctgctgcaccacaccaatgtccgtgtgtctgggtaccgaggtggtgttcaggacaggtcttctccacgtactgccgctgagctcacatccacgctgtgcatgctgggctgagttctcttcaggctgttttcagctgacttaaatgcaacacgtgatgatgagcatatttacataatgtatgcctggtgaaatcacgaaagattggaatttcccattttaattccattttaaagatgcttgttaagcaaaaggatataattcatttttcaaactgctgaaatgttatttggcctcttgaatcaaaggcattccgcaagtgttttctttattacatgccttaaactttaattagaatttaattataagatcctgaaggcatgagcaagaggagcagatgggatagtaaaagcagcttagtgagggaggattaaagattaaaagttgcttgttaatggcataagaaatgaacagagagctaaattactatgcttttgtgctatcctgatgctttttcgattctgtaacttattcctggttgcaggtttttcaattctgcaacttattcctggttggaagttgaagaatctcacaaattagatttttaattttttgagttgctagagtagatttgtacatagaaaacaggtaaaacctgacaaaaaggtgttttatggctagtagcaccttgtacaataatttctgcattgtaggggcttagtggtatttactgaattgaactaaaacttacatcatctcactagtaaacatcgaatgagcataaaataagatttttttttagagatggatggggaaggtgtgagtctataagtccaggctaacctgtcccatggaatgttagatacctactcaggaaggtaacttgtatgaacctcccacctttagcctaccccccagtcgaccttagtcatttgccccacttggttggttggctagaggagtggtagaaatttggtgtgggaaacactttgagactgctcctcatgtcacacagtgaggatgacctgctctgctctctggtgctatgttacgatgatctcccgttaggctaaattattctacttcttagtgctttttcccctagcttttttttttttctttttgaaatctgatatttagagtcctcttccccacttaattgcaagctcaatgaagaaaaactagagaacaataagatagaaaagaagacaaaaatgtagtgaaacaaaaagcattctatctcctattttccaggaacaaatgttttttaaaaagcttttttaagcctgttaatagacagttgattcttcattatttgcagattctttgtttgcaaatttgcctacttactaaatcttatttgtaaccctcaaatcaatacttgtggcactttcacagtcattcgcagaaatgctcagagaggaggataatttctgagtctctcgtcatgcgtgttcctagccgatggcaaataacacaacaccctgccttcttgtttcagctctcatagtgtaaacaagtgtccttttcgaagtctactcgtgccatgtttttctcatttttgtgctttttgttggcgatttcaccatttaaaatgcaccccaagcattgtgcaaaagtactgtgtagtgttcaagtacagtgcaagaaagctgcgatgtgccttacagagacaataacgtgtgtttgataagcttcattcaggcaggagttaagtgctgttggctgtaagttcagtgttattgactcaacaatatatattaaatgagttgtttttaagcaagaatacacatgaaacagggttgcgtattgatgagttggcaaaaatataactggaggctcagaggaacctagccctgtatttcccttaggaacaatggtccagtgttccctaatttaatgtttttggagactaccaaaaataataaggtcagccatgtatctttctccttttctccttgctcttgcttgatctttccatctcttgttacctcaatctgtgtgtatatgatatgcatatatttacttaaattatatatgcatatatttagcaattatgatatcacatgatacacgattctgcaacctgtcttttaacttatcaattgtgttggcctttgggctgtttgcactgagatccatttgtcacccttgccctgctctgcaagggtgctgtgttacagggggttgacccctgccccctgacaatttgtcatcagtgggagatggcaaggcaagagaaagagaagctggagtatttgtccctccctctgtctgccttgggcagcatctctggcagtggcccctctacagctatcccacctgcaggttgggtcctccatggctctgtcatcggctggttggtcctgggtctcgagctttagccctgccttcttcctttgtccttttagctgatgggtggaagaagcttcctgctgatgctgatctctgagtttcttccctgtcccctgggtagagcatcagatttaaaagccaaggcaagacaaaaaatgagagaatggtagcaaagatccaacactttacaagaccgcctgagaaaagggaggagggggtggttcgacaccagggcctgcacactgagtgtgtgatgttgcagctctgcaggcacagattaagcagctaagatgccatcaatgcttggaaagcagccggtgcctcttgtcctgagcttatttgtctggaatatgattcccttgaacctgactagctcatccacggggagagagaaaaaaaaatattctgatagttatcctgaccaggctctaacagggcctccttccctaggatataattttttctggcctctttccattcacttcttcacattaggacccttttcccccagagtgtgagattccctgagggctctaaaaactggaatgctatacagcattttaagccccctgtgttggcacagtccttattaaaaatgtattttcctcaagccatggctgcaccccctgaagtgtggattaacagaaaggccttcagagctggaagacatttttgaagaaccgctgtaccaagtggcattaaatatttattgcctactacatgtaaattgttcatcatcttgttttaactcttggaccaaaaggtttctcatctgctttctgctaaagtggaaatcacaggaaaggtactctttactttgctgtggtattttgttttcccaggaatacggaatatttctttgttctcataagtaatactagaaaagattgccttgactctcagcatttcattgggaggccatgtggtgtcatgatggagaaaaactcgaattctggggcaagtgcattgggctttgccacctgcaagctgtgttggcttgagaacctgataccatttatgtttgttgtgctggaaaaatgggacattgcataaatagcagatagcacaattcctggcacccagtaagttctctctttctcctaggtcttctatttgggactttgcaaatacatttctaagcaacctagaataaaatatgctattaatatgctgttaataataaccaaaagcactcagcttaatctttacttattaaataaaactgaaatgttgctcagacaccttttgctgtttttggaatgcctttgtagacacttttgatcttgcttaaaaaacataacagcatttcaaaggcttatcttagctattcttattcatacctgaaaacctacagagtttggataattttggcacacatatgtgtgcacgcatgtatatgtataaatattctgtctctctaaatatatatgtatatgcaggcacatgtataactctttaagaaatgtttttctaatgtttaattttcttaaagtctgtacttcacatcatttttttccccagaactgtttatcctcactccagacatgacccttggaaaggtggcagaaaaaacaaacggctggtgtgttttggggcagtctgcattccttttaactctctgagaccaggcttatgcatgggctttcaagctatttgtccagaggcccaaccactttgatttctgcttgaaaattagcctgttgttcaagctcaggagagcttccacagagctttcttgggttcgcgaactagagatctatgaagtgtttgcttttatttgtaactttaaccacggcagccttaactggacttttgttttcttatttaacttttatccatgtaaccttaacctaagttctttttcaaatctccatcctcccccatctcacaatttctaatccctcttttgtccttagatttttccttcaaagtcaggatatgacatttatatctatgctttaggaagtatctgaaagctaacatacacatagaattatgatttttttcttgggttgcttaggaggattaaacaaaggttttagaaggcagaattcagaaaaaaattgatagaagttgtgctgcagcttggaggggagtgtggattttagaaagcataaggacactttcatttgtccctttcatatggacttttatttcctctgcgagaggcccaggggcctggcctgtggatggtttagacaggaaaagactgaagggataactgcttccagaccttcagccttgaatgttcagccattattcaagccgttgagaaagggagcaagaggcataaggaggcttcgggagtttccatgcagcttctctgagttccagcttgtgtgcattgttctccaaatgtgtccccagcactactgaaaggactttcatacctcaactaacccttattgcaagcctgtgaaggaagagttttttatatatatatatatatatatatataaacagacaaggcaactaaagctctgggaggttacagaaacttaaggcctaagtagggttacattgagaccagattaatcagttagtagattgtctttctatttcatcatgtgcttcatttcctccttggtttacatgacccttctttggaaatttccttctggtaatatcttagttaaatgaaataactaagttttatggagtatccattatgtgttaggcattgttttatgcaatatgcatctatgtagtgcacattctgataggaaccatgtgaagaaggtgtattacctccattttagacaggaaatccctgcaatacagagggttaggtaatttgctcaagatcacacaggacacagtaggtgacaccaggatttgagcccaggtctgattccagaacttatgccatgcccactacaccagccgtccttattaagaggaaggccattggtatgaggccacttgaaatagacatggtagatatgtggcaatcaatgcaaaggtattgtctttcatgctctgttgcaatctcatttcatttctagcattataggtatttaaagcagaggtaggcttgctttcttagtttcagttttctgagaaacaaagatagtaacaacaatgatgatggatcttgttaccatatgtgaatatctgtgtgtactaggcacggtacttggtctttacacatgttcttctaggttaaccttatgacaactctgtgaagttttctcaaatttatatctgagaaagcactcagaaaggttgagtcacttgcttgcccacatcacactactagtaagtggaggagtgaggatttgaacctaagacctcttacaataaaattatgttctttccactcagtatatgggacatgtatccctgggggcacatgtgagaactataattggtctgtaagattattgatgatggtatagggatagggtgttaaagaacattgatgcccatagtgaaaaagtaattccctttcacttgtcctaccaaccatctggttacatgaaagaggaagtctcagttaggtgccagtatgccttttacaattctaacagagaacagggctcagactctgaggctcgggcaggtaattgaatctagaagaccatggtgacgttctttttgtttttattgtattttaatatcttctcattaaaaaatattataatgtgttcatatatacaaaataaatgtaatgtatatataaggttaaaagaataatataatgagtatccatgtacctatcacctattgaagcattagattaattttagttactatgggaaccttctgtgtcactcttcccatcccaacttctttctttctctcctaccaacatcttacataatcactgtataactatcaaaatcagccagttaacattcacataatactattactcagtctacagactttttgctagttttgccagttgtcatactgtttcatttcctggaccagaatctaggatcacacaatacatttactagtcatatctcctttgtctttggaatagttcctcactctttttgtctttcatgaccatgacgtttttggagtctggttaggcattttgtagaatgtccctcactttgggttggtctgatgtttccacaatattaaattcaaattatgtgtttttggcagggaagctacagaaatgatgttgtgcctttcacagtgcatcacagcaggaggcacatgatgccgatttatcgtatcacaggtgatgtgaactttggccaatttgttaaggttgtgtcttccagtttatccactgtaaagttactatttttccatttgtaattaatgattaccttgtagggagatactttgagattatgtataatatcatgcttcttatacctttgtccactaattttagcaactattgtaaattcttgcctgaaacaattattcctgtggtttttccatatggtgtttttctatgattataattctttctatatttattaactggaatgctttgtaggtggctttatcctcgccacacacttatttattcattcagttgtttatttgtatcagtatgtacttacaaattcttattttattgtctggattataatccattagtatcattattttgttttgcaaatagtccttttaaccaatggggatcccttcaaattagcttttctatctttctgacatgtctccatcttttttaaggcatttttgctttctggtgccagaagataccactttgtgctttacttgctccaaccctgagagaagcctcctcttgctgttctgcatccattcctctcagtcactccttcatgcactataatatgatttccactctccccagtgcactgacacttccgtcacttaggtcattgctaaagcagtagatattttaattcttctattactgcatatcagacatctcttggccccatatcagatcttctcaggaggacagtaaagggaaattgtaccatctcttgttccagctgccgtgaccaagtttgcatagactctgaaaaacttcctacagtataagctgacagtacctcacctcatgctgcatgcttttccatagggcaccccacgaggttccatggggtttccttgtggttgctacctctggatctcactctgttcccacacatgtacaacctggatagagaattaatgcctcctttctctctatcgtggatggttctgagatacagttcatgtggcttggggtgtggagaggttgaggatgatcctatgggatagagaacgagtcacttctagtggggccatcttgataccacaacttcatcttgcctccccctccttattatttgttttattccctttgtctatcagtcctctccttctccctaagattgcactacctgatgcagtagaaccctcttccttgggtctgctgtctcggggacccaggaaaagatgtgcagtgtttaaactccttctctataatctcttaactttcacactatcacattttcattcatttattccaattcattcattcatttacaccttatttattgagactttccctgtgtgagacattgtgtacaggtagacaaaaatcttgatcttatagaagttattgtatttgggggagcagaaataactaaataaaaccaattcagctgaattataagtgcttttaagaaaatgcaacagggagagggcagagagtgggccacgtggggcctggcattgggatggttaccacatacactctgaggaaatgacatttgaactgataaggggtcagcaagaagaaatgggctgagagaagactgatctattcacaggaaagaggaagtgcaagagccctcattttctgttttgcactagaactgctttcctatgattcttcagattgtgccacctttcttccaactcccatgcatttgcacagattgtttctttgacctggaatgccctctctgacttaccaagctggcagatttctatccttagctcagatctcatctaaagcagctctccacccccagggacattttaagtcctttttctgttgttggtgtgctgtgctttgagcacagtattcatttataatagtgatgtcagtgtacgccttagaattgttcacctgcatctctccttcttggactaggagcactctgagggcaggactatgtttgtttactttgtattcccaacaaagtgcttatagggatttaaatctatttattgatgagttggatggatgaatggatgagtacatgggagaaagaggaaaaatgatatatgaattgaaataaataaatgaaagagccagtgaataaatgacagtgacctgaccttaaggcgttgtcttgtttgtgggtgagacaggagtataaccattcagagtactgtgatgaatgcttagagattctcagtgcatgaataacagtggcagtcagcaagttctgctcatagatgcatattgtttcagctatttcatgcttatttatttagtttttaagaaattcatttaggtaccaaacataaaaaaaaacccagacttgcagctttccagatttggggccagacacatgactgtaatcccagcactttgaggggccgaggtgtgcggattgcttgaggctaggagtttgagagcagcctgggcaacatggcaaaaccccgtctctacaaaaaatacaataattagctgggcgtggtggcacatgcctgtagtcccatctccttgggaggctgaggcatgagaattgcttgaacctgggatgtggaagttgtagcaagccgagattgcaccactgtgctccagcctgggcaatagagtgagatttcatctcaaaaaaacccaaaaaacagatttggcagtgctggacccttctacatggagctggggacaaaaatctgctggaaagtaggaaattattagaataactaactgtattaaaatatgttgaattcttcttgtcatgactgttttgacatttgtttgtactagttaagggaaaatgaaacttcaggttgacagcctttaccttccttgtgccataattaatttgctctattctgtttgttcaggaaattcagcttttgaaggcccagaaagaggactaagggtgcaggtggcaaggaaaggttgatttgtggtgacctggcatactgtattccatctttaagtcctcaccacaagtaggcctttatccaggttcttgttacctggaaatgtgtgttcatttggggtatctagatgaggcaggacttcaaggaaggggatggataatgcacttaatcttcatcttcacataaggatagctgctctttatcttctccctctggaagctgccattgtgaggcagcattaaggtgggagaggaccctctggagttcatccagaaccctctgggggcacctgtgtcccttctgtttgtcagtgtatcagccatggatcctgcgtgaaacaggtggcacatttaaatggggtaatccgagaagagtggacaagtgtagggaaaccacatggatagtgcaagatgcttggctatctaaagtggggctggtactctctctgggcctaaggaacaaggagaggggctacgagcaggccctggggagattgttttgtggaggtacttacctttgtgacctttggtggagagctgcagccatcctacactttctcctagtccactgatatccctctgtgtcctccattagctgaacctggctggaggccagaggcagaagagccctctggtgtgctccacacccatcagcatcctggcttacaaggcagggtggagaaagttagagattgaatttgaagagcacatggaagatgtctgggacatctgggcattctttctgtgtggttggttcttgtggtcagatatttgtggaggagtgaggtggtggtggtagtggctgtgctttagagtcagtgagtctgggacaggatcacatctgccccactcgctaacggagttaccctcagctcaaggtcagcaggcaccgatttctttgccgtctggtggggccaagggcaaatgcctatctcaaaaagctttgggaagatcaaaaatgaaaatacttaagtgtttttttgcagatttggaaaaggctgaaagaagttttattaaaatgtgagcaatatacctcaataaagttgttttcctatataagacaaataaaactgtgttgtgatttcacaacaagtgttgatttttttcttcattatatttttctgtattccagattttctgtcatcagaaaaccagacatccataagtgctatttagaaatatgttagtactgccttcaaattattactgttggctaatattgccttctctgggttactgaggtatgtgaattcacagctgcagcatagctgacttgactatggacagactagagtgaacgtgtatgtcatttcttacgatgtgcccatggattcaggtctagtgccccatccccaggaagcctttggcccttcagatgcttctcctctgagctcctgcagctcctgggctgcccctagcagttatcacactgttttgcggttttctccaccactagactgtggtctcctctaggtccaggactgaattttattcatctccaggtcagtgtctagcattgtcttgtaaatgctgtctttattcatgttgcccagcttctaccacacggctactggaagttctcaagctcataacaccgtagcttctacaacagagagcaactgactgtgctttctcctttctgttttcaaagccctgggaaagaattctgattagtttcatttgggtcaagtgtacctacatcccttattgaaccaactatacccatggagaggtatattacagtgatctcagctttggtcaagtgctcattcccagaggaatctgttgtgtggccaatagggtaggatctgtacaactatgacaggtcttatttaaatcaattagttacagtggagaagagaatgaatcagttaggaatgctttcagctgcagtgacaatgcaaaaaagcttttatttaaatcagttagttgcagtggggaagaagcatgtatcaggaatgcatttgcaagggagcaaaaattggttcttgggggatgaaaaagatcttagatattacaatcatttgtggccttctaaagcccatccttatgtaacagcataagtagatacacaatctgtctgtggtattgaaatttcacagtggcagggaaaaggaaaagactgtctggaaagggtctttagtgggggcgatagtgaaaaaaaagtttgagagtgatttatgatgacaataatcatacctaacttatttagtagttatgcaccaggaactgttatgaatgccttacatatactatattaaatcatttcaccatatatccatttgacagtgaccaaaacacaaatagtcttgatttcccactctcacacccctaaattacaagtacaaagatgatttgaccatgtcaccttcagcatatctttaattctttggacttttccctcatgctagctgcctcatggttgtaggatagttgctgcatctctggacgttacattctcctttgatgctggaagaattggtgagaagagcatgatgagattttttgttttgttttttaaatgagaggagcaaaacctttcccaggaatcttctcttcctactatacttctgcttaggtcttattggctggaattaagtcccatggccactcttagcagcaagaagcagggaaagtggaaaacaagattatcatggttggcttaaacctgcacattccaatatgatagttactagctatatggctatttaaatttttttagagagatataattcatataccctaaaattcaccattttatgtatacagtatagtatttctagtatattcacaggattatgcaaccataccccagtatccgattccaaaacattttcttcgccctcaaaagaaatctcatatccgtagcagtaagtcctcatatccctctacacctagccattggcaaccactagcctactttctttctctatggattttcctggacattttgtttggcttctttcacttggcataattttttcagggttcatctatgttgtagtatgtgccagtaatttttttatcagttcctgttttaattgataatactctgttgcatggatgtatcctattttgtttatccattcatctgttgatggacatttagattgtttcactttttagttactgtgactaatgctgctgtgaacactgattgatgtacaagtttttatatcaacatagttttgatttttctttgaattctcttgagcctattagaaggagtggaattgttgggttttatggtaacaccatgtttaaccctttgaggaaatgtcaaactgttttccaaagtggctacacattttgtacatcctggtaggaacatgtaaggattccaatttctccacatccttgtgagcacttgttattttttgtttgtttttattataaccatcttagtgggtgtgaagtggtatctcattgtggttttggtttgcctttatgtaatgactactaatgttgagaatatttaatgtgcctattttccatttgtatatattctttgcagaaatgtctgttcagatcatatgcccattataaaattggattgtctttttattgttgaattataataggtacttaaatttaaattaattaactttaagtaaaatagaaaacttagttcctcagtcatactggccacatttcaagtgctcagttgctgtgtgtggatagtggctatgttattggacagttgcagataaagataatttacatgattgcagaaacttctgttggacagcactggcttagaaccaccatgattgatcacttatagctgggcatatgacttctctaaataaaattgaggttttgttaagctaaggaaggattggtactccagaaagagtgaggtgtcctggtcccagaaaaggaggttatgcagactcagtgtataactcctaaagatgcatcagagtttaccaagggaagaactggggcaggggttgagtgggagggcaaaattctagaccagggcttggcagatgtcttttgcaaagggtcagatagtaaatattttggctttgctgactatatgatatctgtttcaactattgaactgtaaccaaaaagtgtctgagacagatttcaatcgatttagagaggtttattttgccaaggttgaggaagcacccgagaaaataaacacaagttacgttaggatctgtgactggtgttttgtccaaagaggattgtgaggacttcaggatttaaaagggaaagagtgagcaggaagggaaggaggaaagaaaaaaaaaagtttgaggggcataggcgatgaggcaagtggttacattcttgtgaggctttgattagtgctcaccaaatccacagtttacatgtgaaaagaggagtgggggaaagtcatttatgctcagtaaatctacattttacgtaagataaaggaagcatgtgaagttacagcaacccatttgagaacaaaaggatggcagttttttgattttttctttttttgtgtgtgtgtgtgtgactcagttcccaagcttaacttttctctttaacatagtgagtttggggtccaaagattttattttcctttcacacaactttgtccttatagtgaaaaagcagcctaagacaggccataaatgaatggacatggctgtgttctaatggaactttatttacaaaaactggcagcaggcacatttgggctacaggccagggtttcctagggacaatacatagaaaagtatggaagccagaaggggcctggcatactgaaataaagagaatggtaagacgtttggtatggctgaaaactggctgtaggagctatggctgtagagaaggctaggaatagagactggaaccagattataaagggtccgcaatgcatatcaatgttgttttgttctggttggtggtggtggttgtggtgctagtggcagtggtggttttctaaaatcctctaagtggcaagaagccgtcaaatatttttaagtaggacattatatgattatggctttttagacaaccctctggcagcattgtgaaaagaatattggaggaaatgaggctagaggtaaaaaaataccagttaagctttgtattttgtattaaaataaagatctggtaattatcttgctaattgcatcagtagagacatagaccaccaagctgataattcttatcctgactaacctactcactatgagctgagtaaaaagcagtattgatttaaatgagttatgaagagtggggcttggatatgctctttttatatcccaggggaatcaccctggaaacctagagaactggttccaagtattcatctgagaacatctgtgactctcagaaagttatgagattggagttgtacggggaaactcgctgtggccttggaagagttgacttctaaatggggtagtgaacttattctccgtggctcagttctaaaaggccctaagaggagaaaaggattcttgatgaactactaattgatgattttaggtccagagttaagcataatatggaggtttgcctgagagtgtctgccgtcagtgaagatgaattatccatgtgggcttagaaaatcacacatgcaaattatgtgtcaatggatttttttttcaacatgctaatcctagcctttgagtacacagcatattttcaaagccaattttgcaaacaactctatggtaaatgctgctaagctgttgataagttggctttccatttgtaagcctattagttcagaatcttctgaagtttaattcaaaatgagataatgtgtagtgatttgacagttttcattctgtgacgatgctcttcaagaaagcatcttggcttgttcactagttgaatcctcaccagttcctgaaattatgaaatgtaaatttgttataagcagccgctttgggcccttcacaaggcagaattgtaccttatccctgagtggaaataaatgaacatctcatgtgtgtagcttctctctctctgtacatcctgactccaaatgctgtgaggcaccagaaaatgtctcctgaatctgattttgggtggctggatcaatgtccagagggaattaggaatttttccaatggtggtacagatagaggtgataacattagaaaagactgacccttgacaagacccacattagtgaagtcgttattcccaaggagttgggtatgtacttcccacgtgttgtgaaaacagggctctattaccttgccagcaataccccaaaggcagaggctgtatttgtccttggatctcagtctttgacattgttttgggaaggtatgatgagaggcatgaggaaacctcatccattttgtgagtccagtgtacttaaacggtagagactgactccagggcatttggagttcacagaatttgtcaaattatttttcaagcttgtagggttcaagacttccccaaatgtatttttccaagtgcttgtaccctggtgtccattaagggaaatgtactccatatgtttctaattcttctaccctgaaatgatcaaaatattatattgctgagatctctgaagactagaaagatccttttcaattttttttttctctttgatgacactaacagaaatgggtgatcccagtaatcacaaagaggctcaaattcactcccaaatgcccggccaccaagaagctttggacataagtattttttgggggtatttgtgccaactgctgttttaggacatgtttctgataatgctttacacttaccagaaaagctgtttttgaaaaatccagtgttgtcttacaatcattaatttaaaaaaaaaaagtttcccaagtattttcttagagcaaggagatctctttctgatgaagaatacactctagcctaaaaagccacttaggtggaccagtttctttgattaacaaaagttacaaaggggaaaagaagagtgttagagaggatacctgtaacaaaaagagacaggagacatatggaacactcgtggtgtgtcacccttatttgaaccctcattcaaacaacaactgttaagaaaagtaaaacataggaggcatatatcaatacagaatggctatatgatgatattaaggaattattctttttaattatgatattgataattagctattttttgaaagatacctccttttatagatacatgctgaaatatttacagaaaaattttttaaaagcctggaatttgtttaaaaagaatcagggtgtggtatagttaaaactcctccctccctccatctctccctctccccctctctccctctccccctctctccctctctccttttctccttccctcactcccttttcttcttttttccctcccctcctccttcccctcctttctcccccactgccccagcttctcttcccttctgttctctttttctggccttcatttgggctgacaagaagaggatgcatgttttatatcaggttggcaggtatacttgagatatattgtcttggcaatacaaaggcctgacacttcctagggacccagatgggtattgtagatgtttagggcatgccttgacctctgagtagccttcttgggcttgaggtctcatttgactagactaccactccacagtcagccactgtggtctgttttttaaaaacgttgccatgatgagaatgtgaaggatttgggttgaagttaaggacacttcctttttattattagtctggagttttaaaggagatacctgggatcccacccttactttgttactttgatttggagtcagcccttggctttgagagtgtgctgtgatattggtctgatttaatcattgcctatgtagaaaaagagattagatcactggatcccaaactagcctcagaaagtaagtcattgatggcaagaatcacctggagagattttcagtttaattcttaaaaaatttagtgacgatacttggataaccctctgggaattctgattcagtagtcctgggtagaaatagaatctaaatatctgtaattttatcaggtttctacacgattctcatgttccaatagtttggtgatttaccaggttcaatgccttttaatagattcagttgctcaggagcagattgaggttgtatttccatatagtcctaccttgtaaaaaatggatgtgtcaagttttttgttggtgttattgtttttaattgttattttgacttgctgggctgggcgtggtgattcacgccagtagtcccagcaactttgggaggctgaattgggtggattgcttgagcccaggagtttgagaccagcctgggcaacatggaaaaaccgatctgtactaaaaaactggaaaattagccaggtgaggtagtgcgtgcctttagtcccagctactcaggaggctgaggtaggaggactgcttgagcccaggaggttgaggctgcagtgagctgtgatcatgcgctgcactccgatttgggtgacagcgagaccctgtctcaaaggaaaaaaaaaaaaaaggttacttgcttatgaataagaccttccatatagcagttattatataagcactaggtaaatattaataaatggcaaatactaaaaggaaagacaggaaaaggaaaggcaactgatatttattgaaggcctactattatagtaaacttgactcataatttatattttcttctttaattttaaccttggcatgcaatgattattacccaattttgtattcagtaaaattaaagcccagagaagtttagtatttttcctagagtcacatagtaaacacgtggcagcaggggtgtttggatactattgtgccaggcagcctttccgaacactccagcctatttctcaattctttcttggctccagaggattgtgtagcaggaggggaaatctgttcagagatcaggaaactggaccaattgggcaagctgccagagcttcctttactggattgtaccagcaagtttgtttttctctgtccaatactgggtaaaggtcccaccgaaagcctttgtctctgctcagaatgcctggtatgatctctgggaaactatttggcaaaggagtgtggcagctgaagcacagaagcctctcctaggtggttcacccatatctgatttttttttctttggcaccttgtaacagacctgagaatgttgaaattttgtgccaacgtggacaccattcagcatgtcagatttctctgataccgtgaagatcaatatgttggatgcaaaggaaaagtcccagcaatagattccagccctcactgccacttacctggtatattacaacagcctccatactggtcttcctatctgcagcctgtcctctgctttccggcccacttttctcagggggatcctctttcaaataaaggtctgattatgttcctccaatattaaaccccttcagtgactccccagttcttgaggaaaaaatgctgagtctctgagcatagcactgaatacccttcctggtctggccctgtttctccgcatgcttctcccactccacccagcttctggcaggtcatactaccgtggctcaccaaagatgccttggaaaccaggtactttcatgtctctgtttctccagctggagtttcgttccttctttgacctgcctggcaaactcctatgcattctttgattcctactccttcatgaagcctttcagcagtttctttcttagcacaactctaccaccttgtctcacctgttcacagacatctgcctgcctccctctctaggctatggtgccctccaaggggaggcaaggtgttgttttcaaatcattcacagtacttactacataggccacttacagtcagtgtgtaataactgaaggaggacttgagtgaataggcaaataaagatggttaccatgataggccgagatctgaaaagaagctaataatcaatgcatgaagatgtgtgaggaacttgtgtgtcttcagtaccattctaaataccatacaaatacaggtgccgccagagtgcttgcacatggcagcttcacagcccatttgagaagtagaattaatacatgtgaagaatgaggccgggcactgtggctcacgcctgtaatcccagcactctgggaggccgaggcaggcgaatcatgaggtcaagagattgaaactgtcctgctcaacatggtgaaaccccgtctctattaaaaatacaaaaattagctggacgtggtggcacacgcctgtaattccagctactcgggaagctgaggcaggagaatcgcttgaacccgagaggcagaggttgcagtgagccaaaatcgcgccactgcactccagcctggcgacagagtgagactctgtctcttaaaaaataaataaataaaataaaagaatgagtaagaaaaccaagaaaatatgcaatttagttcagcttgtttggtgctggtaatactttatttttcatgtgtcgatttttgatctccaccttgcactgtgagctccctgaggacagggactttgtcttggcaattatgtcttcacacttggcatacagtcagttttcaagatatgtttgttcaatgaataaatggatggtaggcaccattcagtgctgtttagggtcaaaggaaggcatgatttgtgtgggttgaagtggtcaaggagggcttcacacataagccagttatgaaggatataggcattgaagaagcactaaaactggttgtgagctttactcttcagagagtcacagttttagaaaagctcttgctctattggaaagaatatgggttttagaccaaatacatctagaatcaaatttggactctttcccttatctgctatgtgatcttgagatctctgagtttcagtttccttgcccataaaatgaaatcaatattacttcccttagaatatgcttgtgagccgtaaaagcgatatcatatataaagcatgtagcataatgcctagcgtacattaggctctcaataaatggtaagtaaaagctgatatataggtatagtgtgtctgaaatacctgggaaacatggattatttggatgacgtagtaacatttgattaaatttgcatgattattatattggcacataacaattagaattataatagattccagtatttttatggccttttaagtgtgttttggggatttctatcacatttctttacttttttaacattggaaaattggaaatggatatttgcccccaaattgtctgatatatagatctcgcccttcccattacacttgtgaagggaaggcttttctggcaggaggagcataatgcgtagaggagggaaagggaaatgagctttccattttgggagaaaaattagagctactcttccagtgacaaaccgcattgcctggctttccttctgcaggctctgcctcatgcctgtgttcctatagacattggagttaaagctctcattcatggtcatgattctcgcctctgtctaattcttttactttgtcgtgtaccatctctccttttcccactgttttttccagccacctctgtttcttttggtttccttgagcatgtcaagttcttttctggcctatgttctttgaatttactgttccctttgacagacattcttttcctctggctcttttcatttttcagaaaatcagctgactccttaccctgtggtggtattggagccaaataatggaattgatttttcagtgtttattccacataattccaaggaatatgattttaagagtgttcacaattcatatttttttttaatttttgaaattgaataagtttcaaatacgaaaatttaggaacatgatacaaaacttttctctgtgcaccactggagtactgcttttgaaatcaattctctctgtcctggattacccttagagctcctgtctcctgcatggaggagggtggagggcatttaacatgtccatctctcaccccattctacctgagcttccagcaccaccacctctgggcagttccgcttttagtcagcagctcccagttcccataattttgacttctgtccttgctagtccagaagaaatggctcttctgggattgaattcctccctttccccagcagaaatggattggggcagaggaattgcggagctccatggcatagagggtcctggaaggcttgtcattagggtatccagggtgggaaggggagtgaagggaggggaaggaggaaggaattgagttgggaagagtcaaggaggatgaatgaagttgctgactgatgtctggaataacattatttcaccctcaaaaataccagtaattcaggactgaaaaataaatttcacaatatgttttaatttcaaaaagtgatagtgtatttgacattcttatccagcctggtctcacctcaggagttcccccattggagaggccatccctgaatttctaactcacaggcctcccctacgttaatatatttatgtcctcctggcccttgtttactttttacttgtttacttttgcttttgtttacttgtttacttttgctccatgaagtcagggacctgcctgcttgctccgcaatccctagaactgtgtctagaaccttagttggttgcagtaaatatttgttgaatggatggatgagatggttgtagcaatctaagttgctttggatgagattaacactgaaaaaaaaaaaaaaactggttgcctgcaattctgtcagccagtccaggcaatgctaatacagctttgattattatgatcatgattattattttgttttgaaacctttttcagaggccaagcatgctggggacttgagggacataaaaatctttcaactgattatgccacctgcaaacaggataagcctgactttctacctcacccacctcttgctatcacagatatgaatcaacgaacacacaaaaaaggttttcaattctccctttggaaagagggcacatttaatattctgagtcaggcaaggaaagactctagccacaaagacagctgggaactcaggtccatagcaggcacccaggacggaggtgaagagaaggcgcctccctgtctggtgacagcagctggggcccttgctgcctccctccccacaaaaatccagttgggaccagtgcatgctgggaatctgcctgcctgacagaaacagatggcctcaggtggtgactgatctcttggtgacactaactgcatagctgctgctttactcatgaccgaatgagacacgagatggcggaggtaagagttggttaccttgccgtctcctcctcagctgaaatgactcacattgctgtagcttaaatttcagtccaggctctctggactcggggaatttctttttgctcatgctcctgagaaccagagttctccaggaacatctgtagtctctgtcttcaatcaaagcatttgagagatgctttatttttcccctttcctctgtacctgtcacagaagggggcctgtctgaataagatggcacataatctgctgagtgcagcaacccctctgtgcagccttgaggaagaagacaaggcagtcaaagtaccttccatcatttcctggaaaatgtgtcggtagcttggagaggcagagtgggagatggaagtaacactgcatgaggagttaggtggtctatgttcaggggccagggttgtcacttactagataggggacctttagccagtcacttaactccaatggccttctgcttcatatcatctcttatgtagggtggtgggactggattaaggacagcagatagattagctgtcagtcttactgattggaagttgctgtccagagtacagtatgggggatggctgggaagcccatctcagctaagtgagaaagagcagtcaactattggtatttgccaagtgtgtgacagtggcacatctgcctgctattatgagacttgatggtcatttctgcctctgtggttttatgattccaagtgtcctgcaagtgattctagagggatcatgaaacattttctggtcttaataattactcagggatctattaacaatggtgaggaacatactcacaaccagactttcattgagagtttaccatatgtatattatatcacttaaccctcatccttacggatagggaggctcaggctcatagtgattaaatgacttgccaaggtcactcagctaataggtgatggagctggaattcaaactctggtctgtctgcctccagaaccgaagcgctgaactgccaccctatactacttcccagttggagaatacctcagtacagtaattagatgccagtgtgtatggctttgcctatcagtacacagaaatcagaaaggtgattgagagattcattaatgcctccttgcccagttcttttgagcatatcttatttgagaaaggtgcacgtgaccttgggtcagtttgtctaactctgtcagtctcagttatcttatttgagaaatggggctatagcttttaagttaataatccagataaaacatcctatagtgccccagatgtcagtagcactcagtacatgttcatattatgttgccccaaggtcacgtggctgggaattgagctgaggactgcccacctccgaagtctatgatggcaccttttggttttggtacaagtgagtcctgagtggaccacatggcagcattagaggtgcttttgaatacgaaaggtggcgtgaggatccctctcacttatgtctgttctgttgtccagaacttagtgaaaatcctggtccttacccgctagagtgaaaaaggaaggaaaccttaccattctttctgtgtacctttctctggctggggctttctctggtctaggtgtgctcagcaaatatgacaagtagcaggccactcattttgaccacgcccatgtggcagacagctttcttcactttcacgcaaatgaagtacaagacaatcacatgtatggctgcactgaatgtaaaagattaaagagaagtgatatgccaaatagatgactgggagttgacgtttagcaaagtaaatctcttggtggccctggtaaagttaatttcaataattctggttttttttttcatcttagaaacttagaggttaaaaaataataaatatacatgaggagatttagagtgtatgtggaaacagagatcttcggaggacaagtgggatatttctttatagaaagagttttccctcttgatttttttgcttggtaagtttctttcaaatcaactcaattcatttggtgctattgcttttcttttgtgaaaacgattctggggatttgatcaaaaccgacatgaaaatacaaccctcaaatggtaaatatcagggaatctggaatttgcattttctaggctaaagtaatttactggccaagtttgctgtctcctcactcccccaacacatgtacaactcttaaatctcattcccctttaggctccttctctctcagtttatttccagcacacatgcatatgcatccatgcatacacaggtgtgcacatatgcatgtatacacacacacagacacacgacacacacgtgacgcacatattttactctgtgctaataaataggccagtattggctaggctgggcctcaggactgtctggtttaaatctaagctgcctgggagatctggagtaataagtgagtgacaacaggtgcagattttgttacacccttctgaactcagcccatagttctttctttgattcttttcacccaacacccttgcttcaattgtgtccaataaattttatagctgcatgatcctgtttcagagctgaagggagatttttccctccacttggctaaatggtgcctaagtcaaaacaccacttcctgccccctcctcacactttaagaagtaataaggaataaaccccaggccataagctgttgctgggtcctgtatcttcagttttgcatgtgaagagctaattttctggtcccattttagaaaagccaagaattaacttgcagagaattagccataattggggagaaaataattacttggctttttctgccctgtgataactggagccactggcaaatctttcacagcagtgtcaacgcctacttctgtttaaaacaaagtattgcaccaggggccttgaaagtcacatctgaatgttctctgtggtacattttggtccaaaccaccctgaatattggagttggattcatttcatgtcttttttggtgtaaaatcccggtgcagggagacatttcatattacactggaagacatgaatgtcttttgcaggtgtcaggtatgctcatgggccctgcatgcatacttaaggttgggtccaattggatttttttaggagcagtctgtggtctaagctgagaattttttctcataagggcccattttcctctagcatttttctgttttgagactttgcccagctgcctctattccctagtatgtagacttaataaaaaatctcttggttcataataaacatggaaaggagatggtacacgttttccatttgctagtagaggtttacctgaatacagttggtcatatatctcagtgtcgtcagagtacaacaaaatgtcatgccttcccatgatttcagacaccactcttcagtaatgacttatctgaatatcagccctgtacctctcctgagctccagccttaagggcacacttttcattgggtagccctacctgctgacccatagacaccctaggctcaactcattttccctaaataaatttgcttttctttctgtgttttctatcatggtaaaggtgctgtgatccaataactcaaacaagaaaccttgatggcatgccttccatatccattactgttagctaagtgggggacaatctatatattgcctcagatatcactgggatccattgccctcctaactaggctccctgggtccagtcatctttgcctttcctccaacttctcccccatgtcacctacctcctcttttctctacccccaccaaaacagtacttcatacatccctagtattgtctttaaatgtaaatctgatattatttaactatttgaattctttagtaacatcccactgctggcaggaaacaagtcctaacttcctagtataaggaatataaggtccaatgtgatccagctgctccctgactctccagtcttacctcctgtcacactaccatggatcaagccccatggttccctttattctctttcaactctgtattttcgcatatgtgactttcttctgctagtaatgccctttcttaattggcctgtacctttgactcctacacttctgtattattaggctatagcactagatgtggcttaaataagttagattatttgtttatctgatagtccggacgtagatgctttccatgagatcatccaggaacccaggtagcttctgcattggactgtgcttaacatgatgcccctttctgcatgatccaaagtggctttcaaccacagcttccttcaaggcagcaagatggagaatagatgaagaaggaacacaccttctcccttttggtgctgtgactaataagaaatatatttttagtttctgttccaggtttgtgacacagagctcctaaaagccttgtaatttccagagtgatcaacattctaggagtatcttttgttgtactatttagactttgactctggttcctaacagagcttctaaatcccttggggtttcctaagcgatagagcatcttttgctttaatgaggcgactcttgggctcctggataacttcagaatgggagttggtcagaatgggacttggtcactagaaagaccatgtgatggatagcagctcagaattttcagccctactccccacatccacccaatccaccaggaggggagagaggctggagattgagttaataagcaatcatgcctgtgtgatgaatcatccctaaaaatccctgaaagatggggtttggagagctcccgggttggtgaacaagtggaggtgcctggagagggcatgaaagctccccaccccttcccacataccttgccctatgtacctctttgtctggctgttcatttgtatttgtattctttataataagccagtaaatttaagtagagtgtttccctgagttttgtgagccattatagcaaattatcaaacctgaaaaaagggggttatgggaacctccagtatgtagctgatcagtcagaagtatggaaggcctagacttttgattggcatctgaaatgggagcagtcttggattgaagccttaacctgtgtgatctgcccttactccaggtagttagtttagaattgaattgtgggacacctggttggtttctgaagagttagagtattggttagtgtgggaaaatccctcacacacgtgatgtaaaaattgtcatgagtatgcagaaaaaagtttttcccctttagtggcagtttccagagtttgtaaatatctctgcttcccaatcttttgtgcctcctgtctgtctggtactccacctctgtagtaatggcagcagcagcaattctagtagtagtcacagtggtgtttctctagtagaagctgtaatagtagtaggaagaagaggtgtaggagtagtatcagtatcataatttcccattcctagtttcagaagagattgaaaggctaagtgacatgcctgaggtcacatagttaataagtaaacggcaaagctatcgttctgactgggagctctcttacttcagagctcaccactagactgtgggtagttttcaatccagtcacactaaatgccagttatttccttacatgattacctctcccacaagattcagaacttcttgaggaaaaggacatatccaactgacctttgtatctgtagagcctagctccaaggctgggcgtatccatcagttttagacattgaaatcagggtttcttaaccttggcaccattgacattttgggccagataattctttgttgtggggctgtcccattgtgcatgacaggatgtgtggcaccatccctgacttctacccactagttgccagtagcacatatccccacccgcagccagataaaccaaaaatatctccatgcattgccagctatctgctgggagacaaaatgtccctgattaagaaccactgatttaaattaaatgaaggccaaggagccttgagtagtgttcatatccgaaaagggcattttcagaattgttcaggctgctggatctctcaaagatgatgatgtattttccaggcctcatgtgtctggagcacaggttgcctgtggtggtggctgcaatgatctcagtgtgccaggccttcacggggaataccagagagggtccctctggagcagctcttactgggtcatggagaccatctgtctggcatggtaccacctggcaaaatctctttgccttaaccaaaaatatgcttttgtaaatttcctggcaaagcaggggctgcattctgtttcctgatttctctcttttatttccagatgtgtcactggtgacacatagagcccaatgagaactctgttggaaactcaagtttctcattcttcgccagctccgttgtcatgattttcccaccgtctaagccagtgtaggttacgttacccacgtgctggttagtgcttggatgtcagttttcctttttaaattctagatctgtagcatgctttagggaggaaactttatggcttattacacaaatggagttaacccttccctgctttgcagtgtttttgttagtgacagagacatgaattcaagatctgccatttattatttgtttcattttggacaacatgcttagcttctttgatccttgatttgtttaccttcaaaacagagtaacctacctgtcctgtctacctccatgggattattattaaaacacaataagataatctgctcaaaaggcttaaactccctagtatgatttactatcagtataccttttgcacccaagaaaactctacagtatcattgttcatgggcaccaaattgtaagttcagttaaggcagactttgtgtctttttctgccagtttctaggacctagaaggtattcagtaaatatatggtgaatgacagtatgaaaaaaattgggaagtcagattctgtggttcattgtaccagtgggggctggagggaggtaagtgaatggtttgtgtggctttgtgtcatttgtatttgtgacagacattccaagcaatagcattttcaagggttcacaagtgagtgcctgcagaggcaggacacacttaacactctggcagatatgcgacaagacagggtagggaggggcccaagggaactagagagggcatacccagctgtcttagtcattttgggctgctattaaaaaatgccatagactgggtggcttataaacaacggaaattatttctcactgttctggaggctaggaagtccaagatccaggccccagtttattccatgtctggtgaggactcacttcctggttcataggtagccatctcctctgtgtcctcaaaagacgggaggagtaaatgagctttctgggatccattttacaagggccctacttcttcatgacctaatcacctcccaaagccccccccacctccaaataccatcaccttgaggattaggtttcaacacaggaattttgagggggggatacacacactgtctatattgccaacctaaagacattcacagttacacattttgaagtctctgcatcagctaaacaaaatatgtctttgggccaatttaagtcttcagacaaaaatttacaactccttattgacagagtacctaatataaatactgggacagatgcggggcagataaagatgaggtgctcaggatccggcagcagtgatagacaggaaattagtgagacaatgagaatatccaagatacatggagagcttagcccagcactgtccaatgtcctttacaaatgacaacttgtatttaatcctcacaacagcccaatgtgagttagtggatattatgtcccctgttttataatgaggaccctaaggcacaaagaggttgatattttgccagaggctttgaagccagtatctggggaataataaaatgcaacgtgtatgtccaatgacaaaggaaacacagaagccccctcttagatctcactacttctactcctgcccctccagcccctccatttgaagatccctgagggatctgaaaatgcaactttgatcgtggcacagaccagtcctgaggttggtgcagtgacatccccatgccacagaggccctgtgccttctggacgctgcctctcttgccagccttgcccgcccctcatgctctatgctccacttcacttgcccagacagacaagcactttgcccctttgcagccactctcccctttgcctgtgtctccttgttatgcagggcctttcttattcctcaggcctcagatcaatgtcacctcctcagagtgggcctttgctgcccacgctgcccaaagatggcctactgggtcactttcttctttgccacttgcttatttccttcctcacgtgtgtgcctgcgtgtgtgtgtgtgtgtgtgtgtgtgtgtgtgtgtgtgtgtgtattttctgatgcctccacttgactgtaagctccaggagtgcaaagatttttgtcacgttcactgctgcatcccattgcctgagacagtggccagcatgaaggagatacacgagaaagcaatgtgtgtgcactgagtgagcgagcacatgggaggagctgacttcatggggcagattcagtcagagagactgtggctggcctggtgtcacattggtgagaagtggcacagtcgggatttgaactgatcatgacagcatctcgcttgaatcccatcattgcctccctaccgcgctcaggttggactccctggtgtttaccatggacaatgaatcttgatgtctggcccctgtagcacttctagcctcttcaccctcaattgtctgcacatcctcccttgcccctttctatctgcactgacttcaccgtccctcagtcaccccaccttctttctttccctgctcttccttatgttctcttcccacggcaggcaccctctgcccttctgtttcatggggctgtctcttcattgtccctgaaatttgaacttcagtcctcctccccccgcaaacttcttccaagcccatggactagactagaaccccctcaagtgcccctcattgcatttatcatggttgtaactctatagttatttttgtaatttattgtcttttctggcttttctgcccatggcccctacaacaacagcatgttcatctcattcttcttctgccctggctcgttaggtaggaggtgcttacataaacgtttgtcaaggaaatgaataaatgaataaataaatgaataaattgctggatgaatgaatgagagtaagtgaatgaagagttcctgaatttgcttttatgccacctcccttctctgggaaatttcacacaggataggatttctctggcatagagcaacacttctctttgtagatctcagcctgtgcctggagactgggtaaagttgaatgacggggtgcaggaagccttgtgttgtcttgtcacaacacaggaagggaaagtactttggcttttactgttgtaaataggactaaaagtagctcttcgggggtgatctttgtttaccactgcctaaggccactgtccttggagaaaggtcaggaggtgggtgtttacaagttctgtccaaactctcccatgacactatgccacaggccctcatttccctgacccattgttaattagagcagaggaggaacttcagatgctgagtttgtctttgaagaaggatccagaccctaggatgtcatcctggagactttgctcttccttatccttcatacctggtcctccaccttcctgacagtttctcttcttcctcatggttattgggagatagaatgggtggcagatttttattgtttcctgaggagccctgtgctttaatttccattatgtgtgaagatgtctgccatgaccaccaggttgggtgttctgctagattggtgtttgggagccagttgtagacagagtcaaccagaatataaaaagtgtgagtgcagagataaacccactcctgccctataacgacagtaacaaaactggcccagtggtagagctctcatcacaggccaggcactgcgctaagcacgcagtctgcacccctttagactggcccattctctggaaagtttcaaacatacacatcagcaaagagtataatgaaatcctgtgtacccattacgtgtaggggctgaaaatgtatttgccttgatcctgctttcaaagcaatgggtctagtgactgctttgggggaggagttagggaagtgcttaactcatattaacactgatattataaatttacagaatgcagctcgctctggagattatatctggttatatatgtgcacatatcagtgattgctatagtcccctggtaaggggatatatatttaacttaaaatgttctgtttggagtttttacataaatgtcactaaatacatgaatatttcagacccccttcccagtctagagtagtattgggttaagggaactaactgttttgagggaatctgagccaatttagtctggcaggaaaatcatgtagtgaagtagtgaggcccacatggcctctgaccagtcagggagagatactgaagttttacaagagaccatttaatgagagattatccataaaacttgatgcacagatttcaggagaagtctttttagtacttatgtgtgtgtgtgtatgtgagtgtttaaatgtggcaggctaaagtgaagaaatacgactgctactgatagtagctattgtttattgagggccagtatatgggtcagttgctgtgccaggaggtcctttgactacagtctattcctcaccaaggcttttagttcattgttattaccaccattgtagatgtgagaacatggagagtttcagagagttgcccaagactattcacataacaagtggcagggctggaatttcaatccaagttagcctgtttgcaaagcctttgccctttccattagactacatagcatcttaaaatattctggctgcttacttgagaggtaagtatcagttgggaacttactcacttccttctttgtttcaatatacaacccagaatgctttacaaattctgcagaattagccagtgctcatgtttaggcatatcatagattttttaaaatggctaatgttgctgttcctctccttgtgctttggaaaaaattttcagagtccgatacctattgtgacaacttttctaaacactcaaagtgccaagttcatcttgttagctgttcttccaccaggcaatcaaaactcatgttagttccctgtggattcattatagtccccgggaaaccaaaagttttgcctgtgtttggcacataccagttaattgcctaaattgtaacttctgagtattaggaattatcttaaaaactaataccaaaatttggtatgatgtatttcaattgagggggaaaatatttggaaatgaatttattttgactctggggtaatatcttttgcttcacatttagaaatttacatactgggttacttccatgacctaaaacaacttccaagttttcttatttcctcagtacccctagctttgttctggatgaggccagtctctgttccaacgcatgatttaaatatacacggttctgcatctttgtctataatgtttataatatttactatctcatgaattttttatatctacttcataatctactctctccctctatttttccttgcacttgacagcccaactggatgttgtctcttaattctttgtcacttcatggcagtttataattctttaatgttacttattatatttcagctacactgcagtaatggatgggcccattttctctcctccagcgtactgaatgggactgtgtcttgtctccgtgtgcctgacaccttgcatggaatttgcacctcatagccgctcaatagattttaattaattgaaatttaaaagggaacttgtgtggttttgtttaaacaagaccataaattagaaacaactattttcatgaatttgaaattcccagaaacattattctttaatactgtacttttgtcgagactgaagagtttggctttatagtaaatgaaatgaatcacagaatcattgaaccagagtaacaacaatactaataaaaacaccagaaatcatctgtgtaatccattcctctctcttaatgccagacagttccccagccaccttaaaatgatagaactctcctttccttaaagatccttttaaagaagactgtcatcttttcccattccacatcatcatgtcttctagccctacaagttaggcagcttctcctcagatgatcgaaaccctcccttactgaaatttatgcttattgctttcataaagatgaaaagcagctgcttttaactgaaaatagttctcttcctaaagatggttattccattattccatatccttctcttccctaggcataattttcctttccatctgacattcctttttgttctatatttccaaaccattgaatactactctctcaacttacggttttttgcctaagaaaacttggactgggtgtgattagtaagtgatcgttgattttagatgtactgagaaatatgtctcacaccattaaaactagtcgatccagccaggctggtgggtaactggaatactgtgacctcaaatgatatgtggtggtatcttttaaagcctgccatcaaccattcccatctcagtttctccagttgcttaatttataagacataatttatttgttataaactgctttgcaaggttcaaaaaaaaaaaaaaaaaacggaaatgatacacaagagaattagattgaatttaggccattttttccccctcatatctggtttttaaataagccctaagagtgctctcaattagaaaaacacatggtaattctaaaggagataaaaaaggaacatgtacactccaagtgcacttttatcttttcatatttaagaaaccccacaaagctccttcttgcaaattaaagaggatagcaagcaggcagctttctttcctcatttagtttagcaagcatattgatttacatttgagtaggggcctctgatctcttttgtttgtgggtggctttgtttgtttttaatatgaactcatttaaaaactaagcttatggactgagttgcaaaggtagagcttcagtccaacactcaaagtagtcttcctatgcaaaaataaaatagatatttatgtatgtggtagtaggtcaaagaagacatcagtgataactattgattcagtaaatattaaacatctactatgtgtcctccttactaggaagactaaaatgtagaatgtaccatccttgcatctagtgtgcagtgtagtatgggagagagaaataatttagcaggtgatcataatgcaataaatgctatgataggaagcaattaaggcacagtggaggggcgaataacacacctttggatgaattcccagaggaattgacaccagaaggtgattaggatttaccaaggttaagaaaggtgaaggtgtttcaggagtgcgttaccaagtacagaagtgaatggaagtgtgacccattcaagatactcttgagtttgtttcagccagagaacggacaaacaagggaaaacttaagtactctatcctgggttcctcaggatgcacactttaaggacgttttgcgtttttctctggtatttatttattgaagttctcagaacctccacagagctaatttctgtagccttttgtgctcccataaagctttatatatgtacccacatttaaaactttcttacaatactttttgcatttcctccatatgtctattttcccatctactctctgagctaatcaagggagaagacctagtactcacgtctatctatctgcagtgccatgctgagtgcttgcagaaatgtgtttgggaatcagtgcatctctctatgaatggctagagcattctaagtggttttgcttctaactgtgcaggagggcacagtttgggcccaatattggtttgcaaattcaagataagaaccaagaatttgattcttaactcaattttatgttgacttgagcaggctgaactgggttgcttatgccattatttcatttagttcggataatggctatcaaattagctgacaacccatctcagttccctgtagtattcttagcagtgtcttaaagtgggttttcatttgaacatttctttattatattttctttctcagaagtagccaagagatgatgatgatgttgatgctggggaaaacaatggtaacaagagcagctgctttttattgggtatgtgctatgtgaattaaccctgcacttaaccttttaatgaatttatgagataattactactgttaccttcttaacagatgaagaaaatgaagagcaaggaggatatcttactcactagtgaatgatggcttcaccatgtctgatccaaactgtactttgtaatgccttcttcatagcagcactaaaatctaaaagtctggaagagtctttaggagatcagttattccatttcacatctgggggcaggattatgcttgaactgaatgccttggtccactgcctgaaatgtatcctctacaacctttgtccacctggtgaactcctactcatatttcaggactcacaattcaagctgctactcccaagtgaagcttccttaatattcccaggtagagttgccctcttcctctgttgttcctcttaaatatcttgtatttcactcatgaaattcaccaatcatgcagagggtatgtttctagaggcagtttgtatagttgtgaaaggtatggactctgcagctaattgtttgggttccaactctagctctacccgtattagctaaataatatggtgctctcttcccctgacagactgttaatcccttgaggccagataatatttacaagaatttcttaaatggctaagtcacaaaattgtcatgttttttaccttaatagcaagtctgaatgtatcctccttctgaagagctgatgtattgtttctgctggtttctgcatcttgatccctgaaagatattgaaaacctaattttaaggccattttcctgtttgtttgtttttgtttttgtttttgtttttgtttttgttttccatttctgtttcctttccctcttttcctgtccttccttagagacaggacatcttgaaaggtacgaaatcttcaggtctgtacttctacttcaccaacttccttttaatgtttttacctctttgtcttgtgtggaaaatcttaatctgactctttctgctttgtgtcaaagggatactgttcatgttaaaattctcagctctgagaggtatgtgagtaggccgttccttgggtgatgggacagttgacatcatatctgagaagagcatcaccatggtgccctttacttatggccgttgtcatgatgacagtcatagccacctggagcacagtggcctgacaaagacaggaataggaagagggaaataattcgtccaacacttttgtattttgcacaatgggaaaagagtggcatcatttctagatcctaaaccaaaattgatagaaaaagaagactagaatgataagatctgctaaatattctcagggggttgaagtatcaaatatctgcagatggtatcactgagcaaaatcaaggagagcagtttaggatttttagtatgagggaaatgataatgcttttcagtacttcttagagttgtcagtgtctcataaaagataaagaatatttgttgagtgaccacaacttgctgggtactgggctacactacagtatagtatagttattactgagaatttgtagagataatcctagcttatcaaggaaatatttgttttataatttgttcaggtgcttatttatattgaagaatattctcaagttaagatgatttttttagatactccagaggccagaattaatcataaagggccctaatagccaaaaagaattgaaatgcactaggccaattggcagacactatttcagtctgctctctttcatcctttgccaggaattgtacattatctctttaaggcagagcagccttggatgaccatatattaatatgataacttgcttttccttgctccccaccccccaactagtggctttagaatagctttgctatttttcacttatttcttggcagtagcactagatcccaggcttaccgattatgcacactttagataactttgggtcagctcagtactgaacaaatggcaagtcaggaatgccattaagactgaagaatgttggaagataaggattatatagacaccactgtccttatacacactgtgttgtcctgtaattggataggccaaaatgagttgacactggaagaggtattttaatattggagcttataaaatgtttagaaatgttttcctatctgagtcagactgagataggtatgtatgttttctgtctcttctgagtgacactgggaaatagttatgattgggaataggccttggtaccaataacctcatatatacactagggtagaccttgcagaggaagctggcaccagggcatgggaccgtgaagcaaaggggttcagaagaactagagagtggtccaataatgagtcttcagatggccagaggcaaaggctgagatcaagcctcaggtccaagaagccagaatcataagcctgaaataattgagtgagaaacccaacattactagaatggagaagaggctaggggaaaggcaggagcaaacccaagggctgggggtctgaagatgttaccatcacaaggcagccccattttaatggcctctagccacagggtttgccattaaaaactgtaggagtagacagatgcttgatggaaacccttgaccccgggtctttgctcccttaatgaaggaatctaaggcaaagtagagattctttttttaacatttaaactttatttttaattgacagataataattgtacatattcatggggtacatagcaaagtttccatacatataatgcatagtgatcagattaattagcatatccatctcaagcctttttcatttcttcgtgttgggaatgtttaatatcctctttctagtgatgagaaactgtataatacattattgttaactgtagtcatcttacagtggtatagaacagggctccccaaccccatggggttctataccactgtaggatgactagggttaacaataatgtattatacaggtactggtctgtagcctgttaggaatctggctgcacagcatgaggtgggcggtgggctagtgagcattaccacctgagcatcacctcctgtcagatcagcagtggcattagctcctcaaaggaacaggaaccctattgtgaactgcgcatgcaagggatctaagttgcacgctccttatgagaatctaatgcctgatgatctgaggtggcacagtttcatcccggaaccttcctcctcgcaacccccacccatggaaaaattgtcatccacaaaactgggtcctggtgcccaaaaggctggggaccgctggtataaaacagagtttatttctccttatctagttgtaattgtgtatcctttaacagatctctccctatctttttacatgtcctttgataccataagctctatggacaccctataatatttcttcattatacttacccttcatagtaattactagagtgagctcttcatggatttttctcttttactagactctaagctccacgaaggaagagataatatctgtgcctggtacatagtaagagcctaataaatatttttggaaggagggagagaaagagggaggagggaaataaatggctcttttgctccttttcttcatgccagggcaacactcagcttctgaggtatgcacagcaaggatcttgctgagatgggtgtggccacttgcttgcctcacttccagccctgggcacatgcagttctttctacctggtgcagtcctcttcctccctgctctggcacttgcctctgcttccacttctgctgctgcttctttttctagtctcctgcagcctaatcatcctcttgacacattctttctttaaccatctgaatgccttcagtatggttcctgtgagctctgaatgttctggaagccattgttttgttttgataattttgaatattttactcttgctcattatggattaactttacagctgaactctcaaaaccagacttcattttcccaacttgagagaacatctcattgttgtccctgtgtccttgcctatggcacacatctcccgaacacccttttttaccagaacatcctcacagcaaacctaaggcagctaactgctttctacagctctgtgtttcttgacctcttccatctgttttattttcatatttttcctttgttaaaaaaaggagataacagacaagaaaaacacgagaaattaaatacctcaaaattactgtacattttcacttggagtaaccagtctttgtaatgttttgtaaatatctttccctgagtgggcctgaataagcatgtagttaacaagcatggacttttaattgatcagggcaggttttgaacttctgtcctgctctttcctaatgatacaacctccaatgacttaacttctgagcctcagtattctcttctgtgaaatggaaatactaataatagtatcctcacaagtttgttgtgatattcagtaacccacataaaatttctatgcataatgcctggcgtataataggcactaagtaagctgtcacttgttttctttactttcctgctttctctcatattgcctctaattagtaccgtccttattttttaggggacagatccaaatccgtgaatccaggggcttcatcacgatcttggaatattttggtggcaactttaagatcttttgttttctgactcttagatctctttcttttggtggcatgggaaaattccctcaactcgattatttattcagttctttcatgctccccatattgtcatggccacgtttgaatcatgttatcggcaagtctgaccgaaaaagcaatttaatattgccctgtgttgcatcattgcatatattatttcagcctgtcacgggcctgtcagcaagtcttgatgaagtacagagccaatagtaacaggcctgaaatctgacagctctttaacagaagctgctccgattggtgcagtggtatttcttcagaaattaaggccttcttggtctctttgttgatacaattagcaatccaatctgagtcattttatctcccaatgagctgtatcttcagggctggtaattcagtctgttgcatggcttggaaaaacagagccatcagaggcctgtgatgtaccaaaggctgcagccaggaatatcttggtaatttatccccactctcagctctaattattctgttcttcactggctggttcgattgagactctccaggttcagccttccctaagcagagaacaaaaggtttcccttgaaagttggggcctggcaatgtcagtacagtgagctgcgtataaataatgcagcagtgccggcttcatttttataaaatcttggtggagaaatgcatgagaatgatcaggcccctggaactcagcaggcatgtgcttttgatgtgcgccttgctctgagtaaaagcaggagaataaaaagttcttgtttgtgctgaggctacttcatggtctctggctcggattttggtgaccctttcgctttgtttctgatagagtctggaggctcctacctaactaggaaaactctgatatgtatatagagggaaataccttcagtaactattttctgattgaaactaaagatgatgaaaataaagatggtgattatagtagctttacttatattagctttacttacattccctcattttaatcttcctaaggttagagttatctggctaggctattttctctataccttctgctctcccaattagccttatatcttttcttttttctggtcagattccccaaaaataaatattcagggtgtgaacctagcagccaaagctctgggagctgagtcggggaaaggagcttgagggctggcctgcaaaaaagcagatactgaatcagtctctttttgtcaagatactctacccttacctggaccttttatcgcaccctatctaagggtggatgctatggtttggctgtgtccccacccaagtctcaccttgaattgtagctctggtaattcccatgtgttatgggagggacccagtgggagataattgaatcatggggctgtttctcctcctgctgttcttatggtagtgaataagtctcacaagatcagatggttttataagggggaaacccctttcacttggttctcctcctctcttgtctgctgccatataagacgtgccttttaccttccaccatgatggtgtggcctccccagccacgtggaaccatgagtttattaaacctctttttctttataaattacccagtctcaggtatgtctttatcagcagtgtgaaaatggactaatacattggaccttagtacttttcttccgtagtgtgggagaagtagtaccctggttgctaatagtgaggtcacatgggatctaattacttcctaaacatactttttgtaccatctgctgtttttagcctcatttttatcctcactttcaggggtggtgagcaccaccacctcctgaactttttgggtctctgtagggtaatcattttgcttctgggtttttcctgctgctatttaggttttacctttctcaagtctaccaagagagttactactaccatggtttttggcttttagattttcgatgctgtcatcttctatcctgttctcattgtgggtttttgcctctttgaaacattcttgtacaaccattttgttggaatttttaaagggcacagagttcaacacgtgtagtcaatctggcatctttaatcagaagcctctttttgtttttgtactttttgaaataggaaagaaggtctgctagagatctggcatgcatttgtgtcttgggcagtaggtggtgggaggaatgtgaggtaggcaaaaccaggagagcattgttggaaggctctcctggttccattgaggttaatggtctatgcaaggaacccagtgttctgcttcatgcactccaggagtctaacttttgtctcttctccagcctgcatacagagcagtatctaaagatctaggctttataatagaagccattaaaaaatgattaggaacctgaaagcttccttctataactgagatctgaaggtttttattcattcacttaattaacatgcattgtgctctcaaaatttgccagagtagcattgtgcttattcatccatataactggatgaaaaaggcagatatggaccctgctgtgggaggttgtggcctgaccttatatactgaaatttccagaaggccagatagagcatcaagaaataaaataaaataataacattcttttatgataatgagatagatccttcagtgcctcctggtcttccccactcatacacactcatgcctaaaatagtccacggttctggactcctttagtgggccagatcctttcatcaccatgggctgctgagaccactggaatttcaggcaaacctataaaacaggggcagctttaggtgaccacattctgtcatgaatccttgatttcatatacagtttttgcattacatgtttgctagtcctaggccaaaacaaaaggagaaaagatctaattttagctgagttcgagttgcctttctaaaaattatgatttcttctttatgagtctttttggtgaattgacccttttctcaatatgtaatgtacctgtttattcctggtaacatttcttgttctgaagtctactttgatattaatatagccacctcagcttattatttgtatctgcatgccttatctatttatttattttttgagactgagtcttgctctgtcccccaggctggagtgcaatggcacaatctcggctcactgcaacctccaccttccaggttcaagcaattctcctgcctcagcctcctgagtagctgattacaggcgcacaccaccacgcccaactaattttttttgtatttttagtagagatggggtttcaccatgttggtcaggctggtctcgaactcctgaccttgtgatccacctgcctcagcctcccaaggtgctgggattataggcgtgagccaccacacccagcctgcatgccatatttttgcatctttttactctttatcttgcatttttatattgaaaataagtattttttgtttgttttgttttgttttgtttttatccaggcactgcgactcacctcacacctgtaatcccagctactcacaaaactaaggcaggatgattgcttgaggccagcagatggagaccagcctcagcaacatagtgagacccccatctctaaaaaataaaaaaaagaaaaagtaatctgggcatggtggtgtgtgcttatagtctcagctacttaggaggctcaggtggcaggattccttaagctcaggagttaaaggctgcagtcagtcctcatcatgccactgcactccagcctgtgtaacagagtgagctcttctctaaaaagtagaataagtttcttttaaactccatatagttgggttttatttttattcagctttattatctctgccttcgcactggagattttaggtcatttacatttattggttgggttttaatctattttctttttctgtcttccatatattctatataattattcccttttcctgtattctccagattacttaaatatttgttagtattccattttatctctaaaaagttttacctcttgccagtttctaatatgcgtctttcacttatcacagtcgaccttaaaataattttgatgcctcattatatataatacactttcatatcttcctgtgatttgtgctattattctcatatgatttgttcatgcattggattgtataaagatttaaattcaatttttttaaagaaatttatgtctgttgtatttactcacatatttagcagttctgatactcttcattcctttgtgtgtgttcacatttccatttggtatctttaacccatgtagtttctgcatgaattataaagtattctccttctccctcctcctatatgagtatacagaattgagtttgttgattgtattaacaccctttaattccccagtagtaataataatagctattattactcttatagtttacatgtctcttcacattctgaaagtacaatcacatatttaaatagaattgtcttttttcaaatgctttttaaattttagaagctcttgtttcatatatttcatactacattgtttggttcataaaatattatgaatggtagttttcttggattgagcattttgtcattatgaaatattcttcttttccttgttaaatatttttgatcttgattctactttgatacttatattgtcatttaaaaatttttttgtttgtatttgttgtagaacatttttgaaagaaaactgaatcacattttaaaaaatctgaattataaacaaggtatatagcttaattttaaccacagtatgattaatcttatcttttaactggttgtggaattcagcccattcacatttgatgaaatactgagataattgaccttatttgttccatcttattttgttttctatttatattacatcactccccattccctttcctttttgttttgtgtggtttattggtttcactggcttgttaattttttctttattcccttttattccttgttactttgagagtcctactaagtgttttgtttctactagtggttacattctcattccttataaccaacaataaacttatgttctgcctaaacatgtatatgtatttcaaggaacgttttctgtgtaccccttctctagactcttacttaatatttgcttacttaatgtttattttcagttccagactgttactaagttttttttgttgttgtttgttttttttttgtagaacagcaagcctattgtattttaagaaaactcaatattacagattcctgcttacattattattatccacttagatttcaatacgtatatgcatatatttttatgcatatatgtatatgtttaagcatattatgcacatacatgcatatatatacatatatgcaggaaagagacacacagagtgagaaagggtctcagtgtctactggttcctctagtctttgatttccaccatattgagaaagctgctctgaatcaattgttatttggttatactctttctcaagtattgtcctcagacagtgcttatgagtttactttttgaatccttgtgtgttgaaaatgttttttttgcctcttacagctaaataatattttgtctgggtataggattctttaatcagtttctcgtaatagtttgtacattattctagtgtcttctacattccagagttgtagatgagaattcccttagctaggattaatcctttgtaagtaacctattctttctgtctggaagcttgtataattttctgtttactcttgaaattcaagtgtttcctggatttacttcctggacttaatgagacttttaatctgtgggcttaaatcttacttcagttcagtataataaaatacctagccctgtattcatttaattacagtatctccctcatttgttcttttctttttttttttttattccttttctctctcctaaaaaacacaaaatctgttctggaatttctgttattctcatgttaggcttctggaatctgtcctccaagcctcttatctcttccatcattatgtcaatctctttgtatctttgctacttgtagtagcaaagtgggagagatggtgaaatgaatgagcaaagacagttactatggtaaattaagataaagataaagataaaattcagatgtcatatgtcatatttcatttacttggtcttccagagcattaatttgattttcattagtgtcagtgattttttagttcttctgtggaaattttaaacgtaaaatcagtatttatacttccagaaagaattttttgcattcttctgatttctcattgttttcatcattaaaagattctaccatatttttcatcatttctacttctgtgggacttgcctcttgtagatgttctatgtggtctctcaggtgaactactcccattaagttagttaatgtttttgttttgcctactcattgataaatgctattttgactttcatataggtttttagtatctattctgcattaacaagtctgaaagcagtgaaaggtacatcagttcctgccctggcacttgggctggcagtcacccaaccggccaacagcaagtggccccttctttcttcttagagcacccttggtggaagcagcactcctctctagctgccaatcttagaagcaactcagactgccagtgtagccctgactctgtagggcccctatctctaattctaattttacaaacctttgggtgggggtgactagtaggtacagcttgcctaaaggtgaatagttatccaaagagggcaagttgctaaaacacttcaggaaatgtcaaaactggtcttaatagaagactcccggaggggtaagccctttgttctgctgctagtaccttgcctttacccactaataatatgaacaaagtcctatgttttctttccctcctggagagttttggagtacctgtggcttcaattgtactcactaaactttaccagttctgctgcttaatagcacgtccatattacccatcagtttgatttaaagaaactcaatgaattggaccctaatattgtttgaataatcccaatgaaggagggagttgccagaggcatctgtagccataaaacttctgtagtcatcttcactccaggcatactctcttattttaacttcttgtaaagaccaagacatccctaactttccctttattggggaaaaaatctgcttggaaaaacttagttatgctgtgaagtgttgagtttttaaactattgctgtattatgaaccacaaccaatgcttgttagtttaatacagtaatcatttatttgactcatggacagctcatttaggctgtgctgtcctaggtgatccttctggtctcagttggactcactcactggagtcttggctgactgatccacgttgatccaagacaacctgggggtatctgatccagattgagctcagctggctattgccctgctccatgtttctcttatcctcctcatgggaccagtggactagcctagaatgatctcatggcagtgccagaggtgcaagagaacaagcagaaacacatagaatctcttgaggctcagactcggaactggcatgcagttacttctgcttccttattttggctaaattcagtcatgtgacagaatcagaagtcagaggtaaggaatcagaatcagaggtaggaaaggaagccctgcctacaatgtgggggacaggaggaggagggtgcagtactacaaagttacatggcaaagagtgtgggtatgtggagacatgaagacttagggccatgaactcaacctttatcagctgttgagaaatacagtgcaatattttaaacttacaatggtacctcaagagagagagccacgagtttagcttggaggtagtagagaaactttcacagaggagctgacattggaactggaccataaggacaacctggagtttaccaagcagacaaagataggtgaaaggagtaataatccattaagatggaaggagaagtcaaagtagaggcccagcactctacagacaagaatgggacatctggggatttaggagttaccctgtgtgattggatcattggaaacaatccttctatactgccttttgctccctaatattactcttgccagggagctatcgtacctccccaaaagttggaatttcagatgtcatatgccaggaggagttagcatattgtatactcttcagaacatgttacataggtgggctgccttctccacttattagagatgtatgttgcttaaaaaaccgtgaataatttagcatgtttctagaagtgcttgcattccttcagtatatttatgccacttagcatagctcaatgtgttctgtgatctgtgccacatgtaaaaaaatcattaatgataagtgacatttgttggctttcaaaagacatttaagcctcactcagtgctacctcctctatgaacccctccttgatatttcctccctgtctcccaccagattatgtcaggttcttctgctaaaggctttcatttctccctctacttccttcagagtattcatggctgtttgttagtatatgattttagttgtgattatttgatcaatttctgtctccccaattaaactttcagcttctgtgactgcaaaagactagatattttgcataccactggtttcctggatcctagtatagtgccaggatcatagtaactgaatattaaacatttattaagtgagtgagtgaatgcatgaatctatgtgagtgactgaatgagatacatctagactattgtccttgtgagataggttttgggttatctttaaaattgcatgagctcccaggtttaccatttacctaccatgtaatggacaaacgattcattctttaatgtttccattcagtcagtgttcattgtggcttgtcataatcctgaatgtgaatgaggtatttgtgatacagagaagagtaaggctgattctgggctgacggagttgctggtttagtgggagagatggtgaaatgaatgggcaaagacagttactgtggtaaattaagataaaggtatgtccagattggaacttggagaagaagcttttcactcagtctgcccttcattggggcttcctgaaaaaggacaatctgagctgagtcatgaaggctaactaagagttagatgcataatggggatgactgttccaggaagaatgaagcaaaagggttcagtacacagggaagtgggaaatcaaggctcactatagcaaactccaaataattcagtattgcagaatgagaaggcaagggtggggatggccagaacggagtgactgtggagatggacacagtcatatcacaaagggttctttaagccctgctgtgcattggactttgtcctgaagttagagcgtagcaattgaaggatcttaatcagagattgacataaaatattttattttataaagtttgccctgggtacaatatggagaacagattataaggcaataagactgtaggggagcaatatgaagaagcagttacttacccagcatgataagggctatggtagaagacatactccatgctctgggaaatcagaagaggagtgcctaacccagaactggaatctcagcctaggctaaagtaagagtttgaattatcatggtgaagaagctgggatgagttttcccaacagatgggggtagggcaaaggcactgaagtatgtcagaacatgactttcttcagagaactgtaagtaactttttattgttagactacagaatattaagggtaaattgagaaatgtagctggaaagcatctagcgttcaagtcttcctcctattaaatattgccttagactgggatgaccatactctttattatctccaccagacactttaaaaacttttttttatcatagaaacttttgaacatgtagcgagagtagtataattaacacccatgaacccatcactctgtcccaacaaccacccatgaccaatcttgcccttagccacatgccatttacttctccttctcatgttgcttaaagcgcattccagataccatgtatcttatacaaacattttcagtatgtatctctaaatgataaggagccttttgttaacataaccacaactaccaatatcatatctaaaatttcataatttttttatcaaatagcaaggttataatttctaattatctcacaaatgtcatgtaaacgtagatgtaaatacgaatattcatatacagattgtttaatcaggatccaaataaaggactgaaacttttttttttttttttttttgagacagagtctcaccctgttgcccaggctggagtgcagtggcacgatcttggctcactgcaagctctgcctcctgggttcaagcaattcttctgcctcagcctcccgagtagctgggactagaggcatccaccaccaagcctggctaattttgtatttttagtagagacggggtttgaccatgttggccaggctggtctccaactcctgaccttaagtgatctgcctgccttggcctcccaaagtgctgggattacaggtgtgtgccactgtgcccagccagggctgagacttttgaaagtgaaggaaggtactatccataattaacaggtatccatggagactttttacctaagcagggatgtgtcattatctacactggcttattccacttctttaatacctctgcagatacctggacgggtattttgcaaaatataaaggaagcctcactcatatggtcagttctatctatatctcttctattttcttaggtctctctgctccctggtgtgtaagtggacatattcagcagagaaaggctgggacgacagtttctggaaaatgattggtttggaagactttgttgcagataattacagcaaaataggtaaaagaataaaacatctgtagagtgattatgtgcattggaggatcttgatgggtttgttgttattgtggtttgtatgtttcttgtttttgtatgcatgaaaatacaggaatgaagttcactttttccaagacaaatgagttaattatgatgggtaggccatgactagtaggctcttgccttaagatttatatgaactgagtagagatacatgctatgaaaatctgcattgaaatatagaatcagaaattgcgctgggcatggtggctcacacctgtaatcccagcactttgggaactgaggcaggcagattgcttgagcccaggagttcgggaccagtctgggcaacatggtaaaaccccatttctacaagaaaaatacaaatgttagcctggcctcgtgcatatgtctgtagtgtcagctactccggaggctgaggtggggggattgcttgagcctgggaggcagaggaggttgcagtgagctgagatcgtgccactgcatgcagcttgggcaacagacagagcagaactctgttttgagggggaaaaaaaaatgggctagactgaggaagatatttgcaaggagcagcttgggaatagcatactcaaggggctgtgtatggactgcttccagtcagtactacgaaaataattttacaaattaggttcacaggacaaggcaaggctgtgaacaggtaaaaaataaagctaaaagatcaatattagaaaatctagaaaaaagcagaaactagaacgagtcagtggctcctaactaaggccttagggtctcagactaaggccttttatgtgggtggtaaagtacatcttctatgtcccaagcacatttctctgtgcttgtatgtaccttgttttatatatttctcacaactactgacaaaagcactgttgcatgtttacagatgagaatcagagagattagtaaccttgcctaacctggcatggaatcaataaatggtaagtcaggatcgaaattctcccaatgggaggacctagaaggaactaatattttactggaacacaaatttcagcttcagttacctaatggtttaagtgatttgtaaaatgtatatgccctccaaaaaattagttgttttttgctgaatattcccatggtatgttgttaaacatagctttattagtgtatatattgattacctgtatatgtgtcttgattcctcactagactgtgagctgtttgacataaggattttcacttatttacctttgtatttcctgtcctagcacaaggcatggcatattttcatatctcagtgactttttgattaaaatattgagatgcttggtactaggaggttggcactctttcctttaaaaatctgtaatgatatttactgattttaacattatctttggcaattgggtataacttcaactctgattttctgattatttttatatttttctgctcctctttcctgcctcacacatgacacatgtttaattagtatattagctctgctaacgtagcagtatctacaagaaatattcattagaagtccataatgttaatctagcagaaaatttccagagtaactttattagattttttccctgttaagttaatggatttttaatggatttcctaaggagacatatcattaagcagaatattgctgtacgtgaattagaacttacccatttatcaaaattaattgtgtgatgtttcctttgattttcgcttctggacacttgagcttgtagtttcagtctgaacccaaagtagaagatatttaagaggctgtttattctcagttgtgactttcagaaactcctctggaagctacctctagacattctttagcaattcttggaactatgaaagatgaatctcagaagcctccctatgaagtgttaaacatttccagtggcctcattgcccgtcaagatgtgggcaatatagtgtgaaaccttttagcagatttgagcattgagcgtcctggatttgagcattaatacaattaccataatttgctccatgtggagcttttagccaagcctttaccaggcttcctgggcccatgcagtaaataaatgctttccctgaaaactgaacacctcagcaactgatggtcttatggaggaatatttttaaaatgaattatttatgaagtgtaagttaaggatcaaatgcaatatttatatggtgcatttcaaggacaggagaaaaaatttacagggttttaagtaataacatgcaagtttctaaagctaaaatgttactacctaatgccttctttcaaggaggtatttggatggcttggtttgggaacattcacaaagtaaggaaaaatagttttgtgcatcaaaagaatatagtagaaatttctttacaattgaatagaaatttctttacagttgaaactgtacaagttgacttaatgttcagaattgatggagaaaaatgaaacagattttgggtaggagattatatagccctactgacaaaatgatctgtgttcaatgaaatgatccaacaaactgatctgtgtcaataaattttgacctttaattccacatgaataattccccagttacctatctaatcctaaacatctatcaaaagcaaacaggaaggaagagatcagcagggagaaaggaccttaggaagataagcaacatcccacctgttctaattgattatccaggtgccatttcagcatgccgcggttgcctttttaattcctgggaaaatctctttgttctactattggggtagcccactttatgaaaagtcgtgtgtgcaacatggctgaattatagagtgattatctgcattactaacagggtttgtcatataaagggattcagtgtattagcttatagatcattcctttatttgggaccagggaagccaggcaaagaaaaatgtaaattccaagtccaggaagttagtaagtgttaagtgagaggcagaaatgaagataaagggcaggagacagtttcttgagtggagggaggctgctttttaaatgggtttcctcgacccgggaagcacaaggggtgggggagatttccctttcctagacaagggaagccatgacagactgtatctggaaaatcgggacactgccgcccaaatactgggcttttccaacagtcttagcaaacggcacaccaggagattatatcctgcgcctggctcggcgggtcccatgcccagggagccttgctctcactgctagcacagcagtccgagatcgaactgcaaggtggcagtgaggccaggggagaggcttccaccattgctgaggcttgagtaggtaaacagagcagctcggaagctcgaactgggtgcagcccaccacagctcatctaggcctccctgcctctgtagaccccaccactgggggcacggcgtagctgaacaaaaggcagcagaaacctctgcagtcttaaacgttcctgtctgacagctctgaagagagcagtggttctcccagcacagtgtttgagctctgagaactggacagactgcctcctcaagtgggtccctcacccccgtgtagcctaaataggagacacctcccagtaggggccgactgacatctcatacagctgggtgcccctctgggatgaagcttccagaggaaggatcaggcagcaatatttgctgttctgcagtatttgttgttctgcagcctccgctggtaatacccaggcaaactgtctggagtggacctccagcaaattccactttatgaaaattcctgcagctgaggaacctggctgttagaaggaactctaacaaacagaaaggaatagcatcaacatcaacaaaaaggacatccacaacaaaaccatcatcaaagaccaaaggtagataaaactataaagatggagagaaaccagagcagaaaagctgaaaattctaaaaaccagagcacctcttctcctccaaaggatcacaattccctgccagctacggaacaaagctggacggagaatgactttcacgagttgacagaagtaggcttcagaaggtcggtaataacaaacttctccgagctaaaggaggatattcaaccccatcgcaaggaagctaaaaaccttgaaaaaagattagatgaatagctaactagaataaacagtgtagagaagaccttaaatgacctgatggagctgaaaaccatggcacaagaactacgtgacacatgcgcaagcttcaatagccaattcaatcaagtggaagaaagggtatcagtgattgaagatcaaatgaatgaaataaagcaagaagagaagtttagagaaaaaagagtaacaagaaacgaatgaagcctccaagaaatgtgggactatgtgagaagaccatatctacatttgattggtgtacctgaaagtgacgggaagaatggaaacaagctggaaaacacatttcaggatattatccaggagaacttccctaacctaggaaggccaacattcaaattcaggaaatacagataacaccacaaagatactcctcaagaagagcaaccccaagacacataattgtcagattcaccaaggttgaaatgaaggaaaaaatgttaaggggagccacagagaaaggtcacattacccacaaaggaaagcccatcagactcaccacggatctctcagcagaaactctaccagccagaagagagtggaggccaatattcaacattcttttgttttgttttgttttgttttgttttttattttattgtattttatttttttcttctattattattattatactttaagttttagggtacatgtgcacaatgtgcaggttagttacatatgtatacatgtgccatgctggtgtgctgcacccattaactcctcatttagcattaggtatatctcctaatgctatccctccctcctccccccaccccacaacagtccccagagtgtgatgttccccttcctgtgtccatgtgttctcattgttcaattcccatctatgagtgagaacatgcagtgtttggttttttgtccttgcgatagtttacagagatatagatcaatggaacagaacagagccctcagaaataacgccgcatatctacaactatctgatctttgacaaacctgagaaaaacaagaaatggggaaaggattccctatttaataaatggtgctgggaaaactggctagccatatgtagaaagctgaaactggatcccttccttacaccttatacaaaagttaattcaaggtggattaaagacttaaccgttagacctaaaaccataaaaaccctagaagaaaacctaggcattaccattcaggacataggcatgggcaaggacttcatgtctaaaacaccaaaagcaatggcaacaaaagccaaaattgacaaatgggatctcattaaactaaagagcttctggacagcaaaagaaactaccatcagagtgaacaggcaacccacaaaatggcagaaaattttcgcaacctacttatctgacaagggctaatatccagaatctacagtgaactcaagcaaatttacaaggaaaaaacaaacaaccccatcagcaagtgggcaaaggatatgaacagacacttctcaaaagaagacatttatgcagccaaaacacacatgaaaaaatgctcatcatcacttgccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggctctgttcacaatagcaaagacttggaaccaacccaaatgtccatcaatgacagactggattaagaaaatgtggcacatatacaccatggaatactatgcagcctatacaccatggaatactatgcagccataaaaaatgatgagttcatgtcctttgtagggacatggatgaaattggaaatcaacattcttaaagaaaagaattttcaacacagaatttcatatccagccaaactaagcttcataagtgaaggagaaataaaatcctttacacacaagcaaatgctgagagattttgtcaccaccaggcctgccttacaagagctcctgaaggaagcactacacacggaaaggaacaaccagtaccagccactgcaaaaacatgccaaattgtaaagaccatcgatgctaggaagcaactgcatcaactaacgggcaaaataaccagcttacatcataatgacaggatcaaattcacacataacaatattaaccttaaatttaaatgggctaaaggccccaattaaaagacacagactggcaaatatgataaagagtcaagacccatcagtgtgctgtattcaggaaacccgtctcacgtgcagagacacacataggctcaaaataaagggatggaggaagatctaccaagcaaatggaaaaaaaaaaaaaaaggcaggggttgcaatccttgtctctgataaaacagactttaaaccaacaaagatcaaaagagacaaagaaggccattacataatggtaaagggatcaattcaacaagaagagctaactatcctaaatacatatgtgcccaatataggagcacccagattcataaagcaagtgcttagagacctacaaagagatttagactcccacacaataataatgtgagactttaacaccccactgtcaatattccacagatcaacaagacagaagcttaacaaggatacccaggacttgaattcagctctgcaccaggcagacctaatagacatctacagaactctccacccctaatcaacagaatatatgttcttctgagcaccacattgcacttattccaaaattgaccacatagttggaagtaaagcaatcctccgcaaatatgaaagaacagaaatcacaacaaactgtctttcagaccacagtgcaatcaaattggaactcaggattaagaaactcactcaaaactgcacaactacgtggaaagtgaacaacctgctcctgaatgactactgggtaaataatgaaatgaatgtggaaataacgatgttctttgaaaccaatgagaacaaagacacaacgtaccagaatctctgggacacgtttaaagcagtgtgtagagggaaacttatagcactaaatgcccacaagagaaagcaggaaagatccaaaattgacaccctaacatcacaattaaaagaactagagaagcaagggcaaacacattcaaaagatagcagaaggcaagaaataactaaaattagcagaacggaaggagatagagacacacacacaaaaaaacccttcaaaaaatcaatgaatctaggagctggttttttgaaaagatcaacaaaattgatagactgctagcaagactaataaagaagaagacagagaagaatcaaatagatgcaataaaaaataatataggagatatcaccaccaatcccacagaaatacaaactaccatcagagaacactataaacacctctatgcaaataaactagaaaatctggaagaaatggataaattcctggacacatacaccttcccaagactaaaccaggaaaaagttgaattcctgaatacaccaataacaggctctgaaattgaaacaatatttaatagcctaccaaccaaaaaaaagttcaggaccagacagattcacagccgacttctacaaagaggagctgctaccattccttctgaaactattccaatcaatagaaaaagagggtatcctccctaattcattttatgaggccagcatcatcctgataccaatgcctggcagaagcacaacaaaaaagagaattttagatcaatatccctgatgaacatcgatgcagaaatcctcaataacgtactggcaaaccgaatccagcagcacatcaaaaagtttgtccaccatgatcaagttggtttcacccctgggatgtaaggcggttccacatatgcaaattaattaacataatccatcacataaacagaaccaaagacaaaaaccacatgattatctcaatagatgcagaaaagactgacaaaatttaacagtacataatgctaaaaacttaataaactaggtattgatggaacatatctcaaaataataagagctgtttatgacagacccacagccaatatcatactgaatgggcaaaaactggaagcattcccttggaaaactggcacaagacagggatgccctctctcaccactcctattcaacatagtgttggaagttctggccagggcagtcaggcaagagaaagaaataaagggtattcaattaggaaaagaggaagtcaaattgtccctgtttgcagatgacatgattgtatatttagaaaactccattgtctcagaccaaaatctcctcagctaataagcaacttcagcaaagtctcaggatacaaagtcaatgtgcaaaaatcacaagcatttcctatacaccaacaacagacagacagagccaaatcatgtatgaattcccattcacaattgctacaaagagaataaaatacctagaaatccaacttacaaaggatgtgaagtacctcttcaaggagaactacaaaccactgctcaatgaaataaaagaggacacaaacaaatggaagaacattgcatgctcatggataggaagaatcaatatcatgaaaattgccatactgcccaaggtaatttatagattccatgccattcccatcaagctaccaatgactttcttcacagaactgaaaaaaactactttaaagttcatatggaaccaaaaaagagctcacattgccaagacaatcctaagcaaaaagaaaaagctggaggcatcatgctacctgacttcaaactatactacaaggctacagtaaccaaaagagcatagtactgctaccaaaacagagatatagaccaatggaacagaacagagccctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttataccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaccaaaagccaaaattgacaaatgggatctcattaaactaaagagcttctgcacagcaaaagaaactaccatcagagtgaacaggcaacctacagaatgggagaaaattttcacaacctgctcatctgacaaagggctagtatccagaatgtacaaagaactcaaacaactttacaagaaaaaataaaacaaccccatcaaaaagtgggcaacggatatgaacagacacttctcaaaagaagacatttatgcagccaacagacacatgaaaacatgctcatcatcactggtcattagataaatgcaaatcaaaaccacaatgagataccatctcacaccagttagaatggtgatcattaaacaggaaacaacaggtgctggagaggatgtggacaaataggaacacttttacattgttggtggtagtgtaaactagttcaaccattgtggaagatagtgtggcaattcttcaaggatccagaactagaaataccatttgacccagcgattccattactgggtatatacccacggattatacatcatgctactataaagacacgcgtacacgtatttttattggggcactattcacaatagcaaagacttggaaccaagtcgaatttccaccaatgatagactgaattaagaaaatgtaacagatagacaccatggaatactatgcagcaataaaacaggatgagtacatgtcttttgtagggacatggatgaagctggaaaccatcattctgagcaaactatcacaaggacagaaaaccaaacacggcatgttctcactcataggtgggaattgaacgatgagaacacttggacacagggtggggaatatacaccagggcctgtcgtggggtgggggaatgggggagggatagcattagaataaatatctaatgtaaatgacaagttaatgggtgcagcaaaccaacatggcatatgtatacatatgtaacaaacctgcatgttgtgcacatgtaccttagaacttaaagtataataaaaaaaaaacatacaaacctattatacttttcccttcttaaatttatccctttctttgatcttacatttccctgtaggctacatcttgttactgtaattccttttattatagagttactacaataattgtcttttactgcctctacttcctatgatgacattacagttacactttcttccccaccactgtactgaaattaaaaaaataataataaaatggatttcctccatccctatgagactgtactttgggtgtcagatgacaaaaacacagtcacttggcacattttagatactgatgaaatattcattgaatgagttaatatatgtttgaattaaggatttgattttttttaagtcccttgttggcttcaattgtttctttcttgttttttttgttttgttttgttttgtttttttttgagatgtagtttctctcttgttgcccaggctggaatgcaagggcatagtctcggctcactgcaacctctgcctcccggtttcaagtggttcttctgcctcagccttccgagtagctgggattacaggcatgcgccaccatacctggctaattttgtatttttagtagagacggggttgctctatgttggtcaggctggtctcgaactctcgacctcaagtgatccgcccccctcagcctcccaaagtgctgggattataggcataagtcaccgcgcccgactggcttcaattgtttctaaaccacaatggactttcgtaaattttttgaattaaataatactactagctaacaggcaatgaatgtatttccttaattcagtgttcactgtcatctttcatgaacaccttctacataagacgggtccctgcagaagatacaccctatgttgagtgatagtgcaattctatttcattcctgtagcaaatctctcagagacttttctatcttaggaaatatcacagactccttcacagaaggaaaacaagaattaatcttagaaaggttgggcatttcactttttcatagagtaaaataaactgaacattaaatgaagctacactttagatatttttgtcatgtaggctaaaaatttgtaagtaaagaatcttggctgggcgtggtggctcacacctgtaatcccagcactttgggaggccgaggcaggtggatcatggggtcaggagatcgagaccatactggctaacatggtgaaaccctgtctttattaaaaatacaaaaaatcagccaggtgtggtcgcgggcgcctgtagtcccagctacttgggaggctgaggcaggagaatggcgtgaacatgggaggcggagcttgcagtgagccaagattgcaccactgcactccagtctgctccactgagcaagactctgtctttaaaaaaaaaaaaaaaaaaaaaggatcttgactaatgaactaatgataggtatatgctggggacataaatgtgccagtgaacagagccacctcaggcaagggtgcagtattggctttggtcacactgaatcaaagttcagggatcttctgcctcttgttggaatctggctagactttggaacctgcacaatactgacttatccacccactggctggccaagaagctgagacaaagagaaaagaagccacctatacttgcctgaagcaagctgcacttgatcagattgattcatgaactcagagcccacaggcctgagtacaggtggctcaagaagaaagtattagttcttttctgctgctataacagaatacttgaggttgggtgatttataatcagcagagattaattcagctcatggttctggaggctgcagtgcccaagggtgccgataacttctgggcatctgataagggccttcttgctgcatcatcccatggcaaagggtgcaagagtgtgggactgcacacacaagaatgagagagggcaagagggggcttggctttatcagaagtgcctcctaagacaatggcattaatccattcatgagggcagagccctcatggcttaatcacatcttaaaagtctcaccttttaatactgtcataatggcaatgaaattttaacatgactttttgttttaatatgctgagcttttattcatatttttttttaacttttaagttcaagggtagaagtgcagttttgttacataggtaaacttgtgtcatgggggtttgttttacatattattttgtcacccaggtattaagcctagtacccgttatttttcctgatcctcttcctcctcccaccctttgtcctccaccctcccaaaggacccagtgtgtgttatccccctcattgtgtccgtgtgttctcattctttagttcccacttaaaagtgagaacatgtgatatttggttttctgttcctgtgttagttgctaagaatgatggcctctagctccatccatgtccctgcaaaggacatgatcttgttctttttttatggctgcataatagtccatggtgtacatgtaccacattttctttatccagtctaccattgatgggcatttaggttgattccatgtctttgctattgtgaacagtgctgcagtgaacatacatgtacatgtgtctttataatagaatgatctatattctttggggtatatacccagtaatgagatttctgggtcagatggtatttccatctttaggtctttgaggaatcgccacattgtcttccacaatggctgaactatttcacactcccaccaacagtgtatcaacagcgtttaagtattcccttttcttcacaacctcaccagcatctgttattttttgactttttaatagccattctgactggtgtgagatggtatctcattgtggttttgatttgcatttctctaatgatcagtgatgttgacctttttttcatatcaatatgacttctgaaggggacattcaaaccatcacagagatacatgccaagccttcatgaactccacttcaggactgtggccccacttcccatttaacacggcctcatggatactattatacaatcttttcagtctcagggatccagctaagtgattccttctcccatggatggaataagggagattataaaagcaggaaatgggagcattcacaccaatactacctcattttaggggaaagaagaggaaattcccttttgtaaacaaaccatagaggtttccaccaacaacatgcattatgtccagtgctggaagcctgaatccagtgatgccatccatagttgtgggtgttgtaaaatccttttagagcaattaatattcaatgttctgaatttttccagtaaaagtggacatgtttacaaggattcatgtcttcattctttatagtgtgtggcttgtttttcattttgatttgaatgagccatataattcagttatttctgtcctcagagctttgctgaagtgctgcttcatctttgtatcatgtgatataagtgccaattttactaatttatattgagagctctggagaaatctttaactacaggtaatcccagccttttctaggttaaatggggcccatcacaccattacctcccctctcctgagggaggcttatatggtttgcctctgcatccccacccaaatctcatctcaaattgtaatccacacatatatcaagggggagacttggtgggaggtgattagatcctgggggctgtttccccaatgctgttctcttgatagtgaaggagttctcagagatctggttgtttgataaatgtttggcattttccctgcttgttcttgctctctcctgccttccttccccctctccttccaccatgattctaagtttcctgaggcctcccaagccaggtggaatggtgagtcaattaaacctcttttcttcataaattacacagtctcaggtatttctttatagcaatgtgaagatggagtaatatagaggccatccctgtgggtactctggactgagatttgcttttgcctgtcaccctgagcttttgatcttaccttatcctcttattatccttctcttccctgtctaagtgacagaaccaggtcttcacagtacttgaaggcaagtacctatcctctgagtattgatgccttattttactctttagtatcgaatttctgcctgataaagaatgacttggaggtctccatgccagttagccatccatccagtcatgcatccagccaaccacactccccaagtgtctcctgtgtgccaggtgctgggctaagtcctagggatacaaaagtgaattcatcatggtctatccctttggggatctcatgtctactaggggtaggggcaggtaaatgaatcagtaatctcaaggtttttcagtaactctacagatgtccaagatgccatggagaagcagagcaggcagtcactggcactggtggtggtatcaaggaaattttctcatgaggtggcattttatgtgtctggaaaattggagtggtagtgagaagtgacagcgtgctggcagtcctcacagccctcgctcgctctccgcgcctcctctgcctgggctcccactttggcggcacttgagcccttcagcccgccgctgcactgtgggagcccctttctgggctggccaaggccggagccggccccctcagcttgcggggaggtgtggaaggagaggcgcgggcgggaaccggggctgcgcgcagtgcttgcgggccagcgtgagttccgggtgggtgtgggctcggcggaccccgcacttggagcggtcggccggctccaccggcccagggcagtgaggggcttagcacctgggccagcagctgctgtgctcaatttctcgaggggccttagctgccttcccgcggggcagggctcggaacctgcagcccgccatgcctgagcctccccctgttccgtgggctcctgtggggcccgagcctccctgacgagcgccgccccctgctccacggagcctagtcccatcgaccacccaagggctgaggaatgcgggcgcacggcgcgggactggcaggcagctccacctgcagccccggtgcgggatccactgggtgaagccagctgggctcctgagtctggtggggacatggagaacctttatgtctagatcagggattgtaaatacaccaattggcactctgtatctaggtcaaggtttgtaaacacaccaatcggcaccctgtgtctagctcagggtttgcgaatgcaccagtccacactctgtatctagctactctggtggggacttggagaacctttgtgtggacactctgtatctagctaatctggtggggaggtggagaacttttgtgtctagctcagggattgtaaatacaccaatcggctctctgtatctagctgaaggtttgtaaacacaccaatcagcacccagtgtctagctcagggtttgtgaatgcaccaatcaacactctgtatctagctactctggtggggacttggagaacctttgtgtctagctcagggattgtaaacgcaccaatcagcactctgtcaaaacagaccactcggctctaccaatcagcaggttgtgggtggggccagataagagaataaaagtaggctgcccgagccagcagtggcaacccactcgggtccccttccacactgtggaagctttgttctttctctctttgcaataaatcttgctgctgctcactctttgggtccactttgcctttatgagctgtaacactcactgcaaaggtctgcagcttcactcctgaagccagcgagaccacgaacccaccgggaggaacgaacaactccagacgcgccggcttaagagctgtaacactcaccgcgaaggtccgcagcttcactcctgagccagcgagaccacgaacccaccagaaggaagaaactccgaacacatctgaacatcagaaggaacaaactccggacacgccacctttaagaactgtaacactcaccgtgagggtccgcggcttcattcttgaagtcagtgagaccaagaacccagcaattctggacacagtagtttaccagaaaagaggggaaatggcttccaaggcagaagaaacagtgcaggcacagacatggaggcatggaagagtgcagagtgtgtgtgaactgttgggtgtggccagagcatagtggacctgaagcaaggtggagaggagtagttgtgggcaagatagagtttatggggggctagtttctgatggaacttctaactttcctcaaagatggggccaccgattagagactcaacatggcaggagtcactctattcctttcaagagatggttctaattactactcctgccaatgcagtaaataacacttgagggcagtaggagccattttagaatatttgtggctcctatgaagctgtttgtgtgtcggggcaggtggcaagcccatttcttttcttttctaaagtcacataccttgccccttagctatcctcccttccataaaggtttgttgtgaagctggaatgtgatatcagatgtcacagggcagtgtggtttacgaagcctgtagaaatgttcttaccaactgtaagtacaccttggcacctggaggacaagaatattcactcctgcatcactctgttccaactgtgttcacactccttagattcgcagaaggactgttttcagctgctggcccttccaggaatagccctaaagagccagaagggcaaaggagtaacattgaccacatcatggtgatacaaggtaataactttcagaggttttgctgtggaaatgttcctcctttcaatacggcatctgaaagataattggaagtcccccaaaagtgaggtcacccccaacttctcttcctactgctggagaatcagcgattgtcagagctgaaagggatcatagagattttactgtaatgcactcattttatagacaaaaaactgagactcagggatgtgaggtgaatttccttggtcctgcagcattttaatgacagaaatgagaccagaaaccaggtcttctgactcttagtcctgtggtggttctactccttcctgccacttctcctgtttgagttttttggcaatgtgaggacatttagccaatctggatactgacatttgaatgaagctaaccactagaagaatgtcaaggagggaacgatttacataggtaaatttacccaatccattgtccaatcttcagtcatgcaaatgtaggaactggactttgcccaagtcagagacctttggatctaggaacacactgatcaagcccttaagtgactgatgtagataaacgagaataaataagtaataagttcacagttgcctatggtaatagttaagagattggtcaccagggtcagatggacttgacttcaattctgactgtcatctgtaatgaaatttctgccatatgtaactttgggtgagttacttgatctttctcagcctcaattagtatattatgaagattagtaagtatatcatgaggatgaaaggtaataatgcaggtaaagttcctagcatacaataggtcttcagaaaatgaaagttcttactactataatgattgtccattcctctgaattcagatttctctctaggtgatagattatctgccaaagaccataaccccttgaataatcccaggtaattattgccaacttctagatttggaatttttccttttttctgagcttcttccttggattcacacaacctttttccaaccaagatacaataagattaattagatttctgcttctaaattataatcacatttcataatcacaaaccttccttgagaggcatcttaattggaattaagggttttcctgaattcgtcaggtccacatgactggcaatctttagctttttttccatgaatagaggggtgcatatccacaggcaaataaaaaaaatacaggatatgttggttaacaattaactagttaattaataatggctaatgttcctacagtgctttacaacttagaagagtttttcttttcatgcactattgtgcttttttcttccaccaaacttgtaaaataggtttgatttcagttttacacttggggaagccaggattgatgagctttggtcttttccatctcagtagaaggtgtcacaattctccctgtcattcaggacccaaacctagaagtcattcttaatgcttctcttcttcctcttacaccttacatttaatccatcaacaagtactttctgctttgctccaaagtggacccggaatgaggcattcctgcccctcttcactattagtatcgtagttcaaagtagttttatttcttgctggatttgtgtgctagcctcttaaatggtctccctgtttctgtccttccctctgataatccattctccacacagcagccagagtgatattttaaaaatgtaaatcagatcatgttactctcctgcttaaattcctccagtggctccccattgcagctgggaaaaaaataactccttgccatgttcaacaaagtcttgcgtgatctctgtctgacttttattgcttaccatgcccccacgtagtcaccatccaaccacaatgaccttctttttgtccctcagacatttccagtgtatatagcttttgcgttaactctgccttctgtctggcatggcccttctcaaaatattcacatggtctacctctttctctttgttcagatctcagcttcaatgtcatcagagaagagctttcccttaccacccaaacactctcttctactccagcagtattctgtttccctgttgtattttattcttaacactcatgactatccaaaattaatcagtcttgtctggatgctttataggtattaactcgtttaatgcctttaaccagtctagacaggtactactatattcattttactgatgaggaaattaaggaaaggagaggttaagtaagttgctcaaggtcacacagtaagtaatggaatcagagacaggtctgctccagatcctgcacatctgtccatgtagctgcagtctcctggcctgggctgcgctgatacagctgcagttctcagactaagttcaacaagagtcccagtcctagtccagtgatgcctgaagtcacatgtttcattctgggcctcacattcatgaagaccactgacaaaaaggccccagggccccagatgaaaaacataatttaaagccagtgaatttgagaagcagttgagcagttttgggttttctcatcaaattacctgcccaatgtcaaaatattagtaaattatagatctagattttaattgagtgttgtctgacattcccttcctcagtgctgacttgagattactcaagatgacagaagaaaagtgctgcctcagaggttctttcctccctctctgtctttgaaaaagcacagggagaagagggctgaagatgtgactgtccagtaattggaaccatctcggctcctctgaaattctaggagaagaataagtgaacagtatgatatcttgcaaagcttcatgtgccttaatcacattaaaattcacaattcagttttggatttatttttccttgttttttgaaagttattgacttgggacttgcttctggatctcagttggacatctgacctcatgccattattgtcatccatttagaggtcatttatttcagtgttcttgaaaggcagccattcccagtggttggccttctctattgcatgtgacacatcgcagctcttctgcttagcttttcttggtcacacagctatcaggtggtgactttggcctccaatgtggcccttacctctgactttgtagctcctctgcagtactcttcactctggttctgtggagttttgactccgagatacccatgaccttttaagtttcccagcaccagctaacctttctgagaatctgcatcagagggctgcagtggtcagggtggcaggtcaccagttgactaatggcctcctccaaggtttgctggcagacactgcgttgccatgaaccctattgatcccagaagtttgcctgctgcttagacagtctttgcgggcgtgaggaggtagtgagtcatggagccaccacccctgctacccatctgttcttgtggtgaggagaacaaagatgatctctttgtggtatcataaaacctagaaagacattaaaaattccgttaaattttcatacgcttttagctgttgaaatgtacaatctattatgaggggggaaaaacccactgtaattttccccccactgcccttacttcagaggctacttaagggaccaggtaatgattttacgatgtttattaatacttcatgttctgcttccctcccccattcatttatctttaaattgaaagcacagaaactgccagggatctttaaaatccagagtttttgcaatgtcataggttgttctgttatggatattgtatgtagagatctattgttgactcagagctggggatggggttgggggtggtatttatttttaaaatgcactttggagtaatggaaataacatgagttttggagccagatatacatgagtttgaatcctggccctgccatttactacctttgtgaccagtatcaaacaagttacctaacctccgaaggccactcagttcaaccacttgccagattgggaaagtaatacctctctctgagaatttggatgacctcaaacagagacctctcaatgcaggcctcgtgggaacaatcttatcttatccggatatccagataatttttagtttttcttagttgttctgagtaattacttttattttctctgtctctcgtgggtatcatgtggagtaactgtcaagatatccctcacccctttggttgcttgagaattgacagcatattgaagcctcatctatagtagatttataaactatggtataaagctataacctcacctcaatttattttgttcccatgtttggtttatttaatctttgatcccacttacctcattttatatttgcctactagttataagctgtctgaaacattttataacatagcatgtagaaatatgtctggaacatagtaggtactcaatagatatttggtaaatgaatgaataagtaagcattagagatacagatacaatatgtttcagaggataattaaataaaagagggcaagataatgagtttgtgcctttgagatatccaaataaaaacatagagtagacatttggatctatgctaggaaaaaaggctagaaatagagatttggaagtcataagtgtagatgatatttgaagccatagatatgtgtgagagactctagagggagaagagaaatttcagtactttagaggccaggtagaggaagatgtgcctgcaaaggaggctaaggatgtacctgccaagggcagggagataatgaggagattttacaaggggagggaacaatctccaaggatgctgaaaaaggaagggagataaggactggacactgttcatttgatatagtgactcggggaccttagtgaaagtcacttgcttataatagtgaggcagaagataaaagtcgtacagcagccacagctaacactgagcacagatgctgtgccaagtgcttaatgtggactgttacattacaacaacatgagatgtgtagtcatctcaccccattcccattttttacagaggataaaaatgaggcataaagaagttaatcacccaaggtcatatagctgggttcaagccaagacaggtgtcaggactcagagtcacagttgagaaaatgaagccagaaagtttagataactcaagaaatttggtcagagtgtggggggagagagagagagatggggtggtcactaggggaggaagacggttggaaataggtagagtgttccactgtttggttgattgattgttggaagatggagatttgcttgagcatgtctgattgctgataagaagattctagtagtgagtgatgggttgctgatacccagagagaagggagaatcagtactgtgggtccagagaagacaggcaggattagccttggaatacagactttctattttaataggtaggaagaagacaaaaatggtacagctcatgggagcagcatgtgctcggaagtgggaagttaagggatttcccttcatgaggcttctgttttctttgtgaagtaaaaagtgagatgatcttctgacagagtggtagccaagtgagagagtcagaatctgtaaaaaatggaaaaggtttaaaatagaagtacagaggatcggggaaaagatgattagagaaatcttggaggattatcaaacggtacacagaaccctgcttaggggtcgccatgaatttattataaatctgccctgtggtgtgattttctccagcagcactcagcatctggttgtaagcacacaggaaagggttgttcttttgttttattaatcttaatgaatagcagtagtctgttctgcaagtccttgacaccaccctcttttctatatgctgtatctaatctgttaccaagtgctgtcagtcttaggctccaaatacgtctataattcatgaactctttccacctcaaaatgctacctagcctgtgttcccataatctcgcaactggattattcaacaggcttataacacttgtcattgaatggaaacttgcctttttcagtccatcctgaacactgcagccagcatgaactttttataatgaaaatctaatctaatcctgtgacctcccagcataaaccttctcaagtcttcccaatgcttttagggcaaaaaccaaaaacccgaattatggtctcccctccttctggcaccactgttttcattgatctctgacctcagttgccctcttttggttttctgcacacgacacccttctcaccgcaagatctgctctcatggtcttgttttgcttccagtatcgagtccatgttccaggaagaaggacaaggacaaagggcaaaagtatggactttgcttctgttccagtgttaactctgaaacctcactcggtctcttctgcctacatgtcaatggccagaaccgtattacatactactacctgcaagggaagctggggaaaggtccattttttgccagtcacatttcagccttcaataaaatgagagttgtgttatttaaaaagaagaggaggaggggcactaggtaagcaacctggagtcccaccttcaatgaggaagtgttttctaggtgaagagttgagtgaaggagatgctgacagaagtgacagcatgaatacagtttagtgctgagcaatatgatgtgggaagaaggtgctggaacactgagtttgaggcagggaaaagggagggaggaaacagagaagtaggcagggatcaaaaaatcataatgcccttctattccagctgaggaacttaaacttcatcccgtgtgttagcctctaaatgaggtcttatatgccaggtgatgtcaagcaagatggtctactgggtatagacaaaaatgttggtatttttatttatctccatttttatttcattttgtttaaattctatttttaggtatgcatcttgacatacacacatataatttataagttcaatagtacattatatacaatttataagtaatagctatgttgggagtccatctgaagacttttttcttagtgacttgcacagtcaaaatgtttagaaactattgcattaggcatcagggaactgttaaaacattttaaacaaggaaatgatgtgatccaaattgaatatggtccaatttgccttttctttcccctatagagttctttaaatttttaaaaattttagaatgttagtacttagaaagaaacattagggagcatcaaccctgtgtcataagtaagataactgaggcccaggaatattaaataattagaaccattaatttgtggctgagctggagccccatccaacctgggtctcatcttctcccagtggtcctttgtggccctgtgcgagtgctttctctcttcctgaatgcatgtccctattcttcagcaaatactcttctcatcagaattatgacatgtgggaatcaagaggggagtaaaagggcatatttataaaaaacgtggaaaccaagaaatctgttttgtaaaaatgaatcacctatttagcctcagggttctgttgactctttagctgtcaacatggaagtctctaggtaccgattcctgcaggttctgttttcataatgccagacccatcagcagtttaactgagacataccgttgtacaatgtcattattttaggtattgtatttgcaaggccagcggtctaagtaagagattaaactgaacagatttctgacttggtaagacagagactttctaaggggtacactgccccactttatcttaccccagtgtatatgaagaaacacatgtttacccatgggaatgtgtatgtatttggatctatttcacagagtatcttataaaaaccgacatgaaaagaaagtctgatttatagaatcctatttcctgacattgtgaatactagttcaggactttgctaactactttttgaccagtgtgactgatttatttccccatgccatcatcaacccagctatgcaagtacaggaagacagggtatctaataaccagatggtgaacaagatctgtattctcttgggtatactaagctattctgaaaattcagtttataggggtacagactaagggttatatatctccaaacaaatgtgtttgtcaagttgatgatcatgtttaccaagatccttttatcaccagctgagtcctcttttagtggcttaggtcaccctggaattatttcaaaaaccagcctgatgtttagaacctcctgtgggctcgggcttgccagacacaaacctaaaatgaagcctgtagccttcatggtagcaaactgtaacctcaagcacaattatatgaatcatggacaaatgttttcactttcaagcaagtttttgccgcagcaaaaatgaccacttatctaagaggctgcatatttatatatatataaacagtttttggacataagaatcttgactattatttcccacagagaattacagatttatatatgtgtgtctatgtgtatatatatgtgtgtgtgtgtgtgtgtgtctgtgtgtgtatatatacatatgtgtgtgtgtgtgtctgtgtgtatatatatatatatataaacaccatattctgtgtcttttatatatagtatcacttgattattataattaccatgaagtgccattgttcttctcattttataggtgaggaaactgaagctcagagaggtgaaataacatcacaaagctaagaggttgtaaatttggcacttttaaaattatctagttattacaaaagttgatcttcagatcaacaaacttaactgacatttcctttttgggccccattttctactctgtgaactgaggaggattgaattcagtgattctcaaaccagagcatacgtcagaaccacctggggggattcttaaaacactgattcctgggcctgcttagagtttctaaatcagaaattctctggagcgattaagaactggtgtttccaataagttcccaagtggtggttcccagccacactttgagatccattggagtagatgatctctcagtgtcttccagctgttacatcctggagggtcagcaacctgccatacttcattggtgtgtgaccaaaaatactgcttcttcatggagtgactttcctactacttttgccaagtttgttggttagccaggaaaattctcaacatgaatggaggaaaatgctgatgaaaatcactccttcctgtatttattaactcatttgccagactaatatttactgagtataccctttgcagatattgtgctacatactggagatagcacatgtgaagatactcagcccctgcctgcgagatgcctatcaactatggagaaaacagatgattaatttattgttattactaaaagggaagtgctgagacctatgagaataaaatacttctctaggatttgtgattatgacttcaaacttttcctaaacaggactattttctactgtggtcttaagtcataaattgtctattctctgtatctagttcgattctgttcttagctttttgaggtatttctttattgggacaggtcagtaagtggcattttcatttattttttaccaacctaagcatttccttcctgccctagatgaaaacttagctttgttcaaaatttgcattttcatttttagcctatggtgacagtttaaatcaacagcaaaagcagaaacccttgtctaaagcaatttcctcactgttattccaacttcagtgaaatgagaagtcctggggagatgaattcagactgtcttctctactcccaccccttctcctaacagtttggcttcttgaaaaaaaataaaagatgaaggaagcaggggtcttgaagggaagatgtctactgtaaaaaaaatagggaaaggaaatagtgtactgataatggttatcatttgttgagtgtgcattatatgccagggactgtcgccaaacattgtacatgaattagcaggtaaacttccccagtaaccaatgaggtacaggtaccattattatcttccttttacagatatggaaattgaagctcacagagggtagataactgtcccaaagtctcatggttatttgatggaggaacaggaattcaaaagcaggcctgactccaaaatctcatgctttttaccagtaaattagatctccagtcatttcaatccctgcatttttcatagggatggtgctgactcatttggcttcctggttttctgactcatctcactgaacagggccagatccgatatgtcttctgcattctcccttatatcatctttctccctgctcccttttctattatggtccacctactctatcatcttctttccatgggccttaaaggaataccttcttgtggactgtctctgtgatgcagtagaaatctggtaagcttgccagggtgtaaaaagtgcatttgtttaggactgtaatgtttatttgaaagggactttcaatcacagacatgacttttttatgagcctcattatatatccttgtgattggaaaaatgcatcagtaaataatgcctccatgaagagtcactctcacttgcattattttaaaagatttggtaataaaaagtactcagattattgataatccataattaatatgaagtaaataatgtgtgttttcaaataaaattcaccatgataagtgatgagagtatgggcttttatatttctttgtaagtcagagacttataaaagataggttatccatcactaaggaatatgtagacacattaattttagcattcagttttttttctctcttttctaaaaaacatgattctattcttcaaaagaaagagtggttttattatttttccagctctttaaaatggttcaaaaatcttggcctgcagacatctttttaaaaaatcaatttttcaataatttagagtgaatcacacccataggggggatgtgctttcaaaataattaaagtagaggaggcaggattatagatcttgagaaaatgtgcttggaaaatgtcctttgatttgttgtgaaccccaaagctttgaataaaataggataggactggaatcaacttctgaactttctcactagctagtggcatgttaccagtagtccagagaatgctgaatgcccatctaatctacactgtcatcccttttattaacaaaacttaggcttttagggtacatcagggtctttcattatagactacatttcccagctccctttgcagctacacatgttcatctaagttttggccaatgaggtataagcagatgtgtcctgtgggattcctgagacgtctcctttaaggagatcaggcagtggccatcctctttccctcccctgggtcaggtagattggctggtcaggtaggttagcagtgactttggataagggggacagacgccatactccagggatggcagaacagtgagcttttgtggaacttccataccagccttggattcactacctctggactttgtttgtatgagtaggaaatttgtttatttgtttttgctgttgtttttgctttattagaaaatcactgttttgtagatttgtagctacacttaatcataactaataaaaatggtgactcataaggtttgggaaaacaacagttaaattaaggtagtaagtttagctatcattattgagcacctactatttactaggaactgttctaagatctttatttgtaatagctcacataactcattcaacagtctttctaagagacttacccccattttacagatggtcagtcacagagaggttaaataacttgcccaagatcatacagccaagccaggagttaaaatcttcagtctatctcttaaactttctgtaaatcactgtgatgaagtgacttgacaacattctaaaaacaagtaaaactggacctaaactccaacttttccctatgtaggatacctgtctcctagacttgttgctaattatgttagttggcctctggcacatcacttagagcccctgtgcctcagacttaacactaataagaggcatgggacaatacctcaccattgtttagtatccattctgagcctggcactgtgccagacacacagatgtgtgaatgacagcgcacccagagggagaccatgcgttggtcaaggagacaaggcctgaacacttaagaagagccaaggaacagcaagggaaatgcagaaccacaatgtcactacatccaggagggttcttggtgcttgatatgtggctagcaaccagtgaacatccctggaaccaagtggcaatgcatgttaagtgccctgtgagcaggcagaaataaatgttttgaatcaaaagaggaggggagctttggcatctaaaggattcagggacacatggtgagtgctttggttcatgttggttgtgccagtaattgaaggagtcttgtagttggtaagatttggggaggtgatgggaagttaggctcttcccccttctggctttctctgccccagggctaacagggctagttcctggaacaccgtctgtgctcccctgtcttgggtcctacacacagctacctacctgtcagcttgggatgctttcccagcctttcatcctagctaccttcttatcctcctggtctcagaaaaaaatgacatgacctatatggagtctctcctaagtagaccacatcccacttacttgctctactgtgtggtgaaatcccatcaaaatggaggatatggttccaaagtcagtgcatactgtgagcagtgaatcagccaagagaatccttgaaaatccctgagggagctatctccacagtggaaactgataagctatctccagtaagtctaacacattaattccggtatttcttttttccctgttcgagatagctgtcctattttaaagtctaggttgtatgaaaaaaatctaggttacatgtagccaagctataggttatacactccaaggagtctcatgtacatagaccatgatgggagtgacacacccctgaggtttttcagtgtatatagaactgtacatagtggaggtattagggtcagatgtagcaaaaggagatattcacactaaaagaaaatagaaaccgaagccaacccagggaagagctgatttacactccattctcgggttgagctccctgtgtaggatggtgaaataaatcacttgcattatttatattgtttaatttctctctgcatctccttcatttgcttcctgaagcctatgtacagttgactgtgtgtgtctatctctgcaaactacagatcttcacttcctattataacacttatcacatttgaatttttcatggattgtaattatgggttaaatgtgcctgccagattatacattccatgagggcaggggccatgtccatctcattacctgctgtggcccagcacctgcatggtacctggcacacagtctttccaagcagttctgtcctagacattgttgtggctttcttctcacccgccttcaggaagatccacccaacttctttctcagttactcagcattaagatctgtagttgctgaggcactcagttaagcttagggtggagctaaaacctgcctgggctggtgcttctctgatacagaaacccctgaaactgatgattatccagaaatacttgatctctttgggggcctgaggagctttggaccaccttaactcatcacctccttaagctcccctacctctaaatgctcttctcaccgctcccactcccaccccctcccccttgccccaaggctcctcctcagcccaactaactgaggctctttcacaatcctaaaagcatcatctttgttttaattttttcttttatcttcaaaagcatctaaaagtaaaaacaactaaagaaaagccagaaagtgaatgaagcagaaaaacaatttcagcactctgatacagtaccccaaaacaattttagttcactttgcctttttttgtgccattttaacgcagttgaaaccatgccgtatatgccagtgtgtagtctgcagttttaaggtgacattattgcatattcatattttcatgatattctttagaagcataattttaataatgccataatattttattgaatgctgtaatgatatttttaagccttctattaaggttggacacttaaatgtttacctttttttctctagtatgtaaatattatggtacaaatacacaaaaatactgcagggaacctttttattttctgcatctgacagactcgcagaaatggaattactaagtaaaaaatacaaactctttaaaatagatttttatttcaggtgatacttaatgcatattaagtgtaaaaaacttagaaaatacataaaagtatttcatccagcatttacctccaagagatggctaattttttgtatattttctgtctttttgatgtatgtgtatatgtgtgtgtatatatatgtattatgtatatattatatataaatatgtattatgtatatattatatatattatatgtatctataataaaatttatactgtattgatatattcatactatatatgtatcattactttacacaattgaaatactttatatgcatgttgttaaaactcttcaaatatacagcttttaatttactgtgtaacgatttttaaaacaacacttttcttgtatcatttaaattttttctgatttcttctattttgttgtatttgtatacataccttgtcagcattttatgttattccttaggatggattccagtaatggatttaccaagtcaaaaggtataaatttttaaggctcttggtgtatattgtcaagtttctttccaggaagattttgccaaattgcatttccaacagtccataagattataaagcaatggaaaatagcatgtcctttctgttttaatttctatcttattaactcttagtgaggttgagctttttccttatatgttattcatgtatatcttcttttgtgaattgtctagatacttaaaaggctaagaatatttggaggttatttttaaaaaataattttttatttttaattgacgttttatacatatttagggggtacatagtgatgtcacagtacatataatgtgtagtgatcgggtcagtgtaattagcatatccatcatctcaaacatttgtcatttctttgtgctagaaacattcaatatcctcctaggtatttgaaaggatatattattgttaactatagttattctacagtggtatagaatactagaacttattactcgcatctagctgtaattttgtgttttttaataaatctctccctcttcccctcttccctctaccattctctgcctctaatatcctctactttttacttctatgagatcaacattttttagcttcaacatgtgggcaagaatatgcagtgtttaactttctgttcttggcgtatttcacttaatataatgtcctccatttccatccatattgctacaaatgacaggattttgttgtttttttatgtctgaatagtattccattgtgtatgtatatcacattttctttgttcattcatctattattggatacctaggctgattcatatcttggctattgtgaacagtgctgcagtaaatgggagtaaagatatgtctttggtatactgattttgtttcctttggataaatgccccagtggtgggatcagtggatcatatattagttctgtttgtagttttttgaggaacctccatactgttccccataatggctcttctagtttacattcccaccaatagtgtaagagtcctttttctctgcatcttcaccagcatgttaattttttgtcttattttgataatcactatcctaactgggataagatgatatctcattatggttttgatttgcatttccctgatgattagtgatattgaacattttttcatatttttgttgtccatttatatgtcttcttttgagaaatatctgttcagatcatttgccttttttaaaaaatttatttttaggagacgggatttcactgtgttgcctagactgtagtgcagtggcacagtcatagctcactgcagccttgaactcctgggctcaagtgatcttcccacctcagcttcccaagtagctgagactacagatgcacaccaccatacccacctaattaaaaaaaatttttttggacagggtcttgctatattgcccaggcaggtcttaaactcctggcctcaagcaatcctccagtgtcagcctcctaagtctctgagattacaggcgtgagtcaccatttgccaatatttaaatcaggttggttgtttttttcctgtaccaatggttgaattctctgtgtattctggatattaatgtcttgaccaatgaatagtttgcaagtattttctcccattctataggttgaattttcactgtgttgattgtttcctttgctgtgcagaagcttgttagtttgacataattccctttttaaaaattttttcttttgttgcctgtgctttttagatcttattcataaaatattttccctggccaatatcctgaagcatttcccctatgttttcttctagtagttttatagttgcaggtcttgtgtttaggtctttgatccattttgagttgttttttgcatagagtaagagttgggagtctaacttcattcttctgcacatagatatccagttttctgagcaccatttattgacaagactgtcctttcaaagcccagtgaatgctgttggtgcttttttcaaaaatcagttggctgtagataggtggattaaagtctgtgttctctgttcttttccattggtctgtgtgtctgtttttctgccaatactgtgctgttactgttttggttactaaagctttgtaatatactttgaagtctgaaaatgtgatgcctccagcctgcttgcttgcttgcttgcttcctttcctttcctttcctttcctttcctttcctttcctttccttccttccttccttccttccttccttccttccttccttccttccttccttccttccttccttccttccctccttccctccttccttccttccttccttccttcctttctctctttctctctttttttctttcttctttcttttttgcttaatattgctttggcattgtgttttttgtggttccatacaaattttaaggcttttttctatttctgtgaagaatgtcattggtattttgatagggattacgttgagtgtgtaggttgctttgggtagtatggtcatttaataatattaattattctgatgcatgagcatggaatgtctttccatttatttttatcctctttagtttctctcatttgtggttttccttgtagagatctttactaccttggttacattattgtatttaattatttttgtagctattgtaaatgggattgccttcttgctttgtttttcatctagtttgttgttcatgtataaaaatgctactgatttttcatgtcaattttgtatcctgaaaatttactgaatttgttgatcaattctaagagtttttttggtagaatgtttaggtttctctatatatgtgaccatgtcatctacaaacagggataatttgacttccttctttccagtttagctgttcttttttttttttcttgcctagttgctctggcttattcaaaggttgttgacacatacatagatacctattttaaaagagtggcatgtgagaaaaatacaggaaatagagcccaataagatatgaatatttgaatttgctgatccattctttcatataggactataagatttaactcttaaaacttcaaaatttttctgtatgtactttccatcttgtaaagttataatagacgcgtgtcgttcttattggagtcaatgaattgggctctgtcatttgttgagatatcatccttctggctctggagttctgtaagaaaatgacaatatatttagggtgataaagctaatatctcaagtctcaattgtttgagagccagttatcagattacctttcacttctgttcctatcattttgttaataactattgttcatttatttatgtacttattgtctggtaccccactataatgcgtccatcaagagagcttacatctctctcagtagtctgtttccttcatttcctccaaatttccattaactttttaatctgtttgcttatttgggtttctgtctttcatattaggggctctcttcagatgataaggtgatccttggctgtctgtttcatgcttgagaatggggtactaaaaagatgactgggaactctatacatgcataaggcttatcaacagtggtttgtacttgtacggtgatctggatggcttgtttagaaggggaaatcctctgccagtatttttggatttttttctattagtttaattaacatccccagagcaaaactttcaatctttcaatatctaattgcagaaataaagcctggctgctggagttcaaggggctagcataggaaagagactagatgactccagtagatattatgaaaactttcactaaatcctcctttttcactttaacttttttactttcagctgcctggtatccactatctagatgccttctgtttttcctttccaggtaataaacctcgagtcttttgccaagttgacaaaagggatggtcacaccagtgtcaagtcagtactgagtctgcctttttattaaacaggctttcagccagttttactattttcagtccctctttactctcacttctagagatatcatctgccaccaaattcctaagcactttggggttctataaggcaaattgagttactttttagcttttgtcacaatcaattaaggcttcaggttgcttcaaattgttaaattggttaccatttatctttttactttttaactttcatgattttgttgctgctattattttctgtcatatttttgtcttgatgggtttgtatattttaaaaaaatacctcttccatgtcatactcattaggatggctactattaccaaacaaaacacacacacacacacacacacacacacacacacaaaacagaaagtaagtgttggtgaagatgtggagaaattggaaaccttgtgcagtgttggtgggaatgtaaaatggtgtggctgctgtaaaacatggtggtagttcctcaaaaagttacaaacaatattaccatatgatccagcatttcatttctggccatatacccaaaagaatggaaagcaaggactcaaatacatgtttgttcacccacgttaataaaagcatcattcacaatagctaaaatgtggaagcaaaccaagtgttcattagtggcagaactgataaaatgtgatatatacacataacagaatatgattcagcattaaaaagggagggaattatgacacatactatagcatggatgaatcttgaagatactatgttaaatgaaataaggcagtcacaaaaggaccaatactgtatgatccttcttatatgggatacatagagtagtcagattcatagagatagaaagtagaatgatagttaccagggatttgggggaagggggaaaggagaagttagtgtttaatggatatagagtttcagttttgcaagatgaaaaatgttctagaaatgggtggttgtaatgatttcatgatgtgtgaatgtacttaatacaactgaattgtatgcataaaaacagttaagatagtaaatgttatcttacatatattttaccacaattaaaaaatttttaaaaacaatgaaaaataattccactttacatttattttattctcttcttgggggagatagagactaattaatgtattcaatgtgttgcttaaaattaaatctattatttcttagtttacagctaagatgagcctttttagggctaaatcacttgccctggtcacagatctagtcattggcagcctagggtttgattcagttctgggaggaaggcagggtttgtatctgctgtgatacatagatcagttcgattcattctttcattagccagcattagaacacctttttcattccagcactcttgaaggtagcagtaagcaagacagtaaggttacatcacattaccatgtgagatggagaaaccagacagtaagcaagtatatacataaacaagacaaatgcaaatgtggctaattgttatgatggaaataaagtgctggctgaaatgtgggtagggaaggcttctctaaggaggagacttcagagttgtgacatcaatgtggagatggcctaatcagtgtgaacatgtgggcaggagtgttcctggcagaagcaacagcaggagcagaggcccagggctgggaataaggttggcatgtttgagaagatagaaaagaccagtttagcagaatgtactgaggaaggggaaggacaagtgatggggtaagaggtgtaaaaaatgcagaaccttgtgagccttggagtaaagcagccaaagctttcctaggtatacagaaagccactagaggggtttcaaagggaaatgatgattttactttttaacattctgttggctttcactttgtatctactgtatagcagatggtaggttgtagataccagaaatgcaatatgtaatactgttgcccacaaggaaattatggtctggtgaggaagaaagagcagagagtgccagaaaaatatagcagcatattccacagtgtacactttggggtactagaggtgatttttaggaaacaaaaattctttatagtagaacaatttatattcctttgggtatatacctactaatgggattgctgggtaaaatggttctttgagaaagaagttctctaagttctttgagaaatcaccaaagtgctttccacaatggctgaatgaatttacattcacaccactagtgtataggcattcccttttctccacaacctcaccagtatctgttatcttctgactttttaatgatagccattctgactgatgtgagatggtatctcattgtgattttgattttgatttctctaatgattaacactttttcatatgtttgttggttgtatgtcttcttttgaaaagtgttcatgttatttccccattttttaatggggttatttttcgcttgttaatttgcttaaattccttaaatattctgggtattaatcctttgttggatgcatagtttgcaaatattttctcctattctgtaggttgactgtttactctattgatagtttcttttgctgtgtggaagctttttagtttaattaggccccatttgtcaatttttgcttttgttgcaattgcttttgacatcttcatcgtgaaatcttagccagagcctatgtctagaatggtatttcctaggttttcttctagggtttttatagttttaggttttatatctaagtctttaatctatcttgaattgatttttatatatggagtattgattttatatatgatttttatatatggtatacaattaggtatataatacctaattgtatttcctaggttttcttctagggtttttatagttttaggttttacatctaagtctttaatctatcttgaattgatttttatatgtggtataaggaaggggtccagtttcaatcttctgcatatggctagttatcccagcaccatttattgaattggggggaggggtctttccttattgcttgtttgtgtcaactttgttgaagatcagattgttgtaggtgtgtggctttatttctgtgctctctattcttttccatggatctatgtgtctgttattgtactagtgtcatactgttttagttactgtagccttggaatatagtttgaagtcaggtaatgtggtgcctccagctttgttctttgtgcttaggattgctttgtctattcgggctcttttttggttccatatgaattttagaatagttttttctagttctgtgaaaaatgtcattggcagtttgatgggaatagcattgaatctgtaaattactttgggcagtatggccattttaataatattgattcctcctttccatgagcatggaatgtttttccatttatttgtgtcatctctgatttctttcagcagtgttttgtaattctcgttgtagagatctttcacctctctggttagctgtattcctagatatttttattttttgtgtcactattcaaaatagcaaagacatgaaatcaacctagatgcccatcaacagtggaccggataaagaaaatatggcacatgtataccctggaatactacacagccattaaaaagaataagattttgtcctctgcagcaacatgaatggagctggaggccattatcctaagcaaactaatgcaggaacagaaaaccacatactgcatattctcactggtaagtgggagctaaacaccaagtacatatgaacacaaaggagagaacagtagacactggggcctacttaagggtagaggttgggaagagggtgaggatcgaaaaactacctgtagagtgctatgcttatcagctgggtgatgaaataatctgcacaccaaactaatgtgacacgcagtttacctgtgtaacaagcctgcacatgtacccctgagcctaaaataaaagttaaaaaaaaataaaatagatgaacaaataaataaataaaatgtggttactagattgattaaaaaaatgtctacaatcaaatcaggttggggattcatatgtgatatttccttagagattctcagtgcacaccagcatattaaagtcccaattgttacatcacagaaacctgtgtactttgttcaactttacatttcctaaatttatttgcacaaatagcttctttcaaataataccttttaacatctttttaaactcctctgggaaacactgatttaaggcaacatgacaattatatgttaggtgttatggcaataatgaggggggcctaactaccacaactctgggtgtgaaacaggtaagcattcaggattgccttcctggagtaggtgacccctgaattgcttccagaaggagtagagaggttagccttgtgaagaatagagaagggtatttcatagagaaagaactgccaaaacacagatatgtagacccaaacatcccacatcatcatccttggaaaatagatttacaaatttccagcaggaagaggaaaaaaagtgcttgaagtgtgctggtttctcaccttagtggaaataattgcttaaaaaaacagccagaggctggacacggtggctcatgcctataatcccagcactttgcgaggccgaggcagcagatcagctgaggtcaggagtttgagaccagcctggccaacatggcaaaaccccatctctactaaaaaatacaaaaattagccaggcgtggtggcaggcacctgtaatcctagctactcaggaggctgaggcaggagaatagtttgaagccaggaggcagaggttgcagtaagccgagatcatgccactacactccagcctgggcgacagagccagactccgtctcaaacaaacaaagaaacaaaaaaaaccagagtagaatgcaattctcctcatctggatttcagcaagaattgcccatttctgttcagccgtaggcctccatcctctgttgccagtctgttcttctgactctcacctgtctcctttctgcacacagaaggccagagagaatgaacaattcttccccatgtcagttggctcacccttcctggaagtgtggatttcctgttagtacctgcaactctgtcggcgctgctatttctgtcttcgcgttgtttcagaatactctcacactgctgccccatttttccgtacgcagtcttccaggcccttttttgcacctgatttttgccaggcagcataattagaggatgttacatttccctgaaagagcatattctcatggacaacaggacacaagggagtaagaaagcttcaaagatgctggagggtctccctcctgtaccccaacctgtgccacttggtataacaggattctacatgagttagcttttctttattgttattaggagattaataaaaattgacctcatttatttagtgcttactatgtaccagacactgtaccaagaatttattatcattcaactttcacaaccctaaaatatgtgtattttacaaatgaggagaagtaggctggcgagtagcttgcccaaagtcattcaactcagaagagaggccatcgtttaatcttagattgtacttgtaaaattcacacatccaatacataatgcctttaaatgttctcattgttaacatttattttctttggattctgtgcctatttctgcttatgtctccggattacctgggagcttttaaaaataagaatcctagggttccactttataacattgaccagaagtcaagaatggggcccaggaattgctattttcagaagctccctaggtgactctaatgcagggctcttcataccttggtgtgcgtcaaaatcacctggtgagggaggatggctgggctccacaccacagtttctgcttcagtaggtctagggtggggactgagaatgcacacttctaacaagttcccaaatgctgttcatgctgccatcctagcacttgagcatttttcccaatatgtgtatgatccccctcccccaccaactgggtgacgtagatagaactttaagtgtcattaagttatgtcatgttttgaatctttctctgctcgatttccacgtcaacatgagtgagggcttcagggattttactccatcattttggctaaatgccaacttggcaaattccactcctcccccggagggactgcaaatgccagtgtcctccttcattcaggagtgaggtcattgtctgtgtggttaaaagtggacactttctgctgcttctgcttttgcactgtagtagaagtttcaaggagctctattttacagttccaaattaccatccctcccctctttaatgcttccaagatggatagtctctcaccataggttaatgtttagattttgatctctatttctcagccccccaaatctggatgatcctctggtgccagagctgttgcatgtatcacccctggacactttcttctctgcttgaaccagagaataattatatatagtagttcccccttgtccatggaaaataccttccaagacccccagtggatgcctaaaaacatgggtagtactgaaccctatgtatactatgtttgttttttttttttttttgatctggtaactgagaggattactaagcggacgacagggaggtagtgcctacagcatggatttgctggacaaagggatgattcacatcccaggtgggaccaagctagataacgtgagaattcatcacactattcagaatggtgtgcaatttaaaacttatgaattgtttatttctggaattttccatttaatatttttgtactagagttgaccatgagaaattgaaaccatggaaagcgaaactgcagataaggggagactgctgtgctagagtgctatagaggatttcatttggaaaaaaaaagttttggtcctggaaaaaaagtttaagaacatagtcgtattccatttcttcatatgtttgagatatttctggctttggtgaaacataggctaggaaaagaacctaacatcttattagtgtaactgaacaacagtaacagcagacttagcctttcttccttatgtgcaacattacctgtgacctgactcttgaaacatagctgctattaaagtacaagtgagtcatgcatagcagcttctccttgcccagttaatttctctgtaaaatctttactctcttttattcatgtatatatatgtatgtgtgtgtgtgtaaatatatacatatatatgtttgtatttccctttaaggatttcaaacacaaagaccctagtcatttgattgtctctgtactgtcgaattttgcctacaaccctgactgtagagacacattgttacctgttttccatattctgtctagtaaatgcttggttgtcaggacaacggcatagaaggtggaagctcattgataaccacgtgaattctttaaacaaatatgatcagagcaaattccagggtatgcttgaaagtagatttaaggaagagcaaaggtttcagacatatccttccttttataaacttgatattcatctttaaggatcagcaacagttggagttactcataattttatttaaaatcctgaataaagatatcaccttagttttatggtacgtttgtcattccagcttgttaggcatgagtgtgttgttactgacagagcccctggaggacaggcagacactgtggttctccatggtctctcagtaccaggcacagagcaagcacccaatacatattataggaataaatgatctcaaatcttcacagtgcctcttatagatggcttttatgatatatatctgcagagaaactgaattcagggattttaagtgccttttttgcaaggcccttaaagtttgggaaagtaggtgcatggaattagaactcagattatcctgacttctaagatcacactcttcattgtagcacactgccttcttgccaaaaaaaaaaaaaaaaaaaaaaaggaagaaacatgtaaaaagacagaccatttctaagatgaaatgtgtgcttttcaaaacaatagcagaaaaccttcttcaaaggtaaaatagttggaaatagaagaagaaataatatgtaatttagcgttcgttgaggataagcaattaatcctgccctccaggggtgaatttatgtctagcctatttgcacatgaaagtacaagttgggcttcatttctatgcaagtaagacatctggttgggaagtgaaaaattttgtcagttacctgaatcatgtttggtctacatgatagaaaagcccctgatgtcttcagatcaccagaagacatttggcattgtatagttaacaccagatccactgactgagtggttcacctgagagttgctgcttgacatcctgtagattcacccattgttaggaggctgttaccattttgtaagtcagcagtttgcaaacagtagtccagacgagaaaccaacgctggcccttgacaaagtgttcactggtgtgtgatgcaataaatacatgaggtcataaaaggaagtgtatttaccttaaaaaagaacatcctttattttgagatcctctgcttcctatgtttttagtgatacaattttgtgtcaaataaatcctcattgtaagatttggttttaattagtaaatgagacaggataaaaaattgagaaacctatataaatccctagttttctttatgtgatctttgtatttgattgtgaaaaaaaaaagcaaaattgtagaaaccactgctttaaaccttgtaatatttttagcacaatgacacctaaagtattttcatgtatttcccaagttttccttttcctagaagtggggtaactctccatggtagaactgtttgcatgggtcttgaaagcattggacatcttaacagtcaagtattttgctgacaaaataatgaattttccttttgaaacaagcgttttgttcttaaaataactctaaagagaacaccttctgcacttttaaagcatttccctctgaaggcatgccgtggagacatgaccatagggagaaactttttgtgctagaaaactgaattccaccactgtgaattttttaacagctttcacaggttctgcagtttgctctcatgaccccaaaagcatatatctccacatgctgtaacatcaaggatctctcctcaagctttgtaagctcggccagaatgagctgagtaccctctgtgtgtcaggcgatgtccaatacactgggaatagggagtcataataaccataattttatctgacttttgtctagcatttgtcatgtggcagacaacatgctaaaacacttatttgcattatcttgcttgattcttataaccactctgggagaaaaataacattattatagcctttttacaggtgaggaaaccgttgcagggaagttaaatcacttgcccaaggtcacaagccctgtgagtgataaagccaccaccatccaagcctgtccaccccctaacctgaactcccaagtgctatgctaaaccacctgcctcttatggatatattatctacaaaaagagctctgccctcaaggcgattataatctaaattagaagagggaagcacaagggaaaaagccattatgtagagcagaatgatgtaattccaaaaaacatgctgttggattgtagaggaaagagtgattaattatgatctacccagggaaggctttttgcatgtggccttaggctaggtgagaacaaaatagggcaccagcaattatctagagaattgggtcactgtgggtgccaaagtggatgatgatttcaagctaaaaagactatgctctgaatagttcagaattggccgcccacactcctggaatctgttgaatttttgccaactcccttgttctctttgtgacttattgccctggcttagatgagcttcctactccaggtgggggaagatgcaggatggtgctgccatagcagggagtgctgacaacgtggaagaagccttccttgagtcaggagctctggattcaatctagactctgctcccacaactggttgactccagggaagccacctccttctctgggttcagttttctctactgtaaaatgtatacactgaagttgatggtctgtatgggccattcaaaatcccgtgtctctgtttttggaacagagaaggaatcagaggagaggactggaagaagctaaaagattcagcatgttcggatttcatgactcttgtggttttgttcctagacaggacctaccaggggagcctcctgcaaatgaggtggtcttccttttctactcatcacattctatgcctgccctctctaacctacatggtatagtaggaagacgccataccatggagtcagagaatcttgggctaaaatcctgaccatgtcccattacatagtgactttgaacaaattatgtaatctttctgtgcttgtatttctacaactgtagaataataggttgcaatatcatagactcttcatgtagagaatctaattctattactataaaatctaattctaataccattggtttggtgttagcaatgaaggtgatagcaactgaaaagtaagaagagcagtgactaaaagctcataggttttgataaatgggcactattactattataatatttattgtgttaaaatacaaattatgtacagcactcctctgaacactgacctacaatagttaccagttgcttgttggacttcttgaaccagacttgaccaggcaaagagaatttgagaacctctatttcactaaaaaggtggtatctacaatatcttgccactgtagcatctgctatgtgtaatgagatgcttgggcctgctggtggtcacctattttctaggtatacgcattggcttttgtggtgtcgccatatatatatatatatatatatataaaatatgtattatatatataatatatatacatgatatagatataattaaatgttatattcaattaaaataaatataattttaaattaaatataaggaacatgagagttagcaggaatcatgggtgaaaaaaatatgtataataacaccacaaatgcatatatataggtttttgcccatgattcctggttaactcccatagcccttattataacattggggcacttgaggcctcaggcaacagtctctctcagtgaccccctctggtccttcttcacctgcccaaggtaggatgctaatttgattatggatcagaagaccctcattccagagagggtcctgccccatagcctagtggaaagaatgctacacagagaggccaaaaaaagtctgagcagatagtccttgctggatttagatcatatgctttttgtccaatcatatttttacatggttgtcaatcatgcctgtgtaaaaaagcctccataaaaacccaagagtacagggtttggagagctttttgattgctgaatacatggatgttcctggagggtggagtgcccagggaaggcatggaagctctgcgccccttcccccttaccttgccatgtgcatctgttcatctgtatcctttgtaatagtatttataataaaccaataaacgtgtttccctgagttatgtgagctgctctagcaaattaatcaaacccaaagacagggttgtgagaaccccaacttgaagccagtagttcagaagttgtggaagttggacttgccactggtgtctggtgcgtggggttgggggcattcttggggactgagccttcaatctgtgagatctgatgcaatctccaagtagataatgtcagaattgaactaaatgacatccagctggcgtctgctacagaattaagtgcttgcttggtggttgggagaaactcctacacatttagtaacagaagtcaccttctatgtggatgattgctgtggtgtaagaccagaggaaaaacatgatttcagagtttttccctcaacagccttgagatactccattttaataagatagagagatgaaagtgtattactggtgggattatgttagaaaacacatttcttgtcccagtagcattcaagatcaagagttaaacttaatacagtctctcctctttactctcccaactgatattcagcttcctgtgtgagtgtatgtttaatgtttttgtctaaattaattgatctttgtcttatgatctctcgtcttaaaaaaactaagttcagctaaatgaacattgctgagaacttatgttctagacactgctgacgttgtgctgaggggaaatgaatatagaggtaaataaaataatttgaactattctctgtctagtgggaaagagagatcgaggtataaataggggaaaaaataaaacacaacgtaagggtcataatttttaagttggattaaaaatatgtgtgtgtttctttattaaacacctcttataggccagactatcgggccagggatataacattatataaaactcagtccaaattgcataggtgtctacaagatgtaataactacaagatggcataagaagaggtattggatgggaatagtgtcgactagaaagtaagctacttgagcgtaggggccttaactatcttgttccttaatgcatttttagcattagaacagtgcttggctcgtatcaggtactcattaaacatttctgtagtaagtgatgaggctatcataaagttttgtttccccacccctaaaccagattgtaggttcagtctgaaaggactccaggaccctctctgctggtaagacatggtgccactttgtactctcccagccaatctgattggcctcttgactttggcaaaactgagctgggggctggcccccagtgccaagcacagaggaagcagggtcacatgccacccatgcccaaagctctttctgacatttccatgggcctggaaccaactctcctcctgggtttcatctcattatatgtgggaagacaaaagaacactgaaccttccagttaattcaacaccccgcccccacttaccccttcctggagaggataacagttctgttgaccattataatgcattttctgtctcccagcagtccacatagtcattaatttctgctgctgacatcaggaaagaggattatgtgtgtgtctgaaactgttcccaaagtgctcattagtcatagataattgaaaaactggtaggggaagatttggtgtaataggagcccccgcctgtgaagagggactgcaaccaccagataattgtagattccagcttttgaccactcagactgaatctgcccatccaaatgggaattcagcagacttgagcctaagagctctcagagtgatagtgtttttacatacccaggtgagggtgtgtacaccgagacagagacagccaaatcaagagaataggtgaactgcccttgggtctctttcctgccttcagactgtggagcagtgtttggaaaaagtgtccagtattctcctttattttgtttttatttcaacgtaagattgttttgatcacaaaagacatacaaggtcatgggatataagaaacacaaacattagagaagagtaccctacactggatcccaacccatgctgtgacaaaattctagggtttttctggaagtttatgtgcttacatttttatatccttttctttaaaaaaaaaaatcacatgatcatactaagaatactattctgcatcttgccattttttctgaatttatcttggagttccaaatctataccttaattcaagttcattcattttaatggcaaggtgggattctgaccagatttaagggggaaaaacatcttttaaaatattatacaagaggctgggcatggtggcttatgcctgtaatcccagcattttgggaggccaaggtgggtggatcacttgaggtcaggagttcgagaccagtctggccaacatggcgaaaccctgtctctcctaaaaatacaaaaattagccagccgtgctggcgtgtgcccgtagtcccagcaacttgagaagccgaggcatgagaatcgcttgaacctgggaggcagaggttgtagtgagctgagattgtgccactgcactccatcctgggcaacagagcgagactctgtctcaaaaaaaaaattacacaagaaatgtagaccaattagaaattagagaaaaaagaaaaaaaggaaagaaaaaagaaatcactcataattcctccacccagagaaaacctattttctgtatttttttcccctaggaatgtatttttacaaatagttcatctactttcattgttgttgttcttacagctgttaaaagaaaacctttaggcaaattaaatttaacagtttaactgtgcaaagaatgattcatgaattgggcaggtccccaaccagaataggttcagagagacttttgctcagccacatggttgaagagaaattacggacagaaaaagggaagtgaggtacagaaaaatggaagtaaagtacagaaacagctggattgggtacagctctgcatcggccttatttgaacagagtttgaacagttggccgcctgtgggtggttgaagtatgtcttctgtgattggctgagactcagcttctagttacaagagtaggttacagtgtgtttacaaatccagttaagttacagtcactgtgtatgaagaaacctttaggctgaagttacaaacggacacctttaagttaaacttaatttaacaaaaggaagtcatatactgcatgttttgcagcctctatttttcacttggtttgactgttttaaatataaaaattattccccaagcttttctttacactgtgtgtttatcttcttttttatttatttatttttttgagacggagtctcattcttgttgcccaggatggagtgcagtggcgcaatctcggcttactgcaacctctgccttcctgggttcaagcgattctcctgcttcagcctcccaagcagctgggattacaggcaactgcaaccatgcttggctaatttttttttttttttttttttttgtatttttagtagagacggggtttcatcatgttggccaggctggtctcaaactcctgactttgtgatctgcctgcctcggcctcccaaagtgctggggattacaggcatgagcaaccacgcccggccacatttatcttcttaaaaacccaacctgagcacttacagtcgtgcccctctgggcaattcctttttgcctggccacgcctgaagccctccgctgcctcttgtcccgtctgttccagttctctgttcctccttgttcccctttttgcgacatactaaatgcctcaaacacaccatgcccctcagggctccctacaggaaactcactttttgctctgctgtcatccctttccccggagcatgccagcactgaaaccaccaatctccaacttgcctttccacacaggcttgaaagtcatcttcaccttgaagactgtattcactctactagccaccctaactggaccctccacagttctctgggaacaccatgtacacatttcacctttctagcattttctacatggccctaagagtcttagtttttcatcatctttgtcccaaaccacaatatgagacctcagcacctagatcttagcacatggtagatggaaatctatgcaggcaatcattagttctattgtttctgaaatgtttgttaaaatgcatgaatgaatgcttgaatgaagcctagaaagaactgcaaatgctcaggcagtgaagtcttgatttctgggaaaagcaatgctgtgaataatttaattttatggtgaaagaaaagccaaacaaggattatattgggaaaagttgtcaggaggcactaatgtttgcctctgacagctctagtgccctcagtgtacctctggctgataaacttagagtgtgattttgaaggggtgatttctcagggattctcacctatttctatcatcctctctcatgccaagctgtttcattttggtctctaaataaacaaagctccttcctgcttggagtccagatagcctattcctgaaggctgtggttccaaatgaaagatgggatatttgtccttgtatatatttattttcatccctaaccactggattgaggagaaggctggttcactgctgtaggttgggttttccagaagcaaaggctgagacagatttggggggataaggtgtttattagggatggttggctgtgaaagaaggaagagagagaaggactgggtagagggaaaagagctgaactgaggtgcattcctgcagcaccttggtgaactcagcagagtctctggagtgagtggtgtctatcagagcccttctgcctctgctttgcaaagtcaccaggtactggctgtcctgggaggtgcatcaccttgggaaggcagctctctgcaactgaggcaggccctggaacatctggcagctgtctgctgactttactccatccttaagggggagtttgagccatggtatctcagtctctaccatgcttcctatatccacgcaaccactgtgacctgttatttcttgttccatggaatcccttctgtctgcctctgtttctacatctccgttaccaatatctcagtgaagatccttatattctctctctttctttgattactgaaatagattcacactattttccctaaccccagtctatcctctgctataatactgccagagagtgcttaaaaaagcacaagtttaatcgctttcctcctggcttaatgctcctttagtggtttacagtgggcttcatgattaagttcaaacacttaagtatggattacaaggccctgcatccactgccccatctgcctccccagcttcctctgtccttcaacacccaccccctaccagttcacaccccagcctatgttccaatttacctagcccttttgatagttcccttaggggccccttctcccttttttctgtccttgctcaagacgcatcctctgctgatgaagctccctgtggtcctatagcctataattagacccagatctcctgtctgcatgcccaggactctctctgcctcgcagtggtctgcagcctcatgttctgagcctagaggacatagaatcaaattaagctcctttaccagctaaggtttcttcctaaattactatagagaaaacttggaagagtgccccaccctgctaatcctgtctagaaccttttttataaaaattacaccttttatgtttgtggagattgggggtgaaggtggaacagaatttccattttgaccttcctatgaaaaccatttttaaaaaatctcaatttagtaggcaagatttctaaacggtgctcctttttctttttcttttttctttttttttttttttaacatacataatgcttgttctaaaaatacttctcttgatcctttcatccattcagaacccatttttaaacaacttttactccaaaaggtaatgtaatgaataagagcagaggtgtggatatcagtcagagtagaacccatggcctgtcttcagctcttaggctgtctctagggtgtttatttttcttctgtaaaccacaattttcccatctgtctgtaaaatgggggtagtatgggtcctattgtacccttcacagagggttaatatgaaaatgaaatgagaaaatgcatgctatgtccttagtgcagtccctagcatgaaagtgctcagcaaactggagtgcagtctctcctgtgttagatactagccatagtgacataattaagatattgtccagaaccgtattatacaaagccaaggacactgctctcttccaggtttctgctactttggcatttgaaacagaataagattttcctgttctctgccccatcctttgagcatcttatacttatcctccagaccatcagtgtccaatagaaatataatatgagccacatatgtaatcttaaattttttagtagccatgctgaagaaagtgatactaatttttaatgtatcttatttaacttagtatattcaaattattattttaacatggaattgatataaaaattattgaggtattttacattcatttttccagatgaaatctttgatatctggtgtgtattttccgcttaacacctctcaattcagacgctagatttttgttggaaatacttgatttagatttcttaaattaatctagaaaaagtagattcgcatacccaagttgttccgaacatacttaaaagtttttcagtaactgaatttaatatcagtttttaagttgaagttaaaactaaataaaactaaataaaatgaagaatttagtccctgagttactctagccatacttcaagtgctcagcccacatgtgactagtggctgccatattggacagcagagttcttctagaagtcactgcagaggtttcagtcttactcttcttagctaaacttgttttcatattcaattgtagatagaagctcttaaaatggataaaaatggtgtcgtcaaagtgctttggttccatttagaggaggttggttaagctgttcactctctgacccctctcccaacctccaccctcacctctacccccagaggtcctggagcacctctgcccagtccttgagctccatggaacaattaacaagtggcatcttagcactcaaaaattgctgattatgcacccagattctatcttggggctcaaaggggtcttaatatatctatgagtcaactcctagcccctccctgcagtgcagaaatactatagaatccttgggggatgagagagggctcgggctctgtttaacacctaggagcagatggatcatttcattctattctgtcttacgtggttctctgggttcttatcttgtcttcctaactaggttgggggcaaggactgcttttcacagccccacagcacccacacaaagcaagacaatcaattcttaactgaaggcctgactgcaagaattcaaggtcacttgaaaaatcagggtcactgcattgcacaactccaaagaacatcattcaaattgtattatatgattgtgcaagtggcagccttgtaaaatttgcaaaggtttagactggaatattttttccagctgagaaaaactttttaactaattatttgttggtacaaagtacacctttttcctcttatcctctgccaggaagcaactgaaagagtaagttttcttgacttaggaatatacgttcattagagagggtgtatggatgtgtgaacatgtgggtttacgtgcgtttaagtaggttagtagatctgctgtgttaggaagcccatttggaatggtttgagcatttaaaccttgtatttaagaggctactgtgtttatattccttttgaaatttcccattttcagaatctttatctggtttgaatgatgctttagagttccttgtttgtaaagctccacaaagcatgacccataggtaccaagcacgtacactaaagtcactggatgagcaaagggactcttgatgactgcatggtttttatctttgcaaatgcagaggagggaggagagagcaaagagtttctcttaaaaaaaaccctctgtttacttttgtgtttttcaaactgatggtgtttgttttttctcatgtctacccaggaaaccaagtgctacctcctggagcttctcttggaaatgggctcacaccagaggcagcaagagaccttggccttctccctgggattgcggtcgcagcttcactcattgatgcccatgcaggaggactaggtaatctcttatttgttgcctacagccaaaaccgtattcaaatggaatattccctagaaccgaagacactccttttctgtttttaaagcaaaggtcaaggactttggtgtttcaggatataataatgaaaagcctttttacagctaggcatttggatagaattacagaacttttcattaatgataaaatttatttataattgtattaatttctttatacatggcaatagaaaaaaatgtatttgaataactttctgcatagttcttttgtttactgaaaattcaaaaaagatatgttaatttcttgccacacttagctctactgtttttttgtaaggtactccaaaacccttataagtctcttagatttattttaataatatatttggcttatgtcctgtatccagttccttggctgcagtcttgattttatcttgtacataactctcaagtctttcattcatgtattcatttgttcattcataaaacacccgttgaacacttaccatgtccaggcatggtgctagaagacagtgaacttaaaacaaaaccaaataaaaccaaagtctcttccccagcttttaatgggaaaacacacagggaaacaaagaattacagtaaagaatgatgacttcctcatccttattgcaggttgtgtgtgttttttgcaggggaagttgttctggttctcagcatctctcatctcaactgtagccatatatttttttcctagcctttcattctaacaatgttttgttttaaactatgatttataattcatgagatcaatttagcaggacatgaccactgaatttgcacaacagaatggaacagaattgaatagaacaaagtggaaaacatcagagtacatttcacaaagtaagggaaggcactgctttgtggagctgtgtttccattctgtgtgtgtatactttcagacacttccatactctgcccatgcatttacacctctgtgacttggcacacatgttctttgtccagaatgattggtcctccacttctccagctggctaactcctcctctaactgcaagacccatatcagatgctttctgctctgcatagccttccatgaaacactcaggtgtatttagaaattctctaaattatgctttttttcagcacactatttgaagaaatgatcatattgcattgtaatttcaaatatatctgcatgtcatttccattagagtgtgaactccttgagaacaggaacattatgttatctgtcctgtatccttcatgccaagccctatgtctggttcctatagctgcttattaagtttattaaatgaatagtcacattaaggcaagaataaggtgaaatggctttaaacagtagagtgaagattaatctgttttcttatgcaacggattattaaatggtgccttgttctacatactacatggatttccagagcaggatcgctctcatcaatctatggacatgtctgtcctgttcatctctctgtcctcaggatctaaaacagtgcctaagaattagtaaacaactcataatatatgtaggttggttgaatgctatgtaacgtagttctgattacaggcaaggttgtttctctccaaatacttttcagtgtgagcaatgtgtgcttttgattggaatgttaagattttggtttttacatacaagcacagagagaacttgaggtctaggcagacatggagtgtttctgtcccctagcaatcctgacattccagatcatgtgtgaggccacaaaagctttctctgtcatgctttttaaattatccctggggtgacagtgtcaatcatccacccctacctgggtgacaatcacttggctgggaccggcatatgctgaaagaaagagaactgctgcttgaagagccgcaggcactacagtttccttgtcagtttcccagacttccctcagggacgtgccaaaacacaccttctcacttctgcccaggactcactatgtcctccaggaggggagactgtcaatgaccctcacctttttcctaaacagagatgttcagtggcagaagttttacccttagaagctttggcttaagccttttgttccccgtaaaatgcaaatgcttgtaagtgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactgtaagtcaaattaaacctccttttcttccttgtctcgggtatgtctttatcagcagcataaaaacagactaatacagtaaattggtaccagtagagtggggcattgctgaaaagatacttgaaaatgtggacacaactttggtactgggtaacaagctcatagagggaagagacttgccttgtctctgatgagactttggactgtggacttctgggttaattctgaaatgagttaagactttggaggactgttgggaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgtatgtacctaatacctgtacccgcattgtatctaggaagtaactgacttgttttttattttacaggctcatgggtggaagggacttgacttgtctcagatgagactttggactgtggacttttggattaattctgaaatgagtaaagactttgggggacttttgggagggcatgattggttttgaaatgtgaggacctgagattgggaggggccaggggcggaatgataatgatttggctgtgtctctattcaaatctcaactaacttatatctcccagaattcccacatgttgtgggagggacttagggggagggaattgaatcataagggccagtctttcccatgctgttctcgtgatagtaagtctcacaagatctgatgggtttatcaggcttttctgcgtttgcttcttcctcattctttcttgctgccaccatgtaagaagtgccttttgccctccaccatgattatgagacctcccagccgtgtggaactgtaagtcaaattaaacatcctattcttcccagtctcaggtttgtctttatcagcagcataaaaatggactaatgcagtaagttagtaactttcccccatatttttgttagtggaaagatagaatagtttttttttgttttaatggaaagatagaataagaatcttggattctttaaggcctgaacttagatgccagcagtggctgggaagggcacaggaaggtgatagtccatgatgacgggttgatacagacttacttaatatatgttgactatgttttatccttattatgccttcttatgccttcttatgcctctttctttacccttcaccttacagccaatccaagagttggatatctcaaaaaaattaggaggcctgggtgcaaatgtttcctttcatttctacctttcctatacccctattaggatgtggaggtgaacagatgcctgaaaatcttgaaaaggttgtccatgggtccaactctatattaactaaatataattgagtgaatgcaacctgtcagtgattggtctaggcactggagattattagcagtgaacaagtcaggcaaagtccattcgttttggaaagaaaattctcattgttctcccctgcctgcatgtttgtagcttaatagtataggtttgggacagctaatccctgagacatattgtgatgctatgacaagggcactcaaaatggaattttaagttctggatttagattgtgtttctgcctacaaatatggtgcttcgcagaacttttgtctcctgttatgcagtgagagagtgagagacaacagaatgcaggattcactactttgtgattctgtataggttgaggtcagtaatagcctcaagaactggctaaatgaaccctgtgttaagagatttctgaatgtcaagtacagacacagctttggatttggaattgccacccaggaagaggccatccaggcctctcaccaacaaaccctgacaactgtagtcacttcaaatgctgacctggcatggcctgcttgaaaccccacattctgactagtatgaggggtcagcactctgctttagagaaatacccctggactttcattcccaagggaggcctgggatgggaggataaagatcaaagaagcaagcaaaactcaacccatgcttttcccagttctggaaaaagaggaggaagggctttgtgggaataaaaatcaatgataaaagaacattttgttcttaaggtgctggttagtaagttctccagcagacagtcagaagataggagtagctttgtttgcactttgtgggggtggttctggccagggctcctgctgctgatatttttctagcttataaaaataacattaacttttttccaggtcttttcttggctccagcaccccaactgccctgaaaggcaataacaacctgatttctgtctcaggcccttctcttctcagttgctctttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactatgcccggctaattttttgtatttttagtagagacggggtttcaccgttttagccgggatggtctcgatctcctgacctcgtgatccgcccgcctcggcctcccaatcagttgctcttatctggcagacagactcctgattatccatcaaatcttgaatcctgttctcctctgggaagccctccctgacttcccaagttgacttaagcactctctttttcccccactgtgtcttgcgcttgcaggtttgtgtgtgccacattgcctcatctactaatttataaactctttgggcaacctgttgtttcatactcccactgcagcagcctgcagagtgctttacatatggaggacccttaacacatgcgtatttagtgaatgagtgaatgaatgaatggcattccctccatgaggaacggatattacaactgagagagagagtaacctctcattcaaaggcaattgtccctatacaatagttatacttggcttatttctgcaggagcaaaagtttgggttcttctagatgtttggaaatctgtctcctttttgccctcatcacattaccaagtttcggccaagagcaagctttgttccttggtttagcacaactatttgattaccaatattggattatttggcagatgttgaactggcttaaattgctcatctgggccagatattgaattggtttaaactgctcatttcaattgcagagccaggccaaaatgaggattttgaatttcttttctttttaaatggaagaatttattgagccagtcttgcaaaaagggcctttggttcatgccctagaacaacacatagtttgttccagtaaacaataaaacatgccaataacatttctcaccattatcagtgttctagaagacaggataaaggctgcgatctaaagcctgcgactttagataatgtgatttggggggaacatttatttataagtagtatatatactaaatgtagcatgatggataaagaaatatacttattggcaatagtccattgcgtttgtaaacttttgatttatgaagcatgatatggtttggatctgtgtcctcacccaaatctcatgcaaattgtaatccccagtgttggaggggtccctagtgggaggggattgtatcatggtggtggatttctcatgaatggtttcgcatcatccccttggtgctgttctcatgatagtgcatgagttcccttcagatctggttgtttaatagtgtgttgcaccaccccactctctctcttgcttctgctccggccatgtgaagtgcctgcttccccatcaccttttgccatgatcgtaagtttcctgaggcctccccagaagccgagcagacaccatcatgcttcctacacagcctgcagaaccttgagccaattaaaactctgtcttctataaactgttcagtttcaggtattcctttatagcaatgcgagaatggactaatacaaaacacatctatgttcattatagaatttgctccttatagcaactttgtagtgaagttaggacaggtatgtgttccctcattttgcacagcaaacagctgaggctcagtgtattataaactcaagaatagatatttatcttacacttagttcttaaggcaactttatacatactattattctatttgtcagatgagacagttgaggctcacaagactacctaacattctgagctacacagttaaatgagagatgcgtgacttaagcccatgctttgtgcacacttatcactgtgttataaagaatggcctacctatttaaacatgatccactctgctctttaatttgaccctaaaaatgtgagcaagtaacaaattttgaaaaaggaaagtctttaatatttattgacgacccactttactagttcatggggttagacagtgactatgagagagaagtggacttctgggaatttgtattctagtaaagaaaatagacaagtaaataaacagttacggttacttgtgccgtgtatggaaggctttggaaaaacataaaatgggcctaaaattgagacttaaacaattattaaaggattcctagagggagtgatgtccagtaatctaattacgacactgctttccctgttattgcttcctggtaaagtggaatttatatattttttgcgacttttaaacttcaactaggcttcatttctaataataaaataataacattgttaattagaacaaatacaaccaccactctgactggtactactatgatgaccatttcttacatgtgtcctatgtgccaagtactctacctgatactgctcagactttatatcttgctcctcacgataagcctacaaggtagaggttgtttccccattctgcatgagggaattgaaggcagaaagaataatgtttccacaatcacataactaatctcatagcaagatttgaaattgagtctgcctccaaggttcatatatcttttctctaggccagtggttctcaaccaggggtgatttgacccctcaggggacatttggcaatgtctggggacagttttgtttattgcttctggggaaagggaaatggcactggcctgtggtgggtagaggccagggatgctgccaaacaccttacaatgcccaggccaaccccctgcaacaaagaattatccagcttcaaatgtcaaatgtcagtagcactgaaggtgagaaaccctattctctcctggaacacctccagtgatattatttctcttcatcaattcagcttatttctatagaagccaaaaagcagcccacaataagggttttgctgatacattagtactttgttgaaatgtgttttgtgaaattgactcttcagtaaaagtagttgtgagattaagaaaataatagaagtgaagcctgaggagtagggaggacaggatggtttctagctcatctatttcagagtcaagccacacgggacaacttggccgtctttcagcacatcatgcacattccacctcctttcctttgttactcatccatcagcactcagtctaaatgttactttgtggaaacatctccaaatttaatccattcttagaaaagcaccaatcactctctatgctgtatctgtgaaatactttacaactatttcagttttttcaccaaatcatgttcacgtttgtatgcccatcatccagcatgaaatccacatagctggtcttcactaaatcaatgtaattatttaattactattattagtaattaagataataaatataagagggttttgaaaaatccagaataagaattggtaaatataggtgagggagactttaagaaaatatagattcccatgccctaccctgctgaggatgcctggaatcttgttctaagtgtggaaaatgtcacctggtacccagaggagacagcctggggggatgagttggcactgaggacactggggtcagaagcagtattgatgtgtttctgccaagtaggcagatcagaccagagcagaaccgtgctgcgcaggagccaggccaggcgctggccaaaagctgggggcaggagggagcttgtccaaaatgagagagaatatggatccaaagaggcagacggtctgcaagaaattgggggtggggggggattagaaatgcagataaagtcatgccgtggaatctggaaggagaaaaccgtgccagtccctgagcagatagagcaaggacaactctgggagttcctggatgtgaatcacagagggcagaggaagaacgtattcatgggattgcaagtttattgttttaagttgaggttcggtttaatgcgacccactactgcctgagacctcggcagttcatgagccgtggcaacagctcatgtgatggagggaggggcagagagcatacgtggggggaaggataactgagtttcctgttcccaggctccaaggctttcttggagtgctgtgattctctggactgcagaaggctggccttagctgagagaccagactttgactctgtggaagaaaaccgagagaatccagggcctggtgctattgccagctccccatgtgtccccagtttttaaatcttgtgccacacgtcagtgtatatggctgtgaacctgccatgaaaccataatattttgagtttaatacatacactcctgtttggataatgagtaatcataggctttagaactaaaaggctgctcaaagattctgtataccaaattcttcaatttgcagatgagaaaactgaggcccagacaatggtgaatcatccaaagttaccccagcatattactttcagagtcaaatttagaatctgagtgacctagttcatcagccagggtccccgccccattgtactacactgtctccagattaggaaaagggaatgactcctgatttgttattccattttataccttatatcccatttaatggccacaggcagcttcactggtggttattaaataggtaatttagttttcctgagccacacttgagtaaatctctttgttttgttgtcacaatctacaaaaagctccaaagaatctcctccagagctggaaataataaaaacacctgctattcgagttccttccaaagagctcaaagcagttatttttatttcacctaccaatcgttgaatacctatgctgtgccaagtgttttgctaggtacttgactattcactattgtgagctcacaaccacactgtgagctacaattatttttggactttaacatacaaggatgaaggtttaagaacctgccaaaggttacattttaataaattataaagttgggttcctggacccaccgattgcagagcctatgagctctcccgtgttgacctggctagtgaatctatttgtgtgtaggtatgtttgtgcctttacttacgttagcccatacttacaccaatgcatatttgtatctatagtggaagatagagcttctgcttaatatccttctggacgtttgtagatctattttatggatgagaaagttgaggcccagggtggagaagtgactctaataaagtgtatttaaagcagcacaggagtctgggttccatcaatcatggggaataaggccaggcttattagatcagggtaggaatgggatgcgtagctattggggttgtgtggtggagagataaacaatattaatgttgacgttaattttgtttactaaatttgttaattaatgcttacaatctcaatctcaaagattaatcttaatctttttgtagtgacttgctgtttttaaactacccttggaatagggaaggtatttttacctcccacgaatggttgggaaaactgaccttcgaggaggtgaagggatttgcctaaggttacaggaccaggaagactggatccaagactcaaacccttatttgtgtgcctctgtcttcacatcagctttagtgcaacccttgcatcaaacaatggaaaagtagtacctagtaaatggagcaaggtgtcttattctgtgcccagagcctctcattttaaacaagctctgatcatctcatctactacagaactgtatctggtattctggggccatttttaaacagaaggtttcacttattctctcctgtattagtatatggccgagaaaattagctgagctgttattttcctttgctgaactggggaacaaaaacaaaaaaacacacagtaatccagccactggttctgacactgccaagcacctgttaggaggacttcctactccaagttcaaaaggtacggactgctagaaaagtgtgtgtttgggggcccagagtctaagattgcacttgcgtcactggctgcaagagtaggatcaggtccactgtttttcatggcacaaaaactcaacagatagtgcttcacatccatatactgtttctaagcactaatgtttactttgggtcttgcacatcagcagctgatggtgggaaaatacacatctctagttattgccccaaggcggcagcctcacatctaaactgctggcttcttccttattatctctccacaggcctggttcatttccttgttttcagttttctcttagctgtgcattcatatcagtcattgtaaagagcaaagagaaataattttaaaaattttccatatgggcatcttgagcattgcctcagtacactctgtagctagtatagatatctggggaaactaagaaggaaaatttctttgaatatagaaaaatcatactagtctccagttatatcattcaacagcagtccccccagcccacctttccatacctctaatctgtatctgtgctttgtactatgactctgatgtaagagtttggctctctgaagatggtaaaaatttaaatgcttgaggtaaacacagtaagatagttaaaaacacactactggttccatcagctgtctctttgcccttggaagtcatctgacactgatggcagcagtgacccatctggagcagccactgcgaagatgctggctgcagtagaggaatgcactctgcagagctggctggggccagaacaggtgggagccctgtcccctaccaagttggcagggtgggagccccatgctcccaggcacatctgcagccgcccagctgcggctctggacctgggcatccctacgctctcaggggcccaggaagccccccttcctttgcagacttggaaatgcttgctcctactccctggcctcttcccattgctggtgcctgctctggagtggggcagagttgtggctgagcccagtgctgtcacaatccagccaggtgtacatgcacttgaggtggtgctgacacgctagcctcctgccaccttggccctctctggaccttgggcgccaacgagcatggcaggagctgagggcagctcggctcaggcctgcaggtgcctcagtaggaacagactgggtggcgggttgatggcaggaggaagcagacaggctcctgggcagaaaggagcgggtccctggcgaaaccccaccttcaagccagggacagtccgaagcctggtggctggactgccagttccaagtggagtctgtggcccagagtgagaacttgtgttgctttttctgggtccacccatggctacccatggaccaatcagtactcatttcctcccttctgagcccgtaaaaatccctggacccagtcagacacggacagactcaggactaccagctgcaggaaggagctacccactttgggtttctccacccattgggatgacctgcctgcagaaaggagctacccacttcgggtctcctctccactgagagctggacactcatctagacgacctgcctgcagaaaagagctacccactttgggtcttctgagagctattctgtcactcaatgaagcttctctccaccttgctcaccctgcagttgtctgtgtatctcattcttccaggttgtaggataagaactcaggacccactgaatggcaggactgaaagagctgtaatacaaacaaggctggaaacacatccctccggctcactcgctactttgtgggcaatgaggagagaagagctgtggcccttcatggagcccagacctaggggctccccaagccaggggtgtgacactgtctttaaggctttgaggttcatggcatctccaagcctccaggtgcccgtgttcccctcatccagatgcgggtgcccatagcagaagccccatgcagcacatcagatccagctgcagccttgcgtggagctggcacctgtgccagcacctgtagctgcctcccctgccacagcagcttgcttgtctggttgtgtgcagtggccggactctgcacttgctcacccacacacccctcactgctccacgcctgggtcacccttggtaggtgtgggatccaggatggtggcgtgagctgagcccagcctgctgggccaagtgggtggaatgagcccagcaggcacgagcaatactcaggcagaagatgccaccagccacagaggtttccggctggcaaagtgacaccccgaggatcccatgacagtacttcatgcctcagttcccccatctgagaaatgggaataatagtacctcttgcatagatttgagtaataaatgagcttttatttgtaaagcacttagaataatgtctggccatactctgtgtgtgtttagctatgattaatgtgattgcagtaaagttacattatgaatagtagcagtgagcaagagaaaatcaaagatttattacttgatttacaggtagatgacgtcttccttctgtgtgtcaggcattgttataggtatgttagatacagtggtaaacaaagccaagctccttctcttatagagcttctatcctactggggacgttcataaactcccatttaaacatatgtatttataggtatatgtaagtatacatatatgtattgtatgtgtgcataactgtgtgtctctgtatatgtgcatatttataagtgtcttcatacacatgtgtttatgcatggatctggtatttatacatgtatgtgtattacatgtgtatatctgtatgtagttgtgcatgcatatgcatccatgcctgtgtctgaatgcgtgtgtgtatgtgtatatactgtgcatgcacatgtttgcatgcccctatttgtatgtctgtttatgtgtacatttatgtgtgtgtctgatttgtgatgtgtttatgtgtatgtgtgtatattctaatgttcatgagtgtatatgcatgtgtccgtatatatgtatgtgtatatgtgagtggatatgcatgcatgtgtttgcatagggtactgctgagtgttatgaagaatagtcctgattaaagtgatggaaagttccaggaggtgctactggtatacagaggtcaggaaagttcagtctagaatggggacatttgaggaaacataccttaatgaagagaggaaatatttcattgtgtaaaaagcaaggcagagattttttcaatcagcaaatatatgttgagcacatactttgcctcaagcatgtgctgggcactgggaataccaggatgaagatgacccagtcccttctctagatgactcagcagctggtggaaatgggagatctgtattcagaaaaatcctaatacaacttgcatactgcttttccaggcggtgtaaaaatgttacaagagtatagggaatggatcagccagctcttccaggacaagttaggaggtgaaaactcctagaaagtgaaaacttggataagccttttaagaagcagtagtagaatgtgcagaggctcagggacgttaaaatgcccttcataatcaaggaacattttggtgtggccacctcgccattcaaatgtgcgagaggggcagcgagaggcagccgggaagacggagcctgtgtagcacactctgactggaatcagactgcctgggttcaaacccctgttttgccacttgttagtaaagagcttacctgctctgtgcctcagatttcccttctgcaaatggggatgggaatagtgcctcacagggttattttagagatgccttctcctgacacattgtaagcactcaacaagtgttagctactcccagttggaagctagaatgtaaaaggccttaaattcccagccaaagagattgaatgctaaaattaatttcaagcaaacctatctgttcaaatagctttctcagcactgattttgatgtgaaaaatatctggaatattcttcgttatcaagcatgtgccttggtagtgtaattacagtttttaatactaatggatgatcttccattaaagtagtaaaaagataccatctcattttaagcttagagcaaaagcttacttaagtgaaattaagcagatatttattttgtcaggctctggggaggattccgaaattatttgctccctactagtgcctagcactttatctttgcaaccgcacttaccctgtagagtcatagttgcacaggaaactgtattcctgcatctctaccttcagtgtttcacgatcactgtttctcatctgccaggcctgagggtgggcagtgctgatttcactgtctcatacccactcttctttctgccagtgtcttttgtgagagcaattttatctctgcccctttctcttcaccccattgtctcttctccagtcttcaaacccaaacaaaaaacatacaaagtttgctcatattcactgcagtctgagctgctgaatgttcttccagagccccttaggatttctgcacccatacttgtaaatgtttgcatcttcattttgttggtggtgatgacaaattaccccacataacttgcctctgttcctgttttagttagaaattactgtttactggagacagaatggaaaatgtatgaaggggcaacatgagaaaataggttattttgattacttccaatcatccatcgttaatcgaattcataatatagataaccaaataaaaagattatttcaatttaaacttagaatgacttataggtttttttaatctgatttccattcttattacttcttgcagcagttttcaaacttgagtctgcataggcattcatggagctagttaaaatgcggatggctgggtccccaccaccacaactcattctgatcagtggctttaactggggcctaaatatctgcactgtatccagcccacacatgagcctgatgaacttcaccagtggtaccttaaaagatagcaagaggggcagactaattagactcaacgttgtttaccatcaaaaactgtctgtacataatccagaaagagcaaagttgaatccaggctaattgaaagactgcattttaaattttttgtttcaaaagtagagcaataaagagtttttccaatgtgttatacttcccatgagctggatactacctgtttacctagatgccacttaatgtggacagcaacttttatggctgtgcacattctcaccacccccatttaaagagaggaaggagactcgcttagactcaggcagctagtgtggttgaacagagagaaccttggtctgtctggccccagcttgctctcttttaccattatatagcttcacccaagccagcgttaacagctgtagatgattttcttctaatgttctaaaacctgaagacatggggcatcttttaaccaaatgctcagctctagggaaagctaagcctcttctattttgttgaaagataaagtgttaggctgtcgatctgtattgttacaggtccctgggctggatttagcctcaggagttaaaagtatatcagccttgtgactcaccaccatgaaaccctcagatgggagtctcctaccagtatcaataatatgaatgaaaactttatatgccttctggattgaggcctctcacagctcaaagttgtaaagaaaaacccacgcaattggattttgtgaaatatattaaatatgcccagtaatgtggctcttcaaaggaatttatatactgtctgctttactgtggtgtatcattatagctcagccaaatgcgtggcctaataatttgtttcccttatgcatatccatcattaaatgtaacatgcagacaataactatttaaacacctaaatagatgattatatagctgtctgtcccacttagactgtgaactttttatgaacaatggaatctagtcatcttcatctctgtgtctcttagctcagtaaatgaatgaatatatgcatgaatgaatacatgcgtgaatgaatgggtttgcttaacatgctaagcactagactagttactgtggcaaatacagtgatacaaagaaatagaggcagatggattgagttctacaggaattttaaaaagggaagaatcactttcagttgaaacagtaaggcaaagaaaagacaaaaatactaatatttattgagggaccttcctgatagaaatatgctagagagtctacatgtataatcttcacattgactccagcagcttgctcaaggtcacacagctggcagtgagaaccccctgaggttagctaccatggtccttctgggaagtgggaagggatagcctttgaatgaatctgggagaataggtgtattctccactggaagcaatgaaacgtagagtattctggatggagagaataacataaatggaggcactgagatgaggtcgtggaatggtaagcatttcagtttggctgaaatctatgatatctctaagggattcctggaagaagaggatataatgatcaaataggtggagatagattgggagtctgtcccatctgagtaccgttttggagtttgtgcttcctctttctccctggaggcattggcaaatcattgaaggtgatctcaagccagagattcattttaagcatggctttatatacttttatacacaatagttgggggaaaaggcaaagaggtttcctgaaataggttttggcagtggggcttgaaaagaagatagggagtttgacaactttttaaaacaaatccatgcattaggcacaagttatttaaaatttttgatgttctttatattcttctagctctttctatttacatagctattactaaattaaatgtataaaagtatttttcctttttaatttgaaatagatttcatctcatatttggcagaagataataataacttgttaacttcaaggcagtcagggtaattcatccagtctcaaactgggcattcatttaaatctattgtcttagatggagatatctagtatactcactcatttaaagtagagccgtaaatcctgaagttaaataagcaaaacaaaaggcctcccaaagctgagaaaacacttgccatagagtgcacatactgtaggaaagtacaaggattattctccggctgtcacccagcactgctaacttagaattatagataaaatatgctgtaattttaataattaatagctgactatgcaaaaatattattttctcctagcttcaaccaacaggtaacatatctgcctttcatgtcaggtactgtgctaggtactaaagatataaatatgaacaaattatagtctctgtcctcaaagagctcccattctgattggacaaacaggcaagtaagccatccgagtatgatgtggaaagtgtctgataaaagcatgtctgggctattacaggagtctaacctcactttacctgagcaagttagtaaaattccctccccttcccccaaaaatgattggtttgacacttaaagatgaattggagggagaaataggaatttatcagatggacaagacggctaggcaggaaggagggtgagaaggagagggaagcagagggaggtagtatgcaccaagatccagaagcatgagggtacccctttggctgcagaataccgagtatactatagtgtagagtatgctgaaatagaagtgtgagagatatatgtggggacaaagtttttgagggccttgaacatcatttaaaagagattggaatttttatccttaaggtactagcttgtaaacagaaactttagaggcagtgaggttaatggaccagaagacgggactgttgtaagagaccttgaaggccagaactgacgcagttccaaggcagtatcaatggaacaagaggggacattaaaaaattaaaaataggctgatgaacagtgatggggtcctttaatgcatgggcttaaagtgctacatatatagctctctgaagcaagagtgcactggacaatgatggcatggcactatttaacagaagtaagcagagtctatgtgtcaggaggattgagtgtaagtctcaaatctgcccttaccagttatgtaacttctacaagtcacctctttaaacctcacttttttatataggtgtgaagatcaagattcatgctttttcttctaatatatccacttttatatgccaaaattttcctactattgaagtggtattgttggaataaatgtgatcacaaatagaatgtatttaattcattaatttattcacttgccatttattgaatttttttttctggcaacaatgggctgtcctcttggtcccccaaaataaaaagctggtgaaaattaaatgtatccacatattcaactcacaaggcaccagagagctactaaaggacttgaggggccaagatcaaaagagaagcctacagagctgggttcaacatttccacccttttatacgctgagcatttactgacttgctgagatttggactcaacatttccaccattttataatacactatgagcatttgctgagttgaaacctgcaactcagaggccaagaagctaaacaccagtttgggcagtctgcaggctggaagtatatatatttgagtttggacatcattgaagagggagaatactagtaaatcctctaggtgttatttgggaccccgaaagtcagtgtaaactaaaaatagacaaactttacaaaggccaaagcctgggtttgaattaaattaacatctgattaaattcagatcatctatccctacttgagctaactgcaagaagcaaggttatatcctttctagaggtaggtaacataatcagaagctcaagttataactaaaaggtttcatatgtaatgtctgcattgagtagaaaataagcatgtaaaatatgaataatttcaaaaatcaagagtaaaaacaaagccacagaaaagtccatatgctggtggtatttgacatgaactctaacatatctgtgattaatatggtcaacaaattataggagaagatggagaattcagcagagatctgggaagtagaaaaagaagtggggattctagaattgaaactaataactgagattaagaattgactaaatggagtaaagtcaacagcatacaatataattgaaaagagaattagagaactgaaacatagatctgaaaaatctatttatactacagccagtatacaaaaggatggaaaatacatgaaatacacaaacaagtatgagatatatggagcatggtaaagaggtctaacagaggtgtagttggagtccaagaatgagagaagagagataataaatcatacatagaagctatatttgaagagatattggccaaaagtttttcaaaacttataaaagaactcaagtgagttattttaacttttgaataatcaattaatgcaattccatattaaaaggatgcaagagaaaaattaacagttgtttacaaatgcttttgatacaacttagcacatattcatgatttttttaaaaatcatggcaaactacgagtagaaaggaacttattttgattaaggatatcaacaaagaaaaaaacataatgcaaatatcatacttaatggtgaaatattacaatgttccaattcttaccacgtttattccacagggcctatctagtgcaacaagtcaagaaaaataaatggaaaatataagaattagaaagaaagaaagctaacatcatagatgatacaattatacacatatagaatgtcaaaagaatctatagataaaatattaaaattaataagtaatttagcaaggttgctattgcagaaagtcaatacaaaactctattttatttctctaatccagaggcaaccatttagaaaataaaaattttagggaggagccaagatggccgaataggaacagctcccgtctacagctcccagcttgagcgacacagcagacggtgatttctgcatttccgtctgaggtacggggttcatctcactagggagtgccagtcagtgggcgcaggacagtgggtgccgcgcaccatgcacgagctgaagcagggcaaggcattgcctcactcgggaagtgcaaggggtcagggagttccctttcctagtcaaagaaaggggtgacagcacctggaaaatcgggtgactcccacccgaatattgcgcttttccgacgggcttaaaaaacagcacaccagattatatcccgcacctggctcggagggtcctacgcccacggagtctcactgattgctagcacagcagtctgagatcaaactgcaaggctgcagcgaggctgggggaggggcgcccgccattgcccaggcttgcttaggtaagcaaagcagccgggaagctcgaactgggtggagcccaccacagctcaaggaggcctgcctgcctctgtaggctccacctctgggggcagggaacagacaaaaagacagcagtaacctctgcagacttaaatgtccctgtctgacagctttgaagagagcagtggttctcccagcacgcagctggagacctgagaacgggcagactgcctccttaagtgggtccctgacccctgaaccccgagcagcctaactgagaggcaccccccagcaggggcagactgacacctcacacagacctgcagctgagggtcctgtctgttagaaggaaaactaacaaacagaaaggacatccacaccaaaatcccatctgtacatcaccatcatcaaagaccaaaagtagataaaaccacaaagatggggaaaaaacagagcagaaaaactggaaactctgaaacgcagagcgcctctcctcctccaaaggaacggagttcctcaccagcaacggaacaaagctggacggagaatgactttgaagagctgagagaagaaggcttcagacgatcaaattactccgagctacgggaggacattcaaaccaaaggcaaagaagttgaaaactttgaaaaacatttagaagaatgtataattagaataaccaatacagagaagtgcttaaaggagctgatggagctgaaaaccaaggctcgagaactacgtgaagaatgcagaagcctcaggagccgatgcgatcacctagaagaaagggtatcagcgatggaagatgagatgaatgaaatgaagtgagaagggaagattagagaaaaaagaataaaaagaaacgaacaaagcctccaagaaatatgggactatgtgaaaagaccaaatctacgtctgattggtgtacctgaaagtgacggggagaatggaaccaagttgaaaaacactctgcaggatattatccaggagaactcccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtagggttatcctcaaagggaagcccatcagactaacagcggatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcttgaaggaagtgctaaacatggaaaggaaaaaccagtaccagccactgcaaaatcatgccaaaatgtaaagaccatcgagactaggaagaaactgcatcaactaacgagcaaaatcaccagctaacatcataatgacaggaacaaattcacacataacaatattaactttaaatgtaaatggactaaatgctccaattaaaagacacagactggcaaattggataaagagtcaagacccatcagtgtgctgtattcaggaaacccatctcacctgcagagacacacatagactcaaaataaaaggatggaggaagatctacctagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatgtgcacccaatacaggagcacccagattcataaagcaagtcctgagtgacctacaaagagacttagactcccacacattaataatgggagactttaacacctcactgtcaacattagacagatcaacgagagagaaagtcaacaaggatacccaggaattgaactcagctctgcaccaaggagacctaatagacatctacagaactctccaccccaaatcaacagaatatacatttttttcagcaccacaccacacctattccaaaattgaccacatagttggaagcaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatcttctttgaaaccaacgagaacaaagacacaacataccagaatctctgggatgcattcaaagcagtgtgtagagggaaatttatagcactaaatgcccacaagagaaagcaggaaagatccaaaattgacaccgtaacatcacaattaaaagaactagaaaagcaagagcaaacacattcaaaagctagcagaaggcaagaaataactaaaatcacagcagaactgaaggaaatcaagacacaaaaaacccttcaaaaaattaatgaatccaggagctggttttttgaaaggatcaacaaaattgatagacctctagcaagagtaataaggaaaaaaataagaatcaaatagatgcaataaaaaatgataaaggggatatcaccaccgatcccacagaaatacaaactaccatcagagaatactacaaacacctctctgcaaataaactagaaaatctagaagaaatggataaattcctcgacacatacactttcccaagactaaaccaggaagaagttgaatctctgaatagaccaataacaggctctgaaattgtgtcaataatcaatagcttaccaaccaaaaaaagtccaggaccagatggattcacagccgaattctaccagaggtacaaggagtaagtggtaccattccttctgaaactattccaatcaatagaaaaagaaggtatcctccctaactcattttatgaggccagcatcatcctgataccaaagccaggcagagacacaaccaaaaaagagaattttagaccaatatccttgatgaacactgatgcaaaaatcctcggtaaaatactggcaaaccgaatccagcagcacatcaaaaagcttatccagcagcacatcaaaaagcttatccaccatgatcaagtgggcttcatccctgggatgcaaggctggttcaatataggtaaatcaaaaaatataatccagcatatacagaaccaaagacaaaaaccacatgattatctcaatagatgcaggcctttgacaaaattcaacaacccttcatgctaaaaactctcaataaattagatattgatgggacatatttcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggtaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagatccaaatcatgagtgaactcccattcacaattgcttcaaagagaataaaatagctaggaatccaacttacaagggatgtgaaggacctcttcaaggagaactacaaaccactgctcaaggaaataaaagaggacacaaacaaatggaagaacattccatgctcgtggataggaagaatcaatatcatgaaaatggccatactgcccaaggtaatttacagattcaatgccatccccatcaagctaccaatgactttcttcacagaattggaaaaaactactttaaacttcatatggaaccaaaaagagcccgcatcaccaagtcaatcctaaaccaaaagaacaaagctggaggcatcacgctacctgacttcaagctatactacaagggtacagtaaccaaaacagcatggtactggtaccaaaacagaaatatagatcaatggaacagaacagagccctcagaaataacgccgcatatctacaactatctgatctttgacaaacctgagaaaaacaagcaatggggaaaggattccctatttaataaatggtgctgggaaaactggctagccatatggagaaagctgaaactagattccttccttacaccttatacaaaaatcaattcaagatggattaaagacttaaacgttagacctaaaaccataaaaatcctagaggaaaacctaggcattaccattcagaacataggcatgggcaaggacttcatgtctaaaacaccaaaagcaatggcaacaaaagccaaaattgacaaatgggatctcattaaactaaagagcttctgcacagcaaaagaaactaccatcagactgaacaggcaacctacaaaatgggagaaaattttcacaacctgctcatctgacaaagggctaatatccagaatctacaatgaactcaaacaaatttacgagaaaaaaacaaccccatgaaaaagtgggcgagggacataaacagacacttctcaaaagaagacatttatgcagccaaaacacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttgaaccattgtggaagtcagcgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgttagggacatggatgaaattggaaatcatcattctcagtaaactatagcaagaacaaaaaaccaaataccgcatattctcactcataggtgggaattgaacaatgagaacacatggacacaggaaggggaacatcacactttggggactgttgtggggtggggggaggggggagggatagcattgggagatatacctaatgctagatgaggagttagtacgtgcagcgcaccaacatggcacgtatatgcatatgtaactaacctgcacattgtgcacatgtaccctaaaacttaaagtataataataataaaataaataaaaatgtttaaatagcatgatttacaataaaataaaaatattaagtacctaggaaggaagatgtgtaagacatctatgcagaaaggtataaaacattgagagtaactaaagaagtcataaataaatcgagggatatatgatgttcattgattggaaaacagtattataaatgtgacagtttcttcccggttgttctatagattcagtgtacttcagttcagcattctagcagatttgtgtgtaagaggatggaaattggtagacatcctaaaacttagatggaaaggatcaataataagacagtcttgaaaaagaacaaagttgggaaaactccataatgccagatagcagaacatattacgaagtaattaagaatggtattgagggaaggacagacaacccagaggaaaacagattaaggagcccagaaacaaactcacacatgtatggacagttaatttgtggcaaagatgccgttgccagagctgtaaggaagcaatgtatttttcagtgaaatagtaccctgccgattggttatcactatggcagaaattgaattttggcccttctccttatactatgcatacaaatacattccaaacagattaaaaacttaagtatgaaatttaaaaaaataaagttcctaaaagacaaggtcttcatgactttgagatagacaattttcctaaataggacattaatgtaagtacaaccataaagaaaaggattggtaaataagactatgttaaaataagaaacttcttttcatcaaaagcttccattaaaagagtgaaaatgcaagccacaaagtggaaggaaatagttgcaatgcatataacaaaagatgtgtatccagagtatgtaaagaatgtctacacattaatgagaaaagaacaattattttgacagaacaatggttaaatgtgtataaatgtgtgcatatatacatttgagcagctttgcagaaaagaggatatacaaatggacaataagatacgaaaaattgtccagccttgttagtcattaggaaagtccaaattaaaaccatactatgatatcactacacaccctgcaggttggctaaaatcaaacggtttgataatgccaagtattgatggggatatcaaacacctgaaatgctcaagcattgatgtggaaatatgaccacactttgggaaagagtttggcagtatcatgataggctatgattcagcagtcctattcttagacatatatccaacagaaatgtgtaccagaaaaaatacgtatatagtaatacatgtaaaaccattatttgcaataggcaaaaactgcaaacccccagttcccatcaataatagaattcatcaatgtttggtatattcgtggagtaaaggattttatggcaacaaaaatgtacaaaatattgctacatgcagcagtgtggttgaatctcacaaacatgggtgactgaagctggcacaaagaaaatacaccgaatggtttaaaaattaagcaaatcctgtggtgtagacatctggacagtggttatctctggcaaggcatggtatttggaaaaggacatgaggtttatttcttgatctggataggtgtgtttactttgtaagactccactaaattctatacttaaaatctgtagctttttaatgtaggttatacttcattgataaggtttattaaaaatatcaaaggctctgggccgccctgtgctaggcactgggaatgcagacatgagtatgaaataacctggctctgaagaacggagaggaggaggtgagtggtaattaataaacaattagagaaggagtttgttagaagtgaagtcagggtgtgtcactttatatgtcagcacacaaaggagcaactcccaactcaacacacttcctgcctgtattaggtgcttcataaatgttaaattctactcccaccttgctatactcataatcatgagtaatcaagtaagggaaaaattatgttatgaatcctcttttttagtgcacaatccatgttagtgatagtggtggcaagtaggcttttttatttgtctgtttgtttgtttgttttttgatgtctttaacagtgagccttcctcaaacaatgtattagatagaattgcaacttcctcagctgaaattatttcatcagtgattactttctccatggaatgttaatacattgagtttctcttgtatatataaccagggattctgagcctctttcatctctgccttgggccacacagccccatagaaagatgatggaagggagaagaagggaagaacacctgccagcctgccagaatttcggctatagattggcaagcagacagctgaatggagggaggatatggacaatgaaaaggaccatctaacttgagggcacagtgcccaccgacagcacagcaggtgctgccaggcctgtacagagctggaaatcctggcaagatggtagctgctccatcttgtctggcctagttactgcctctggcccatgctgaagggagtctggggagttaccattccaaagaactcacaagaaaacagaactgacttggatatattccaggtttgcctagtggtacttcaaaatggtagattgaatgttattttaaaagtcattttaaaattatttcctttgaaatacagaatttaataggagaaaaatcagaaggagaatgaaaaataatatggatatgcagaatatatccgaaagaaatgtgtacttcaatgtaccaaaaatatgtacagggatacagataacaccatttcaacagcttaatggttagaaagaagtatgatttctggagccagactacctaagtttatattccatgctgtcacctactgtctttgtgatcatgtgtcagttactgaacgtgctgagtctaaatatttcatctccaaaatgggcatcatcatagcagttgtaagaattaaataagttaatttacctaaaacactcaaaacagcacctgtcctgcgtaaatactacacaactactagctgctgctgatgataacagctaagccatttttgtggctgagagtcagcagccacagccagggtggaggagatccttgtaatcataaggtcagaggaaagagggcctcagtaaagaaggcttcttaggcccatacagcgggaattacttcttgccaaaaggcttgtttgtcctctcttgaagccatgattagtctgcctctgccatgtcgttggctcctcaggagattacaagctctctgaggacagagattacattttttttcaagtattatttccccagcagtgctgagcacagtacctgatgtaaagttgtgctctgtaaatgtttactgaattgaatccttctaaacagaggagggagatactattaatcagggctgaacgtgtgacagcactgttctttcaagccaagactatatgtatgttctttactttttttttttttttttttttttttttttttgagatggagtttcactcttgttgcccaggctggagtgcgatggcacgatcttggctcactgcaacctccgcctcccgggttcaagcatttctgtctcagcgtcccgagtacctgggattacaggcatgcaccaccacgcccggctaattttgtatttttagtagagatggggtttctccatgttggtcaggctggtctcgagctcccaatctcaggtgatctgcctgccttggcctcccaaagtgccgggattacaggcatgagccaacacacctggctttttttacttttaaatcatcatttcccttttagagatgggatgtcagaggcccaaaaaactcagttcatttgcgtgaggtcatgtaaatggtgatatctggaagtgtctccctcaaagtcagtgccctccctcacaggcactcattccctaaggcacctaggatgggcacagagaaaggagaaccaagcttggctggggctgctgtccagagaaggtgggcaggtgtcaagagcaggtgcagaggtggagaggagagctaaatcttgtcctcagtagaagcagagatgtcatttcaactgcaggttttgaaaaatgtcagtgcatacttcatgagattttctgaattcatttttactctcatcttctacactatttatctaagctgttgttctctttgaaactatgtcagccacatgtcattcattgtgccacaaccctgggctttttatcctgcttagggttttgttttgttttgcttgttttttctccccagctgctctgcctatcacttaattctctgagccctctggcctgagtcttatccggtggtgtgggtcaccttacaatcccgtttctagtctcctgggagtagtggtggcaggcgagggatagaatcaacatccaggttcagaatctatttgtcttttttggtcttattgtccgaagcttgagtcaaggataaattaatcagtctagaggtgggagagccctctaaccctccccagggaaaatcctagcctttatagaaacttggcctggttttggctctcagatttaattccaagctgtgaagaatctgtcaatgttcaactaaccctgacaaaacctttggaagtttctgttgcaaccgaaactcttatcacaggaggtggtactgagcttggcatcagaggttggagagagaagagagctagcctgctaattaatattttttttccttaaatttcaggcttttttttttagtttaaatgttctaaagaacctgtcctgtcacttcccatctgtttcctggtgttttcctcaagcatctcactggtttgttttatgtttttgaggggattatctggggtgctgattactttccctaccttcaaggagcctttgaataattttataaatgagaccatttgtctaggggcaagagaaggttgctgaaggcaacctagtcctgctttctcccaagagaaattgtacactaacatttgtttagtagtgcctatatcccaagtacaaggctcttgccttatacctaggatgagcaactattccagtttgccccaagataagctggggggtttccttgggtcctggaccttaaatagagtgtagacgaggagagttatcttttcttctgtctatcctaggttcatagctggggcccttttaacaaaagatagattaacaagagagaagcatacacatttatgtaatatgttttatgtgatatgggaggtatcatacagaaatgtagacccagaggaacagttaaacatgagtatttttatgttaggcttgatgaagagtagacagacatggaaaaatatgatagggcaagaagggcatgatttaatggtaataaactggggaacttagcaaagcctgttagtgcagtttcatccgtgtgatccttcatctccagatacaaggatggtgctttcctttgagtacagggagggcacctctcacatgagggtcttatgacctgcttcaggggacagtcagaaaatcctaggtttaatgacctgctttaggggagaatggtgggggaaaggtaagagtgacctctatgcctctatgattttctcagataccttcagcttaaactattcaaaatactaacatgccatattttgggatagcatgtcctgaaccccatcaagtgcagataccaggaaaaatgaccctgtaaaggaaatgccattatttccaccttacaagtgagaaaagtgagtttcgaagaggtgtgttcacttacagaagtttgcacaggaaactggtggtgagaaagaatcaaatatacatctgtcagacttcagacccagaactttacactaaccaacttcttcagaatgcagagttccatctccttcagactgtgtagctcaacagttttgtaccatctggctatttttctctactgtgtatttgactttgtctcttttgtctcagggtgtacttgaaagcctttacctccccatcttccttccctgatggctgatatacttctgcctcacctgctttaggagcccctgcctccaaccatccaaactaggtcaggggctggggctccttccttctgttagactattcagatctgagtcactggtcattcgcatagtgtcttataaatgtctgcctgtgtatttttccaccactgctagactgggatcttgtagaatacaaggaaacaactttcatctttagatttctagcacccagcatagttcctggcttataattggggatcagtaaatagctgttgaattaatcaatttataaattttcaggaagcatttgtgtgccttcgagtcacagtatttgatctatttaaggacttattccataagatgcatttgtgatgcttaggccagttctcttaatttttttttctatttttaatttttacaaagtaatttttgtgagttaacttggctgtttggattagatttcaacctgatactttaccatgcctaatgtctgagaatgagaaattgtcttttctgaagtcatagatgataatgtccaagtaatctagaggctgtgttgaagttaggaagaaaggaatttctgacatcaagtttttgctttgtcttcactgtggatttttctagttttctctaagtctcaaatttccaagctatacatattagcctacctttgagatttgatctttctgggtaggaaggagaaacaggagtgagacccagttatcagaaggtctgttctttgttctctccactcctcgcaatacaaccagcctcttgaattggtttctgattgctctaagtcatggaggagtgtggcatgaagacagaaatgatgaatgccatcccaagttaaactgcagtatgcatggtgctacatgtaattgtggcttttcatgaaataagcagattttggtttattcttaatgtttaaaatgctagcctgggttatacctactacctggtacctcattttccttattcctttgggcccgcaattattttgtcatcagttgtatagtcaaggacagaaaacagatgttccaatcaatctaagtaaacccaaataactctggcaaagcacacaccgtgctgaaatcaaatgaactgttatgccaagccttgctattaacaccaaagattggaagttgttggtagtaacatcaaaaatggtgaaaatatattgagtaaactgtcccagacattgttcccctcagttaatctccatgatagccctataagccacattctatcatcattccaattttatagatcaggagactgagacataggaaacttaagtgatttgacctacttgccagacttgaaaccaagcagtcgagttccagtgcccttgctttgaaccattacgccctaactagttcatatatctagtaaatgtctgtttacatctcatgtagaaaaagaccttccctattatcttgctctgcagagggtgggagggttggggtggggagggggcagtggcagtgtcaaggtgtgtaaaatttctctgttgacttaaagcataggatgatgatgatgatgatgatgatgatgatgatgatgatgatgattattattattattatttgagacggagtctggctctgtttcccagtgcaatggcgcgatctcggctcactgcaatctccggctcagtgcaagctctgcttcccaggttcacgccattctcctgcctcagcctcccaagtagctgggactataggtgccgccaccacgcccggctaattttttgtatttttagtagagacagggtttcactgtgttagccaggatggtctcgatctcctgacctcgtgatccaccctccttggcctcccaaagtgctgggattacaggcgtgagctaccacacccagtgcagtaaaagtaaacctactttaggatttagttggggtaagttctagaccacatttctttcaaggtcaaagcaatacttcatgaaacattgggattacctttttgacttttttttttttttttttttgagatggagtctcgctctgtggcccaggcttgaatgcagtggcgcgatctcgattcactgcatcctccacctcctgcattcaagcaattctcctgcctcagccccctgagcagcttggactacaggcgcgtgccaccatgcctagctaatttttatatttgtagtaaagacggggtttcaccatattagccaggctggtcttgaactcctgacctcatgatccacctgcctcggcctcccaaagtgctgagattacgggcataagccaccatgcccggccacctttttgactgttttactccccttcatttgctaggcttgaggttaaccctttgggtttgctttagtggcattttgacagtaagtcctgaaagagatctgagttcagctatcctattgtctaggaatagttggagttcttgtaagtagttgaaaagaaaggaactagcttctgtgaactccacgagataatgtaggataaggtagaattagagtcaggtagatctgggtgtgatatagtcccaccccgaggtcccccacaatttagtagtgtgggaccttgtagaagttgcttggaaaactttactctccttttctctatttgtaaatcaaagtgataataactaccttgcagtatcactgtgggaatcaaatatgataatatttgcaaagtgtcaagcacaaagcaatctcccaataatcaaggatcttagaacctttagtctttaccagtgatttttgacaaggtatgttgtgaggctccagtaattacattattacccatgagttgtcactcaaaaccaatcaatatttttcacctttattcatatttaagacacggagcctttgtccgtgattaaatgtgctattgttacctagaaaatgtcttgtgctttactagtatgtgacttctgccacacacattcatttattcattcattcattcatcaacaataacaacaaaaaatagtgagctactgcagtgtgaagacttgccctggcctccgtttgcttatagtgtagtagagggatttgtttgtgttgtctgtgcagacacataaactaaagttacagtgacagaatctgtagagagtcagaagatgggctacaaaggaaggaggcttggtcggttctgctggtctggggtgttttggggatgtggggagatgtgatcaggaaaggcttctgatgctgcaactgagtcttcaaaatggagttggtgttccccaggattgttatgggatgaggtgtattggtggaaaggatatcctaggcagagggagcaaagtaaacaaatgcttagtggcaaggaccaccaaatcacattcaggaataaggagaaaaggtcccaaccatatggaaccctgctcatgccaggcaattctgcaggtcgtggatggcgtatctcccatttattgagtactggtgtgttccacctaaatctcatttaattctcacagcaactttgtgggtgagtattgctatccaaattcttcagatatggaaattgaagttctaaggggtcaaggcatctttgcccaaggggatgaaagagggattcaagtctaactctgaagaagtagataaacaacaaaaacagcaataacaataataaaagtaataaaaacagcaaaggttcatatagtactaggcatgttttaacctgtaccgttcaatataatatccactagctatatgttgctacttaaatgtgaattaattaggatagaataaaaaattcagtcctcagttgtactagccacattttcagggctcaattgccacatgtgtctggtatctattgtatcagacagtgcaaatatagaacatttccatcatcacagaatgctcttattagcactgttatgggtactttacacctatattaacatatataatttttataatctgtgaggaggatactattcatattgtagagatgtggaaattgaggcataaggaagataagaaacataaagaagataagaaatcacatgatgaatgagtccttatttttaagcactgtgccataatactaactcaatatattgtgttctgtttaacataaatgaatgttagtcaaaataatggacttcagtgtctgcgtgtatgtagtctggtgttaagtcttctgcagagaacacgtctttgatatgattcttatccttccagaagcatacagttgtcaatttgcatgtataaagctggtggtcactagagagtcttctctggagcccttcctctccaggaactccagaaacctcccagccagctttggcaagaaactcactggatgggattcatcagtcagttcattcatccaaatgactgaatcaagagtctcaaacagatgtagtcttaaataatgttcaaaacccttcttatcctttttgatacttcagagaaggtgcctgaggttattaaaagagaatctttttcaagatgccaacacatcagactcaaagactgaaaatcctagttgagtccaacttctacctctaagttactaaataaactcgactaaattacttcacctttctgaaattcaatttcttcaactgtgaactggaaataaaatacacatatcacaggattttctaaggactaattgaaggttacagtgtttgaggatactttgcaagctataaagtactttatatggctataaagtgggagataattataacacaaatgcgagaactcaggatgtttttcttctatataaccttgtaagctttcaaaactgccacagcgtgataaattataggaaaatgtactcttaatcataacatttgcaaagtctcttttttattttacataaatatagtagggactcaatgcttgggtggaagtattgttggttggatgaatgggagagatgaagggagacagcatattaaataagagagctgttcatgaagttttaaatgttccttttttaacattctttttaaacattgcttgatatgaactatgtgtgttacatggagggttgggagacatttaattcattgagttagcctgtttttctgctatttgttttttagttcaacaaacatttattgagcaactgccatcagttgggcattgtgcaagtttcagggaaaacacagttgatgatgtcactgtttttttatgcctgtttcttcatctgctaatttttctccttaaacattttgaggattgcagaataaactgacactggtatggtcatatgaagggccccagcggtaccgagggctgcacttgtgtcaaattgtttcctgatgtacacatgcagcctgtgagttctctgtggatggcaaaatatgtttctccggaaagaagaaagctcctcccaccttttcttgcttttccctgcttatctctgaacctcttttctcggggatagcccatcaaagcactgtgtggccaaaggaaaaataagatgtcagctctccgactcatgtggtcttgcagtgaacatcagctatgcatggctgctgaattggggtggacattaggcagagtgtagagaacctcttgaggggaaatgaggccagtcctgcccaatatatataattttaggtaaggagatacctcagcttgtattttaggagaagcactgtgtatatactgagaatggctgaggaaggacctccatttgtaattcatttctctcattgtggggatgagagaaccagttcaaacttttaggccatttgtggcagaattggggctgaaactcttgtttttctaactcttagcccatggctctcactgagtttcatggtgaactagcacttccaagtatgttttcattatgtaagacaattataacatcataaagtgaggagtatagaaagaacataagctttggagtcagacagaacaaggtcaaatcctggcactgcttcttaaatccatgtggccttgggcaagttacctgaacactctgctctgttcttctacttctgcatctattaagaggaagaaagaatgtttaccttttatggatgttgcaaagattaaatgagagaacattcaaggagctcagcacagtacccagcctatctttgatgttgatatgtttactagaaaggaagaatccagttgtctcttgagagggggttcagatgatgatgatggtgatgatggtggtggtggagagagtgatggtagtgatgatggtgacagagctaccattaaacatctctttttaagcatttctgcaatatcacaacaaccatgtgatgttgtgattttcctcattttatagcagatccttctgtctccaaattccatccttttctcataatagcacactagttctcaggttctaagtctagatatagcagcagtgaatctgccaacccaagaagaaacaaataaatatttcctacacatttctttttccttcattttaattcccttttcgtattgactgaccctgtaacattaactttgcctgtactttatgtttatgcaaccagtaaatgtgggtgattctcaggaattccttgaacctatttatgatactgtggagcagcgtggccaactccttttctgtcaaggatctcagaatcaatatatttaagatcccaagattttgagatgtacagataagtgaacattggttgcctggctattggatttttatcttagagaaaaacctgtgagtcttggtggggaagaaccagcactttggaatcagattacctgaatgtgaatcacagcccagttccttgtgagctgcatgaccctggtgaagttactactcatttctaagcttcgattttcttatccataaaatgaggataatactaataccaatgacattagtttgttgtaagaataaaatgagacatgtatagaaagagcatgtaaaaagagctcagttaaaatgagctcatatcttgggttattcctgtacaaaagcctttgtgccctgaatggagaatcgtgtcactcaggattcactcagcaaaacacaaaccactctaattgtttaaaaaaccagtaacttaatacccaaaaatggcgatcctgatgatggaggagctgagaagggctacattccctgtgaagcaaatcagagatcagtgaaatggaagcagctaccatccccaggctggagggactaaggagggaggagggaggtggtgttctcatagtctgagggcaggggacaccagccgatgctggagccatggcagccctgtcaacagagcccgagtggtggaggggaagcagctgctgcctggcacagaagagaagtagataggctcttgcttccccttgcctgcaggggtagccccacaatactgagcagagcagcggacttgatctgaaaacacataggccaaggattcttgcaggctaaagtctcagacttctattgcctggttgtggatatgtaactactgtgataactaacacagaaagtttggaagagtcttacttccccctgttgctagacctctgaacaatagcagagattcacaggttgctgtgccccagaaggtagaatttggaaaaagcagtggaaaaccctcgaaagctgtaagaggcctgtctctggcctttttctcacattactttctagcaagtatctgagcagccagtgccttcagtatctggggatttgtggtctgatgagacattcccaccctgccgtttacctggctaacttctgcagaattgagtatagactgaacttccttgggcccctataggtgggttagctgcctttgtggcccctcctgtgatacactgatttccctgcactgaaatactccatttaggcttccatctccttcccaccagactgtgagcagggacttgtcttcttcatccttgcatccccaagcatttgtactcttacttcctgtattgagctagctactgtggtaggtcctgggctatgcatgtaagtaagagtgccagctactagcaacttttattatagaagggaggcagatgggatatatgatgttttaaaattacccatgtcttttgtgctagggaagtccattgcatgagactatttaacagggagaatcgtctgtcctagagggtcagggaagccctataattaggagtcggcctgacagcgaggttgggggaatggcattccaggcagagggaagagcaaatgtgaaggtcttgaggtgggaaacagcattaaggattagagattgagagcaaacgtggcattgcctgggagctgatgaggtcagcaggacctgttctctcctgtgtccaagtctctgcgtcctgcctgagcactttccacccccagctttgtgttgtagtcctgcaagtctgcgtgtttgtggcttccacatcacacctagtatatatcgttttgtgcatagaaggggcttattggatatttgaacaaatgaatacaattccaggccctaaagagtctttctagctttcttgtcatatttataactttagttgccctgcaagtatcaaggaatacgagctctatggggaagaagcctgaatttataccatttatgggaaaccctctgctatttggcattctgttactaggaactcgctctcagtcattctctccttcacaattggagttctgcgataagtagtagtaagaatggtgacctagggatgccagaaagattcagtcatcagaccatcctttgcttttgcttctttgggactgagatgtgatgtgttaaaccagattccatttggctccgctccttcttagcagtgaccttgggcaagtcagttaacctctgcagaccttagtttctcctctgatgtctaacattaataatatctatgatagtgttaaaatgagaccatgtatgcaaatatgtagcatagtgcctggtatttagtgagcagaaaataactgatagctgctgcttttattatgacaatcacaattactgccattattataacgttgggtgccatacattgaccagaacaaagcaaaatctgagcaggcttccgaggtttcctatgcaggcaagtatgccctttgggtttctccttgagactgccctacacacaggacccttcctccatgttgtttgactattaaaaagaagatttgttaatgcttgtttttagctttctctccctctttttttatgtgttaaagaggatttgtttttgttttcctttctcacaggagtgattggggcagatgtgagagggcacggcctcatctgtgaggggcagccagtgacgtcacggctggctgtcatctgtggaacgtcttcttgtcacatgggggtgagtccactgagcacaaaggcaaggccaccacacagcaggaggtagcctggaaggagaccctgagtgctggcttcttcaccctttcacttctttcctcttttccctgcctgccccttgtgctttgtctagccagaagcccagctccccactctacctcccttgcttaacatttgctggatctttttccaggggccaaattcttagtaagcatgaaaaggattgagtgctccctttgacgtcaccctggccagagagcccaggcatgaatggtgacatctgatcctaaggtgacaaagtctagctcccccagactgatctgtccctaatgggtagcggggtcttctcggcaaagagtgtctgttttccttggccagggaactctctctcaatcaatataaatccatctccctgggagcgtcctgatgatctatagaattagcctgcgtatcatgacttcaaaagaacactgataagcaattttcactttgttaatttttctccatgaattagtgaaaaggctttctccaagattgcagttaaaatttagtgcctgccctaaaatttatatcttctttaaatgcatgagtctgaaagcattccattccgataagtacccatttctaccatatttttatttaaaagtcattactctgttaaacttaaatcgacgactctttggaattttcccagataagtataatagagggcagagtgggggaggagcagggagatgagcagagattagagcgggacacagcccagggcagaaccaaagcagctatggaggaaattaagtgggatgtgagactgttttgcaactgtagggacccctgagcctttttaccatcagatattctagttcagttgatataaatacatgtacttacttatcaatccctgctcttgtgctaaactgtggatataagaatgacatcggctcagtgggatgagatgaagttataacaggtattagaatataatgtgaggccccccaatgtagatacaaattgaactcatgatactaagcatctgttatgtgccaagcaatatgcgaggtattcttgcacatggcatcccattttctatggctgagggagccagcccgagtggtttccagtcccacttcctcagtttactaagtgtgggcctttgggcaaggtacttaaactctctgggtcccagattcctcatctacaatatgtagagagtgacagcacctgtcagagtgctgcaagaattaaatgaggtgatactaagtgctccacatgcagtaagcacatcacaagggctcactcttaatcactaggactgttgttgttactgagcagaaagcaaacagtggctgactctgcctgggagggtgcagggtgatagaatcttcttgaggtgacatttgtgctggactttaaggaaatagatttccttctgtttgggctctgggcagtcttgaatggaatttttctaagtttaaaaattgcagcatatttggccagacacagtggctcacgcctgtaatcccagcactttgggaggccgaggtgggtggatcacctgaggtcaagagttcaagaccagcctggccaacatggtgaaaccccgtctctactacaaatacaaaaaattagccgggcgtggtggcaggcacctgtaattccagctgcttgggaggctgaggcaggagaattgcttgaacccagaaggcagaggttgcagcaagccgagatagtgccattgcactccagcctgggcaacaagagcgacactccatctcaaaaataataataataatttcagcatatttcttctgctcagcagcccttttgtaaggctcagctgtccctgaagggagagatctgcagaggcctgaggcctctttaagccagaaggcaccagcccaggagccagcccttctttcccttgatatgagtctacacttgttagattgtcttcactgaatactgatttaatcctgtttaaattatctcttattttcacagggatacatctaatcaggcttctcctgggagatctgaatctcaggcatttttaccccactcaattcagatttctgaacagaagcaaatctaaatggatgcaagtgtctctgtgatggcctgcttcttagtcttactgtctcttaatggagatgaggctggctttccctacccatttaatgtacacatttgggacctaaagcgtagaaaagtccagtaattttcccaaagtcacaaagctttgaagttcttgagctaagaactgaaatctaactctgattccaaagctcatactcctccttgcctccctgaattgtgcatgaagatgatgtacccatagaggaatggtgagaacatgggcttttacattgtccagaggcaagcttgaacatctgctcatgcatgttttggccctctgacctgagtgagctacttaacttctctaagcttcagattcttcatccatcaaattggggataatgatgccagtctcacagggttgttgagtaacatgcattatgtaggtttgtacctagcacacagcagacactcaaaaatggtggagattgttattaaactttcctagtgatgtaaacggctcacatgaagcaactgtttgggctttaacgagtttgatgggcagctgcagttggttgcgatgaatgagggccataaaaggccagtttatgatggctgtgttgtgctggaaataaagtccccacccccatcctgctttgtacttgggagtgggaagggaccctctgggccaaggggattaatcatcagctttaatgttatgtcatgagggtgagactgtggtcatgctggcatgggaaagtgcctttgatctcctcaggtgctgggaacccagcaacaataacacctttgtgaggtctaggagaggtgcaggtctgaggaaacactcccagggagactcaaggaccccctttgttgtggttctggcaaataaaaccgccactgtgaggaaaaattaaccaaacagaacacagggaccaaagggtgatgcgggcttttcaaaaagtggttttcagcatgatctgaaggatcctctttcttcctgtctgcttacttctgatgtttccaatttagtagattgagacaaaattcccaggaacgttttgtgcttgatccaggttgcctctttctagatcacccaaaaagaataaatgaatgaacgaatgaccacataagtgagtattggtaaatacttagaagcttcgtacctccaggttcctgttgcttccaggaatctggagaaaaagcctgaggttgaacataagacatgttaataaggcctttgatattttagaagatacaagcatgggctgcacatttatcttccttgtgggtgatttaattaacaggggaaaaatgccattctttttttaactccatgaaagcagagctgcttgttcagagttaattactaccaagtcaccaaaaccccagataatacacagcaggggttagccagaggttgaaaagtcatggggtaagatggagctgatccttgccattgtactgacatccttttcttgagctgtcaggttgggttgtaacttggcaacttgtcttccagttagcatgtcagatggggacaggaccctgggggggtcggggtagggagaaacactgaggaggtaagatttgagcagaacaatacctgaagagagctgggaactacatctgcatcttaaatcgctcagaactgaagttttttcagtcttaatattgagatagtggttctctatcattgaagggatgtggagactcaaagacataggctcatacgctgcccccaccacttactgtgtgaatttaggcaggatgcttcatctttcagtgcctcagtttctgcatctgttaaatgtgagtgatagtatttacccataaagttttgttcaggttcaaattaggccatctttgtaaatgacttggcactgtacctggcacaaaataccaaatatgatattgttattaaaaatgagttgttaatcacatgaacaatccatgtggttatggactagaattagagacatcagtatgaactcatattgggggaacccacccccaatatttcaacgtaggttctttctattttccgtaagtgtcagccggctgagaaataaagagaaagagtacaacgagaggaattttacagctgggctgctgggggtgacatcacatatcagtaggaccatgatgcccacctgagccttaaatccagcaagttttattaaggatttcaaaaggggagggggtgcaagaacagggagtaggtcacaagatcacatgcttcaaaggcaaaaaggagaacagagatcacatacttctgaggaaacagtacaagggcaaattcagaactactgataagtgtctatgttcagctgtgcatgtattgtcttgataaacatcttaaacaacagaaaacagggttcaagagcagagaaccgatctgacctcaaatttaccagggtgggttttttccccaccctaataagcctagggtactgcaggagaccagggcatatttcagtccttatctcaacctcataagacagacactcccagagtggcttttatagacctccccccaggaatgcattccttccccagggtattaattattaatattctttgctgggaaaataatttagcgatatcttccctacctgcacatctgttttaggctgtctgcaagaagaaaaatatggctctttttgcccgaccccacaggcagtcagaccttatggttgtcttcctatgttccctaaaatcactgttattctgttctttttccaggtgcactgatttcatattgttcaaacacacatcttttacaatcaatttgtacagttaacacaatagtggtcctgaggtgaagtacattctcagcttatgaagataacagggttaagagattaaagtaaagacaggcataagaaattattaaagtattaattttgggaactgataaatgtccatattaaaatgaaatcttcacaatttatgttcagagattgaagtaaagattggcgtaagaaattataaaagtattatttgggaactgatatatgtccatattaaaatgaaatcttcacaatttatgttcctctgctgcagctccagccagtcccactgtttgaggtccctgacttcctgaaacaaactcatatttagtttaacatagatgcagatggatgcatatagaaatagttatggatatatatacatatacaggttagtaaacacatatttatttcctggctctgttagctgagatggtctagaaataaggatacctcaagagctagtttttacaagcacatagtgtccagatcatggtatctaataccattatccaatacaaagaaccaggactccttggagaaatagttgattttaggattggaataggaaatatacaagatgagcttggagcatttgcagtgccagaaagttaggaagttctcaacaaaaaagatgagaatatgtcacagggagccaactgtgggagctcccactagccaaaactggaacaatttaagcagtaaaatgaagtattatgaattataactcaaagtataacataaatatccataagaccatactgacataaattattttgaataaataaatcaatgaaaagaagagagacatctcccatgcagaaagattccaaataatttatataaatgttccaccatcaaggaggtggagcataactttccactccttaagtgtgggctgcacatagcgatttccttccacaaaatatggtatggaaaacgggggaagagtaattttacattggagaaatatgagaaacagcatccacgtgacaaggtcaacatcaacaatgataagtcatgttgatagtacgtacccttgatatgatgtaatgaaaatgacactttgtctctgttgtgttcatcccccaatcctataagcccagtctaattaccaggaaaacaccaaacagatcttagttaagggacatcctataaaatacttgaccagtatttctcaaagctgtcatccaggtcatcaaaaaacagggaaagtcagagaaactatcacagccaagaggaacctaaagagccatgataactaaatgtaatatggtatcctggatgggatcctggagcagagaaagaacattaggtaaaatctaaggaaatctgaataaagtatggtcttcagttcatgataatatatcagtgtcattcactgtgacatatatacttgacaagatagtaatgataggggaaatgtaactggatgtgaggtatatatgatctttacaaccatcttatattgtaaaactattctaaaatttaaaatttatttttaaaatattcattaactattcactcataaagaaaacttttttttttaatttacctggctaagtgctaaaagtcttcataagataaaatgtcatgcctgccttcaaagagctcaggcacattgagaaagacagacagaaaaaggagatactacaatacaaaatggtaactactatagttaatgcatggctggagtgtggtggaagtaggaagaaggggctgtcccaagtcttgggtagatgaggaggttttcctataggaagagatatttgcaggatcatggcttccccgcccccactgagacactgttcctgccagcccaatttctgtagtaggccctttcctcagtcttctccactttgtttttctttgctgtgtccacaaagcctcacagctgacttcccctgaggcctgagcaggatgtgggtgtgtatgagccctttgggagggcaccacagggagacagcacagtcatgtattatgaactgatggtcttctgttactagctgagaagagtgggcaagtgggaccagtttctctgtcatggtctctttaacaagtgacattggcagaagttaccagaggggtggagtgggatgggattccacacggtacagtagaccactgttacacctaacaatgaaagtgctgaggtgctgctcagaaggtgcctcgcttcctctttgtttaccaggacctgttgtcgtcagccctctaggaaccagcattctcaggacactctctgtgtcaagactagctctcagactgcatgttttgaaaacaaagtatatgctaggcattgattcggcgaggagagggttgatgtggttcagtggacaatgagagacagactgtgcactcaagaagctcaaggtagcttgtttttcaagacatttgagaaacatagaaacattatgctggactgagtatgtttaatatctctgaacccaggcagtagcaccctttcctcaatcctcatgaggagataagcagtaatactacttgctaccatctgttgaccacggaccatgtactaagcaccttactaaaactttgtatcatgtaaatagctcaacaatcctaccaagtaggcaccatactgtccctcattttacaagttaggagactgaggcaaagagtggttaagtgggtcacacaatgtgtaggaatgcaacactttgagccctctggaagactgaccagagagtccttcctcctccctttcagctgtatagcttccctcaaaggcctagaggaaagggagaacagactcaattaaaagggccaaacatgagcaaatgtttgaacagacatttcaccaaaggagaaatttgaatgaaaagcactggtcattagggaaatgcaaattaaaaccacagtaagattctctactactcctactcatcttagaatggctgaagatgtgaggaactgtagctctcacacaccactggtgggaatgtaaaatgatgcaaccattttggaaaatggtttagcagttacaaagttaacatattcctactacgtgatctagccattccactcttacaaaagcatgtattcatacaaaaatttgtacagtaatgttcataccaacaaataaagctttgtaatagtccagcactggaaacaaccgagatatctttcaagagtgaatagatcaactcttggtgtatcaagagaacaaaatactactaagcagtaaaagggaatgaaccataatataaggtacaacatggattaatcacacaaaataattatgctgagtgacagaagccattaattcttccaggcaacttgcagtcttttgtggaaaagtgggctcaggccagctgataggtagattccccctaaaggcttttgttcctggccttctgagatgctttgtttcacctgactttgccatgttcctggtggactttcagaaacatgaggccagatatccctgcccagcttttatagaaatggaatgtctggatcacagggtagatgtaagttttaagaaactgccaaactgttttccaaagtcactgtaccagaaacgaatgcaaactttcttgaataaaaaatagttccattatttaaattcttgcaaaagcaaactaatatatagtgacaaaaagcagatcagtagttgcctggaatcatgaaatgggcacaacaagggccaggaaagtaggatcaaaaaggggcacaaggaaagatttgggtatgtttatcttgattgtggtaataacttcactgatctatgctatgtcaaaactttccaaatcagacatcttaaatatgtacagtttattgaaagctattagctcaataatgctttttaaaaacagaaaaaagatcgattttgtatctggagactttactgaagttgcttatacacctaaggaattttaaggctgagatgatggggttttctaaatatacaattatgtcatctgcaaaccgagataatttgacttcctctcttcttatttgaataccctttatttctttctcttgcctgattgccctggccagaacttccaatagtatgttgaataggagtggtgagagagggcatccttgtcttgtgccggttttcaaagggaatgcttccagcttttgcccactcactatgatattggctgcgggtttgtcataaatagctcttcttgttttgagatatgttcattcaatacctagtttatggattgtttttagcatgaaggggtgttgaattttattggaggccttttctgcatctattgagataatcatgtggtttttgtcattggttctgtttatgtgacgggttacaccaataatagagagtcaaatcatgagtgaactcccattcacaattgctacaaagagaataaaatacctaggtatacaacttacaggggatatgaaggacctcttcaaggagaactacaaaccactgctcaaggaaataagagaggacacaaacaaatggaaaaacattccatgctcatggataggaagaatcaatatcgtgaaaatggccatactgctcaaaataatttatagattcaatgctattcccatcaaactaccattgactttcttcacacaattagaaaaaactactttaaatttcatatggaaccaaaaaagagcctgtatagccaagacaatcctaagccaaaagaacaaagctagaggcatcatgctccctgacttcaaactctactacaaggctacagtaaccaaaacagtatggtactggtaccaaaacagatatgtagacccatggaacagaagagaggcctcagaaataacaccacacatctacaaccatctgatcattgacaaacctgacaaaaacaaggaatggggaaagattccctatttaataaatggtgttgggaaaactggctagccatatgcagaaaactgaaactggaccccttccttacaccttatacaaaaattaactcaagatggattaaagatttaaacataagacctgaaaccgtaaaaaacctagaagaaaacctaggcagtaccattcaggatgtaggcatggacaaagacttcatgactaaaacaccaaaagcaatggcaacaaaagccaaaatagacaaatgggatctaattaaactaaagagcatctgcacagtcaaaaaagctgtcatcagagtgaacgggcaacctacaaattgggagaaaaattttgcagtatctccatctaacaactgttcagaaatcagttagagagcctctggccttagtgtctttgggctctaaccacagaaaagccacccttcagaccatgctacgtttttagagctgtgttctctgggtgatgtctataacagcactttacagcttcctcagaacaccaaagaaaacgttccccagaggcaaagggtgtggcctgggcctggggggcccatgtttcatccaggaccatgaggcactgcacagtgtttgtttgttagaggagcagaggatgctcaaaatcattagtcgttagggaaatgcaagtgaaagacacagtgagatccactccacacttactagaatggctgaagttgtggtgataatgtggggaactggaactcacatgccactggcaggaatgtcaaatgatgcaacgactttggaaaacattttagcagtttcataaaacctactctaccctgtgatccagacattccatttctataaaagccaggcagggatatctggccccatgtttctggaaacccactaggaacacggcaaagtcaggtgaaacaaggcatctcagaaggtcaggaacaaaagcctttagggggaatctatctatcagatggcctgagcccagttttccacaaaagactgcaagttgcctggaagaatggtgtaagttcttcctctagaagtagaggacgaaaatggtgcagctgtgttttagctccctcctgattggcagcatgggttcttctcccaagggtacaagggaatggggtgggatgggggtggtatatgggagtggaaagttctggaggactgccttgattagcagcaatgacaataacagctaatatttattatatgtttatcatggtctatttggatttttttaaccctcataataaccttatacagttgtcagaattatcttaccaatttatggggactgaaactgaggctcagagagacaagtgacttatccaaggctgtctagctagtaagtcctttctttttttttaagacagagtcttgtcgcactcttgctcaggctggggtgcaggtgcgccatctcggctcactgcaagctctgcctcccgggttcacgccagtctcctgcctcagcctcctgagtagctgggactataggcacccgccaccatgcccggctaattttttgtatttttagtagagacggggtttcaccgcgttagccaggatggtctcgatctcctgacattgtgatccacccgcctaagcctcccaaagtgctgggattacaggcgtgagccaccgcgcctggccgtaagtcttacagataggtttgccactcaggcagttggattccagagctcagactctcaacaataagcagaatgatgagacacaggctgtgggatgggttgaccataaacacacgtgttttgtgggaatgaggtagagtgattacacagcagatctttcccagagcctgatgagaactgcacagttaaggctggatcacagctagaccgcagtgctttcattttccctttttcccagtcttccaaatcacttcctttcaagaagccaccagcctaatgataacaataaaaataaacaacatcacttgtcaccatcatcccctgggaagagagtatttatgagactccctatttaatcttcccctgttccctgctgcgctgtggtcaagtaccaaatttggcaatgtgaagacatgcggctgacttcccaactcatgaagatgtttttctatttgtttggagagcatgatgaaaaccacattgattttttttttccttttcctatttaccacacatctgttgtgtgggtgattctgatattgtggctgctgagggttacctggcagtaaccctcagtaagaggagagggtttgtccttttccagaagtttggtgtggatgaaatagatgatgaggcagtcatggtggagccctaaccaagcattgggtcccgtgccaagtgcctgcatgcatgagctcatttagttctacatacatttagttcagaggctttagtatttatgccttgtttttctcttagtttttcatcctcttctcctattctgtttgtgtgttccaaatgtctgttttttcatacattacatttttatatcttttgaaagtactcttaagagctgtcagaagtttgaggtagtttctactctttcacttaaccaatggttagagccccaggagaaataacagtgagatcaaagaactcagaagaaccaatgggaagctttttgagcaatcagcactgaaggaatgaaattgaaagtccctacgtaattaaccatcagtggctccctactgccaatagaaaaaaaaaagttcagatgagacaatgagtggaccttctggctgtgttcttatgggtttgggatatattgcattagaataaaaccgaagtcttaaatcctaaatgaaagttactgtcagttatactgacagtgatactgtcatgtatgttgtaaatctttttgttgaaagataatttacataccatgaaatttatccccttgtatttttaaaacatctagagaactgagtatagtgatgtttgagaaagaggagacttactgcccattttttaggttacattatgggatgatactagtgtgtggtctttattacttagggagataacagaaggatatcatacaatagtacattgccatttacttgtatgtacctgacacataataggtgtccgttaaataatagatatatacatgagcataaggacagacagaaaaataccagttagcaactgtaaaggtttgttggagaagaaatcgtgccatacctatttgatttctgttctctgatggagtgaaaggctgggcagagaaagggagatacagcatataaaccaccaagttattggtcaggccttaggttctttccttgattaactgacccttcccacatgccacagcagcattggttaagtcagtcacacaattttatctgtgcacaaccgagttgtccactgaattatacctcaaagcaggccaaaaatatatatatatatgtaaaactgattgaaaagcattaagaacaactaattgccaatttgtatttgggctgtttagttgatcgttgtagccttgtgtggcaccaggcaaagactaagccacaattctgttggttgaggaaatatttaactggaagatgcttttgaatgaatgatcagctacccaggtactatttgacatacagcagtcttggggcttccatgacttattctcctatcatctgtttgcatgataaaattacaggtttccatgtaatctttagcagatgtatttgctatgatcttggaagacagggcatagcttctctggaattaagggaatggcccaggaaaaagaagaggtgcccacagataaaatggtcagttatttttatatatgtgtgcattcttctgtggtgtgcagaacaccaaattgcttggacctgtttattcccacagactcacagtcaaactggtcctgaatattaaatctgatggtttcattctcctgataaaaatcctttgtcgataaaaaatcctttgtcaagtctcctgaatgctagctaggcatacgagatccagcattattgcccctgtctacctctgataccattccgtgctatccctcaccattcatcctgtgttctagcaggtgcatctgcacacgcttgtttgaattctatggaaccagagatgtttgagcatagagaatgaccagattttaggcagttaatactgtatatatacaatataatgcataacactgccagtgaagtttggagcagcacctgtaatcgtgcatactaatatctctacagtaaaacatatgaatattcacaccaaacaggttaagtcagctttaaatggcttgatccattcagatcagattttaccatcaaatgaattgtgaaaagacttttggtatttgaaatgctttgggttgaagaagtgtggtagacctgtacttgcttttcttgaaaagagcctgtgctctcttattcatctggcctttgggcatgttgttttccctgcctggaatggccacatctccctctgcctgttgagtagcatcattactagaatcatcattgcatatactgaggatttactatgttgttactcccagcaaattctatggtcgggggggcgggggggggtgttcttattgtattacatccccccagtgtttagatgaggaaactgaagcttggagaggtcacagagctaggaagaggtagagctgaggttgaaccaaaaagtatggagacaacaaaccttgggttcttagttactacactgtccgtgtgtgcgtcttccccaaaggtccagttcaggtgtcaccttcctaaggccctcttcccttcctccaccacgtttaatagattatgactcctctgggccttcacagctgtttatgcatagctgtggtgcactgcttctcattctctgtctttcccatgagcctaaactccttgagtagttggggaaaaatgtctacttcagtgttctatctctagggcatacagtaggtagtcaacacatagtttataattaagttagtttaaagtgatacggtaacagataacaatttgtatcatcattaaaataaatagtaaacaccaaatcacaagttcaaggatataaaatttggatttacaaaagaaaaaaatactcagaaaaaaaaaggctgctcatttttatgcatggtatgtaaagaagaggaatttggggacaacagttcaagaatgggcaaggaacacatttatacttaaaaattatgacagctaggatttattaaatacttcacatgtgacagtttctctgctaggcattctgtgtataaactttctaatcctcacaacaaatatgtaaggctaattgtcgaatccctgaatggacaaaaattatagctatataagaaagagaaagatatggtaaccatgtcttagatcagaataaaaagaacaaaaggtaatgatcctaatatattcagatttaacataaattaagcatcattagaggacagtcacataaaattgcacaatagaatatatttccacatctgagagatgatggaattgaggtcaaagagattacaggctagtatgtggtattttatacccattccttgaattatgttaacatggtaccagaagtatatcttgctgtcctcctcagaactgggtgcagttttgagctctgcttttgtaaaaagctgttagaacctgaaagaaccacataacacagctgtaatattcaagagaaagtgggtcccacgaacaaagattgagattgttcagagaaatggggtggttctgattgcttaatagaaacctcacaggttggctctattattttcttgtttatggaagtttttgtgaccgtaagagctaacttttccttggtgctttagagtttattaaacgtcttatggaatttgatgctcagaataactaagtgaatcagtcagagcagatgttttctttttttcaaatgagactcaaagaaattaagtgatttgttcagtgtcccacagctaataaatgatagggccaagactcagatatgtatctgagcagacccctgagccatgtccactgcaatcttgcaatccttggttcatcttcatttactcaaattgaaggatcctgcggctggtgaatgtctggttcattgcagaagagttcctggttccttgtctctaatttccattgtgactgtgaattctccattgagctgcaagccagtgactgtcaattaatgtgcacaaaatatacctgggtaactgttttaaaaatgcaattcctcaggcccctctcccacagggtctgattctctaagtcttgctggaagggatatatgagaatctgtaattttaacatgtgcccaggtgattctaatggaaaactttcaaaaaaactgctttaagctctttcagagtagcaattatatctttacttcattgtttccgtagtgcctagcagagcaccttgtacatagacagtactctaaatttacacttgatgaatataagagtgaagtaaataaatgtaaaattaatgtaaaatgaaggaaaacaagtttgagaatcagtcagttcctgccagatttggagcacactgaggaatccctttatctccatcctttcaaataaaatatctcttggtaggtctgggtaagacatactgagaagtcatgacttggacaaagtacctggtagaatctgccaacaattagagattgtggaattcttattttctcatggaaagcaggatggagtgaaacagtgagagatcctgtttgtagttctgtgcagacaaacccagaaaccagaacgcagacacaccaggacgcaacaggaaaccacaaaggcctgagatctttcaatgtaaataggaagtcagagtttacttccgaacccacagtgccaagctgaagtgcagtgtttaatccagctctctacccagcccttccttgagcctgggcacagatgaaagatgatgatgccacctgggtaaaagcattcaaaaatgtttgttctgatcaggtcttggagtgagcttcttttgtttgtgctagtgaataatttgggacacaggtgcactttgcatttgaaagcgttaattggtctccttggttttccctgccatgatatttgaagccacatcttcctccacaaagtaattttaatccatatacattcaaaaagcacttgtcatggacagccgtctttcatataccccatctgtggacccctgggtccaggtgcagagtagtggaacattggtgatgcttaatatgtactctgtgttcattgcattgacatctgtaatctcatttgattactactattacactgggaaataattaataggatacgatcatcaccattttgaaataaggaaaatgtagtctggtagaaaacacatggatgttaaagttaggcagatctgtgttcatgtccaaaagacttaagctttcttaccagactgctttattttatgtagccagttgtttagagcattcactctgtgccaggtactggagagaaaatggtgagcagtagacctagactgtacagtgtagtggaggagatgaatactcagcaaacaattacaaaaatgtataattacagaccttgataagtgctttgctttcataccctgctgggggaagtataaattgggcagtcactttggaaaacagtgaggcattgtctgatcaatttgactgtgcacatgccctgtactctaccaattccattcctaggtaggaagctggagaaacaattgtacttgtgtaccagtaagtgcccagagacaagtaagtacaagagtattcatagcattattttttataatagctacaaatttgaatcaactcaaatttcatcaataatagcatgaataactaagttgtattatattcatacagtggtagacatacttaaaatgtaggaactacagctacatatgacaacatagatggatcaaacaattttaagtggaagaaacaagacatgaaagagatacatacagaattatttcattcatagaaaattcaaaaagaagcaaaaaagacaatgtcttttaaaaaatgcctacaaaagcactaagcttagaaaagacaagcaagggaataattaccacaaatatcaggacactggtgaattagatggcttggaattgcaggttgttgaggttaaaagatgctttcaggaagagcttgagggaactagcatttgcttctgaaggatacatgagtacttaacagtttttttaatgttcacataagttttatacactcctctgtatgtatgatatgtaagtgctagaaagcagagaagctatcagaacatagagccaagtgccatataatttgggtggtctagaaggcaaggcagtgatgtttgagctgggagattttgattaggtaactaagcagagagcctgacggggagggagtagggttgtgcatggcagtggtcaagagaaaaaatttgttcagaaagagagtacagaagaataagcagaaggaaattggcagctttggtgtggggcaagagagaagaatgctacaagtaaaggctggagaagcaaaaaggggtagcatatgctgggcttgtaagccttctgagggattttagtcttttatgtaagagaaactgaaaggttttaagcacagtggataagataattgaattacaaaggatggaaataattccagtttggagaacaaattggcaagagacctgagtggtactaggatactaggaaaccagaagaagactgggagtctgtgtgagagatgatatcatactaacttgtctcagattatggtgggggagatgagatgtcgatatattggaaagatgtttagaagataaaatcagcagcacttccttggtgtgaaaactgttgaggctgcagggcaaacacaatagaggcttattaggtatctcacccaaactcctaagatgagctgctccccagtgagtagagatatctggagagagagcagtagtcgttcaggcattccttggacagactggattcactagagagaaacatttttggtttgcactgtcagctttgtttttaggttgttttaaatattttacccttgtctcttatgaaaggtcttctcaagaagtagccatgtggacacgatattgctttggtagtaattctgccaaaaatgcctgacttgaatctgatcatgaggaaatatcagaaacccaaattgagggagattctataaaataacttgcctctagtcttcaaaaatgccaaggtcataaaagaaaaactacaggaagatcaaaggagacgaaagagacatgatatctgaaggacatgtgtgatgctgaattgaattggagaaacttttttaaaagttttattgtaaaggacatttagtggataatagatgacattctaataagatcagtagattagataatagaattgtatctatgtatacttcctgataattgtattatggatatataagagaatatccttgttattataaaatacacactgaattattgaatattttggagtaaaaggacattatgtctgccactttcaaatggttcagaaaaactacatacatatacacatatgtgtgtgtgtatatatatgttcatatatatacacacatgtatgttcatatatatatgtttatgaacaatatgtgaacaatatgtttatgtaaaacattgggaaaatctaggtgaatattatacaataattctttgttctatttttacaactatttcataagtgttaaatcatttgtaataaaacattttaaaagtgttttttaatagaaggaagtagtcatgtgaaggccatgcttatatttggcataaccatgagttaatataccactcattgtgccccatataaaatcccacttgagaatttattttagaatttaccatttggaaaagtgttgttcaatctcaaatggtgtattttcatctttccagtaataaaagctatataatggattacatttttcttctggccctggaagccaaggaaactcagagttaaaaatttaacactcaagctaaactgttgagccttctactacatagcatatttccattcttctttttgctgtaattgtcttgcattactgtttctagtcactctgtactatattatctgtgtatgtatgtttgtgggagtggtagataaaatatctcaaactctttgtattagtttcctatggctgctattgtagcaagttgccatacacttggtggcttaaaacaacacacatatattttcttatggttctcgagactagaagttcaaaaccagtttcactcagccaagatcaagtgtcaacagggccgtactccctctggaggttccaggggaaaacctgttccttgcttcttccagcatctggtggctgctggcattccttggcttgtggccacatcattccagccttgccttctgtggtttcattgcctcctcctcatctgtggtcacatctgcctctccctgtctcttacaagaacagttatgattgcatttaggccaactcaaataatccaagattgtctcctcatgtcaggatccttaatcacatttgtgggtcctttttttttctttcttttttatttttttgccatatgagtaacattcataggttccagggatttgaacatggtgatcttttcaggagccattattcagcctaccataccctttatggaaagaagtgacatttaaatgtgttttttaaggtacataaaaataaagtattaatttatttggaaaatataaagtacttctgcactctgtgtatagtgaaggaacaaagataaaagaaatcaaatttctgtttagtgatttttcattgcttttatgaattacattgaattttctattatatttcctatttggttatttctggaatagagaaatatatttgactttttttagaaagtaaattatttgttaatatgaatgaataatacctgtgagatttccaatgaaaagaagcaaagttttatacatcaaatttgcttccaaatgctaatatactaaaatcagtgctagttatgtttaatataggttgctgagaaaaatagttatcttttatggtttttaaaaagtgtatgttaatttatttttatcgtttatttcttactgacaaatgcaaattgtatatatttatggggttcaatgtgaattttgatatactatatattgtaaaatgattaaatcaagcttattgacatattcattacctcacatacttttttgtggtgagaacatttaaaatctactctcttagtaattttcaaatatacaatacatttttattaactatagtcaccatgctgtgcaacagatcttcaaaacttattcctcctgtctaacccaagcttagtacaatttggccaacatctctgctttaccccttggcaaccccaccctaataaccaacattctactctctacttctatgagttcaactttattaagctttacatataagtgaaatcgtgcagtatttatccctctgtgtgtggtttattttacttagcataatgttctccaggatcgtctgtgtcactgcaaatgacagaatttccttcttttttaagactgaatagtattttgttttgaatctatggcacattttcttgatctgttgatggacatttaggttgatttcatatcttggcaattgtgaataatggtgcagtgaacatgagagtgcagacatctcttcaacatattgtttgcatttcgtttagatacacccagaagtagaattgcctgatcacatggtaatttgtcatttttttgaggaaactccatactgttttacaaaatgcctgtactagtttacattcccacagatttttaaaaagttaatcttctacccactaaccttgctaaactttcttatttttttaaaatgtgcatgtattatatatgctctgcatgcattataaatgttacagtaatttttaggtacaacactaaatattctcatatggtttggatggtcagtgaaggcttctgtaaggaagtgatatctgtgatattttggttaggaaaaaagtggtccaaacatagaggacagtatgagctatatatacaagatcatatcatctgcaaattttgcttctctcttcccttctttatatcttcttttgctgttaatttttgtctaattgtgtttgctagggcctctggtattatgctgaacagttgtggtgataaaaagcattctcacatgcacacatatgtttattgcagcactgtttacaatagcaaagatttggaaccaacccaaatgcccctcaatgatagactggataaggaaaatgtggcacatatttaccatggaatactatgcagccataaaaaagaatgagttcatgtcctttgcagggacatggatgaatctgggagccatcattctcagcaaactaacacaggaacagaaaaacaaacactgcatgttctcactcataagcaggagttgaacagtgagaacacatggacacagggaggggaacatcacacactgaggccagtcggggggtagggggaaaggggaagggagagcattaggacaaatgcctaatgcatgcagggcttaaagcctagatgacgggttgataggtgcagcaaaccaccatggcacatgtatacttatgtaacaaacctgcacgttctgcacacgtatcccagaacttaaagtaaaataataaataagcattctcatcttatttctaatcttagagggaatgtatataaaatttttccagtgagagtgatatttgctagagattacagacagacagacagacagacagacacacacacacacacacacacacacacacacacacatttccttatgaaattgagtaaatgatcttccaaagcattcagggcaaatagcagcccatgttttaataaccctaagaattattttatatgatagtcccattccatggccatggagctctgtcactatactgtgaacttctctatggcaggaactattcattcaccattgtatccttactctgaacttctctagggcaggaaactgttcacttgccattggatactcagtatctagcacaatgcctgtaagttaggcattcactatccattcaatgaatgaatggatggatgaacgatagttaatatctgtttcattctcaaagctagcaaattctttttaagcatgagccaaaaatatcactactttccattttctttattcaatgagttgagctcattttgccgccatccttacctcctcccagcacctggtacagtcagtagtcatttgacatatgaaggaataaatgaatgagtcaatcacagagcattctgctgccagttgatagactttgcccctaaagattctgaactttatttgaactgaagccaggtggttaaagatgatttaatcaggacaaaaataaaattctactctctttaatggaataattgcttattgcattttcttcttaaagttggccattcatctccttaaagttggccactgtctttcaatttatatatgttgtccatgaattattgaaagtgattattctgaattaagccaaaattattcacaaagaattgtcttggtgtgtgactagagggttcagaattccagtattacttggagagaggggttgggtatagtggtaaacttaaagtttacctgcaaaaaaacagtgttgaatgcctgagtatggcaaatccaaaaagtaagtatttggatttattggtgaataagggagagaggttggttatcaaaaaaagagcagttaagtaggaatatgttagtagttttaaatactttatgatggctctaatcatatatgtacttcctatttcaaaaggtatttcatttcataagttagagtaacacccaatattagaatttcagtgtccagaaattgattaccttctcctgacttggaactctctgctcaaaagcctttgatgactcttcgttgcctggagagtaaaaatttatttagccctagccagcgctgtccacctgcactcctaccatacacactctctgtttcagccacatgtaacagaatgttaccatagggctcttcctatcttggaggtttcgaacaggccccagagcccagaccacctatgcagagcttgctaaaagattgtgaaacttgtgctaaacgtcaccctgaggatataaaagaggtggaagaagtcagaggtcaagactaaggaaagaggctgaggttgatgattgtatctgagagagtagagcaaaaagtgaagacaaggaaaaggtgtgtgggtccagcacaagggagccagctggggatatcttaaaaggaatcccatccataaggttcaactagaggagcagaatgatcccagagcaggacttgatcacctgaaggccaggactgaaagggagttgtgggcagaccactggacggagagatagccagctttggacaggcaccacaccctgaggacataatgaagccagataacaacgtatatgcatcaagtgagaccttccccaggcaccttgacccctgtatggaggaaccccaaaacacccagctgtccagcaggaaaaagtagaaggaggagagagagaagccagcaagtccccttcttgaagtgtgtatacgctaagcctgaaatatactgtagctgcagaagggagaattttcaattagccaaaatgggagttttaattattataatagagtgtacatatttactgctagaagctggcctgaggacttttataattgaagagtgtaggaatacagtggatccccctgaaatttcatcccaggaatgaggaagaacagttcgtggaacaaatttaccaaggagaagagaatagagctgttttttcctgcacacccataatggtactacagatccttcaataaaccagaacacacacaaggctggggttgtcctctcgtccctctcctacatcagcaaatctgtctctacgtaatcatgtaagactacagcttgctttaatagctcccatcttaagaatgggagggggagagcgaggtagaagaaaaaccttgaccttatatttcgccctcctgttcccccatttattgtctttgccacacagcttctcaagtgctgtataatcccattcctcccctcccactctctcttgagcccaatcagacatttgtacaaacttctccatgaaaataacccttgaccatttgtttcgggctcctgtgaccagggtctgtgttcctaaatccagtagtcctcattcagatcgttctgttggcagcattgggcacagctgcgccctcccttctcaaaacccctcacttgcatgtagttgactctttggtcccattgtctaattgctctccatcaccagtttctaaattttggaaggcgttaagcctctgcccaagacctcttccctgcccatttccccttgcttcttcagtgacctcattaagactcaaagctttaagacaccatctgtagagtatgacctccaaacatatatctccagcctgaccctgatatcctaatatatttaatcacctactcagcatttcttcttggctttctaatagatacctaaaatttagcatgtcaaaagcctaattcctctcagcccccaggaaatctcctctcactgtctttcctagaacatgaaagaacaattctattcatacacttgcctatgtcaaaacaccttgaaaacatccttcatccctctctttttctcatattgtgctccagtaaatgctgtcagttctactgatggaatccaccaatgtggaccacctagttcaagcagttgtgctccctctcttggtttattgacacagtctcctgactgtctccctgtttttaccactgggccctggattctgttctcacagcagccagggtggcctcttgaaaacttgcctcagattatgtcattcctctgctcaaaacctttcaataattttgcatttcactgagaattaaagccaatgtccttaaaaataaaagatctgttcctcttacttttcagctctcatcttctgtcccctttctcactgttcacaccactgcagctgccctgattctttgctgttcatgtaagatagcaagcacacctctgccacagggcctttgtacttgctcttatctctccacctgcatcactcttaactgcatgcttcactcactcactcccttccagtctctgctgtaatgtaacctcatcattaaggtctatccagaccaccctatattaaaataacaacacttgccttcactcactgcttaacctctctatccttctttatttttctacacacagttatcgtcctacgctccactggactgtaagttccatgaagacagaactttgttttttcaccactgaatccccagccccttcaaagtgccttgcatgtaatagactctcacaaatagttctcaaatggagggtgcttcctaacttgctttagcctttccacatgctgttctttctggcaagagttgcttccctttaccccccgccttgttacaccccagccccaagtgagcctgttagaatcctgtgcatcctctcagactccagtttcatacaacctcctctgtgacaccgcgtgagtcagatttaattcctctttccccagaactcaaagttttcagttttattttgctttaatcaagtttgtacccttaaccactacattgtgtgtctttcagactcttgttctttcttgattttaaggctttagagatgacaaattcagcaaccgcaggtccttctcatgttgtagaattgtaaagtagctgttttttaactgcatgcaactgtatgaatcctaaacctagaattttcaatccctctattctaccgcatgtattttcatttctccttctttttctactacttcctcttcatcacaaaaaaagtcccaagcacatattatatgttattcattttcttcaaacatctttcacttaatagtttagagaaaagcccatctattccattgagtgacctttcctatgactatagaaagtggtcagtttttctgtcccttggcctgtttagcagttgaaatgcacctgacagtttgtattacaaagctaaatggtggtggccagtaaggagtttgataaacttttcatgtaatttatacataggggaaatgacactggctgttgagcacatgaagtcattttctttcttccctgaaatgctttgggggagaagaccaatcagtcatcttagtgctgcacctccatagtgagatctgcattaggtttttgaccaagaagacagtaatattttatgacaaaacttggaaaagttaaaaattcacagatgaacaaatgctttttctcattatttatctttttattctttcctatttttattccctgagaccatttgcatgaggggaaatttaatcaggatccctagttgagaacatttctattggagaaaatggaacctggatatcaaattatctcacaacttcttctgagtgacatacactgaattttatcttaaatagcttgtttagaagctattggtcaccagcttaaatagcaccttttcattataacattgcttctgttgttgcattcataacattttatttgctaaaaatgtattaactgtgtctctcccatcagttcttgagctttggagggctgtggctgtggcttattcatctctccatacccaaagactagcatataatagacatacagtaaaaatggaaagactatattgagctgcagtctaccctgtccaattaaaagtcagtggacatttgttgaataactgctatgtgccaggtattttgaaatatttggtgttatttaatctttatagtgaccctaaaatgcattgttatcccttagttatagatgagagaaagtacataagtggtttacccagctagtaagtagcagacctgtctttgaatgtaacccatgtaaagcaaaattttctgtcctttctcctttattagagcttaagtgatctttcagggaccgatatgtttagctatcaactctgtaataacatgaaaaatatttatttagctgtgatcatctatttgataaattgtcagagtgataaacccaaaaggagctttaaagatcattcagcctgtaatcccaaggtggaaagatcacttgaggccaggagtttgagaccagcctgggcaacatagtgagacccttctctcttaaaaagaaaaaaaagctggatgtggtggtggtgggtacctgtagtcccagctacttgggaggctaaggcaggaggatcacttgaacccaggaatttgaggctgcagtgagccatgatcatgcccactgcattccagcctgagaacagagcaagaacttgtctcaaaaaaacccccagaaatcatccaattcagtattctaatttcagatgcaaaaattgagtcccagaagggaaaaggtcttggccattatttcttctgtcagttggaatcatgttattcttctccttttgcactgtccttacagtaattacttttaaatccttagcaagtctgattatcccctgcatggtatggcctgtgatgacctctccagcctcacgttgcactactacccctcacagtttctgtccttcatctgtggcatagaacacactctattctctgcttcctgtccctctgcctatagcacccttccctctactccttctcctaagtcctacttacccttcacatttagctcaggcatctaatatcctctcgctggaagctttcagactagattaggtggtgtatctatgtgcatccatggtacatacctgtcatggtgcgtatccttctgtgtttgttgttagttaactggcttatgtcttccttgctgtgaattccttgaggacagatattgcggagcattcatttctatatcaccacggcctcataaagctcctcacacaaagtcagctttcaggaaattttgaaagaaataatcactcacttggattcaggtctgaagtgaggcaaacattagagatgtgatggtgttgaatactcatcgtttttgatattttgaaggctctcccatgcttgaggatccaaaggagtttaccattttgtaatgccacagatgtgtactggtgtctgtaatgctcaggtcccatccttgagcttcaccaggaacatcagtaggaagatctggcacaggctatgtggagagcctcctcaccccatgctgatgatctcatagtatctggtcactgccactaaggaaaaataaatgcctgcaggtccttttataccatgatgtaactaactataggaagtgtccctatgcaacatctttcatcttacctgaatcaaagcttcaatgaatgaagttctcttcggcccatcatcctgcaagaaactggtaggatgatggcattgggaagctataagggtgattctgacttctctgaaatgacatacattccttgtcaatattatgtcagcggaaaacttgctagccttagaaataaaaataaaggtcttatttttacattgacactttcaatctaggtaaacttgaataattcatttgatatttcagaggcttcatttcttcatctaagaacatgaggatcttttctatttatggaggtatcttgaggattggttgaagtagtgagcatgaaaggtctctagaaaaccttggttgtttagacatgttttagggacattgaaatggactgcgcatggaggaagcttcatggggggcacacctgaggggcatttcctcaatgggagagcacctttgcccttcacaacattcacacacccctcctgggtattggtgccaggctagtgccctgatctgagtccacctctgaacagtcaccctcaccaagataccccgagccaggagagccagtggagcacatctaagccaaagatgtcaaagagagtgaggagtgagaggtccaaattcaactggagaccctcaagatgagacctgttttgaatgagagagagatgaccgtgcagggtggaagcaggtctgatgcagctgacagctaaccactgctgctcggaagtgtcgacggctcaccacttatgtgttggcttttgttcctggactactcaggtggtttaaaagaccaggtgaaattgaggcaataatgaatagcttaccaaccaaaaaaagtccaggaccggatggattcacagccgaattctaccagaggtacaaggaggaattggtaccattccttctgaaactattccagccaatagaaaaagagggaatcctccctaactcattttatgaggccagcaacatcctgataccaaagcctggcagagacacaacaacaaaaaaaaagagaattttagaccaatatccctgatgaacatcgatgcaaaaatcctcaataaaatactggcaaaccgaattcagcagcacatcaaaaagcttatccaccatgatcaagtgggcttcatccctgggatgcaaggcttgttcagcatacacaaatcaataaacataatccagcatataaacagaacaaacaacaaaaaccatatgattatctcaatagatgcagaaaaggcctttgacaaaattcaacaacgcttcatgctaaaaactctcaataaattaggtattgatgggacgtatctcaaaataataagacctatctatgacaaacccacagccaatatcatactgaatgggcaaaaactggaagcattccctttgaaaactggcacaagacaaggatgccctctctcaccactgctattcaacgtagtgttggaagttctggccagggcaatcaggcaggagaaggaaataaagggtattcaattaggaaaagaggaagtcaaattgtccctgtttgcagatgacatgaatgtatatctagaaaaccccatcatctcagcccaaaatctccttaagctgataggcaacttcagcaaagtttcaggatacaaaatcaatgtgcaaaaatcacaagcattcttatacaccagtacagacaaagagagagccaaatcttgagtgaactcccattcacaattgcttcaaagagaataaaatagctaggaatccaacttacaagggacgtgaaggacctcatcaaggagaactacaaaccactgctcaatgaaataaaagaggataccaataaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagctcatatggaatcaaaaaagagcccacattgccaagtcaatcctaagccaaaagaacaaagctagaggcatcacgctacctgacttcaaactatactaccaggctacaggaaccaaaatagcatggtactggtaccaaaacagagatgcagaccaatggaacagaacagagccctcagaaataataccacacatctacaaccatctgatctttgacaaacctgacagaaacaagaaatggggaaaggattccctgtttaataaatggtgctgggaaaactggctagccatatggagaaagctgaaactggatcccttccttacaccctatacaaaaattaattcaaaatggattaaagacttaaatgttagacctgaaactataaaaatcctagaagaaaacctaggcatcaccattcaggacataggcatgggcaaggacttcatgtctaaaacaccaaaagcaatggcaacaaaagccaaaattgacaaatgggatctcattaaactaaagagcttctgcacagcaaaagaaactaccatcagggtgaacaggcaacctacagaatgggagaaaatattcacaacctactcatctgacaaagggctaatatccagaatctacaaagaactcaaacaaatttgcaagaaaaaaaccccatcaacaattgggtgaaggatatgaacagacacttctcaaaagaagacatttatgcagccaaaaggcacatgaaaaaatgctcatcatcactggccatcagaaaaatgcaaatcaaaaccacaatgagataccatctcacaccagttagaatgccaatcattaaacaggaaacaacagatgctggagaggatgtggagaaataggaacacttttacactgttgttgggactgtaaactagttgaaccattgtggaagtcagtgtggcgattcctcagggatctagaactagaaataccatttgacccagccatcccatcactgggtatatacgcaaaggattataaatcatgctactataaagacacatgcacacatatgtttattgtggcactattcacaatagcaaagacttggaaccaagccagatatccaacaatgatagactggattaagaaaatgtggcaaatatacaccatggaatactatgcagccataaaaaatgagttcatgtcctttgtagggacatggatgaagctggaaaccatcattcttagtaagctatcgcaaggacaaaaaaccaaacaccacatgttctcactcataggtgggaattgaacaatgagaacacatggacacaggaaggggaacatcacacaccggggcctgtggtggggtcgggggagtggggagggatagcattaggagatatacctaatgttaaatgacgagttaatggatgcagcacaccaacatggcacatgtatacatatgtaacaaacctgcacattgtgcacatgtaccctaaaacttaaagtataataataaaaaataaaagaccacgtgaaatgagcaggcttgggcaattcaaagcctggaaaaaaagtggtagagagggggatttggggaagagtagatagacagaatgaggtgacacattgaaggacttcttagagaaatgcatttgaggaagaagcagccaagatggccgaataggaacagctctggtctacagctcccagcgtgagtgacgcagaagacgggtgatttctgcatttccatctgaggtaccgggttcatctcactagggagtgccagacagtgggcgcaggacagtgggtgcagcgcaccgtgcacgagctgaagcagggcaaggcattgcctcactcaggaagcacaaggggtcagggagttccctttcctagtcaaagaaaggggtgacagatggcacctggaaaatcgggtcactcccgccctaatactgtgcttttccaatgggcttaaaaaatggcacaccaggagattatatcccgcacctggcttggagggtcctgcacccacggagtctcactgattgctagcacagcagtctgagatcaaactgcaaggcggcagcaaggctgggggaggggcgcccgccattgcccaggcttgcttaggtaagcaaagcagcctggaagctcgaactgggtggagcccaccacagctcaaggaggcctgcctgcctctgtaggctccacctctgggggcagggaacagacaaacaaaaagacagcagtaacccctgccgacttaaatgtccctgtctgacagctttgaagagagcagtggttctcccagcacgcaactggagatctgagaacgggcagactgcctcctcaagtgggtccctgacccctgacccccaagcagcctaactgggaggcaccccccagtaggggcagactgacacctcacacggccgggtactcctctgagacaaaacttccagaggaacgatcagacagctgcattcgcggttcacgataatcccctgttctgcagccactgttgctgttacccaggcaaacagggtctggagtggacctctagcaaactccaacagacctgcagctgagggtcctgtctgttagaaggaaaactaacaaacagaaaggacatccacaccaaaaacccatctgtacgtcgccatcatcaaagaccaaaagtagataaaaccacaaagatggggaaaaaacagagcagaaaaactggaaactctaaaaagcagagcacctctcctcctccaaaggatcgcagttcctcaccagcaatggaacaaagctggacagagattgactttgacgagttgagagaaggcttcagaccatcaaactattccaagctacagaaggaaattcaaaccaaaggcaaagaagttgaaaactttgaaaaaaattcagatgaatgtataactagaataaccaatacaaagaagtgcttaaaggagctgatggagctgaaagccaaggctcgagaactacgtgaagaatgcagaagcctcaggagccgatgtgatcaactggaagaaagggtatcagggatggaagatgaagcgaatgaaatgaagcgagaagggaagtttggagaaaaaagaataaaaagaaacgaacaaagcctccaagaaatatgggactatgtgaaaagaccaaatctacgtctgattggtgtacctgaaagtgacggagagaatggaaccaagttgaaaaacactctgcaggatattatccaggagaacttccccaatctagcaaggcaggccaacgttcagattcaggaaatacagagaacgccacaaagatactcctcgagaagagcaactccaagacacataattgtcagattcaccaaagtcgaaggaaaaaatattaagggcagccagagagaaagggcgggttacccacaaagggaagcccatcagactaacagcagatctcttggcagaaaccctacaagccagaagagagtgggggccaatatttaacattcttaaagaaaagaattttcaatccagaatttcatatccagccaaactaagcttcaaaagtgaaggagaaataaaatactttacagacaagccaatgctgagagattttgtcaccaccaggcctgccctaaaagagctcctgaaggaagcactaaacatggaaaggaacaaccggtaccagccactggaaaatcatgccaaactgtaaagaccatcgaggctaggaggaaactgcatcaactaacgagcaatataaccagctaacatcaaaatgacaggatcaaattcacacataacaatattaactttaaatgtaaatggactaaatgctccaattaaaagacacagtctggtaaattggataaagagtcaagacccatcagtgtgctgtattcaggaaacccagctcacatgcagagacacacataggctcaaaataaaaggatggaggaagatctcccatgcaaatggaaaacaaaaaaaggcaggagttgcaatcctagtctctgataaaacagactttaaaccaacaaagatcaaaagagacaaagaaggccattaaataatggtaaagggatcaattcaacaagagctaaccatcctaaatatatatgcacccaatacaggagcacgcagtttcataatgcaagtcctgagtgacctacaaagagacttagactcccacacaataataatgggagactttaacaccccactgtcaacattagacagatcaacgagacagaaagttaacaaggatacccaggaattgaactcaactctgcaccaagcggacctaatagacatctacagaactctccaccccaaatcaacagaatatacattttttccagcaccacaccacacctattccaaaattgaccacatagttggaagtaaagctctcctgagcaaatgtaaaagaacagaaattataacaaactgtctctcagaccacagtgcaatcaaagtagaactcaggattcagaaactcactcaaaaccgctcaactacatggaaactgaacaacctgctcctgaatgactactgggtacataatgaaatgaaggcagtaataaaggtgttcattgaaaccaacgagaacaaagacacaacataccagaatctctgggacatattcaaagcagtgtgtagagggaaatttatagcactaaatgcccacaagagaaagcaggaaagatccaaaattgacactctaacatcacaattaaaagaactagagaagcaagagcaaacacattcaaaagctagcagaaggcaagaaataactaaaatcacagcagaactgaaggaaatagagacataaaaaacccttcaaaaaattaatgaatctaggagctggttttttgaaaggatcaacaaaattgatagatcgctagcaagactaataaagaagaaaagagagaagaatcaaatagacgcaataaaaaatgataaagggaatatcaccactgaccccacagaaatacaaaccaccatcagagaatactacaaacacctctactcaaataaactagaaaatctagaagaaatggataaattcctcgacacatacaccctcccaagcctaaaccaagaagaagttgaatctctgaatagaacaataacaggatctgaaattgtggcaataattaatagcttaccaaccaaaaagagtccaggaccagatggatttacagctgaattctaccagaggtacaaggaggaagtggtaccattccttctgaaactattccaatcaatagaaaaagaggttatcctccctaactcattttatgaggccagaatcatcctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgtaaggctggttcaatataggcaaatcaataaatgtaatccagcatataaacagaaccaaaggaaaaaaccacatgattatctcaatagatgcagaaaaggcctttgacaaaattcaacaacgccttatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctgtctcaccactcctattcaacatagtgttggaaattctggccagggcaattaggcaggagaaggaaagaaagggtattcaattaggaaaagaggaagtcaaattgtccctgtttgcagatgacgtgattgtatatctagaaaaccccatcgtctcagcccaaaatctcctcaagctgataagcaacttcagcaaagtctcaggatacaaaatcaatgtgcaaaaatcacaagcattcttatacaccaataacagacaaagagagagccaaataatgagtgagctcccatttacaattgcttcaaaaagaataaaatggctaggaatccaacttacaagggatgtgaaggacctcatcaaggagaactacaaaccactgctcaatgaaataaaagaggatataaacaaatggaagaacattccatgctcatgggtaggaagaatcagtatcgtgaaaatggccatactgcccaaggtaatttatagattcagtgccatccccatcaagctaccaatgactttcttcacagaattggaaaaaactactttaaacttcatatggaaccaaaaaagagcccgcatcgccaagtcaatcctaagccaaaagaacaaactggaggcatcacgctacctgacttcaaactatactacaaggctacagtaaccaaaagagcatggtactggtaacaaaacagagatatagaccaatgtaacaggacagagccctcagaaataacaccgcatatctataactacctgatctttgacatacctgagaaaaacaagcaatggggaaaggattccctatttaataaatggtgctgggaaaactggctagccatatgtagaaagctgaaactggattccttccttacaccttatacaaaagttaattcaagatggattaaagacttaaacgttcgacctaaaaccataaaaaccctagaagaaaaactaggcattaccattcaggacataggcatgggcaaggacttcatgtctaaaacaccaaaagcaatggcaacaaaagccaaaattgacaaatgggatctcattaaactaaagagcttctgcacagcaaaagaaactaccatcagactgaacaggcaacctacaaaatgggtgaaaattttcgcaacctactcatctgacaaagggctaatattcagaatctacaatgaactcaaacaaatttacaagaaaaagcaaccccatcaaaaagtgggcaaaggacatgaacagacacttctcaaaagaagacatttatgcagcaaaaaaacacatgaaaaaatgctcaccatcactggccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctggtataaagacacatgcacacatatgtttattgctgcactattcacaatagcaaagacttggaaccaacccaaatgtccaacaatgatagactggattaagaaaatgtggcacatatacaccatggaatactatacagccatgaaaattgatgagttcatgtcctttgtggggacatggatgaaattggaaatcattattctcagtaaactatagcaagaacaaaagaccaaacaccgcatattctcactcataggtgggaattgaacaatgagaatacatggacacaggaaggggaacatcacactctggggactgttgtggggtggggggacgggggagggatagcattatgagatatacctaatgctaaatgacgagttaatgggtgtagcacaccagcatggcacatgtatacatatataactaaccggcacattgtgcacatgtaccctagaacttcaactatagtaataataaaataagaaaaagtaaaaataaaaaaataaaagagaaatgcatttgaggcaaagcctcttttcctctgtgtagaactgatgatggggtaaaatagaagaaaccacacatatacaccctgatgctgatctagagcccagtagctccagagagctagggaaggccccactctgtgtgggacatttatgtggcctgtgaccacaagaaccgtcagcagcagaacaggtgatgagcatttgttgagtgaatcaaaacagaaatgaaccactgtgcaggttcagctgggttcccctgaatgcatccttgagagggtcctcagtgtgtttgtggacatctagttacaaggcaatcaacatataaatggggatcatcttcccatcgccttcaagaaaaacagaattctatttctgcatgtcatgaagggttctttaggatctgacacatacctgcccttccactcagaggtctgacattttattttcacatctgctccgtggctgcctgtctttgggcaagttacatgaccctgctaatcctcagttccctcatctttaaaatggggataaagatacctatctcaccggcttgtgataattataaaatgagaaagtgcaaataaatccactgtcttttcatcacacatatgccaatccagcatttgtgatttttaaaaattcttactgtatagtttacctttcagccaaaccatgccttcttcaagctgatattatactaagaacttttatctttattgaggtgcttatcagaatatcttgccattcttgcattaactgttagatatcccaactgcatgggaaacaaggacaagcacagtatctttttcatctctctttttcacaggacctgacacatagaaggtgctcagctgaatgtttgccgaagggtcatgtgaagtgtctctgttctggagaatcttgattcccaagagccccagataattcctggcccctactctcctatcccatattaggcagctactctgtgtcagaaactaagccaggggctctgcacaaaaggctgtagttcatagctctgcaaccctggggggcagctattatataaacttcttacaacaattaacacaaatccctcaagtgtaaacatctgatgtctctttaccttcaacccactagggacacaaattgagaacccagcaaccctcatctggcatggaaaacttaagacctggatttcttccacctgcacctgctgcgtttgtagccatcccctcccctcttccagcacctttgttgtttgtatcttaccaggattaaccatactagtctggactctgaactcagaaacatgtagattaaacatttcctagcttaaaaaaatagagtgcagaaagttaaatagttagctctcacatgttgattatttactatgtgaaggcagtatgtagggtttgtctaacattgcctccaattttcccaaatatccggtaaggtgaatattcttgtctgtcttttacacgggaagaagccaagattcaagagggcctcataacttgctgcatggatctgtgattcctgacctgggtacaccccaacactgcttcttcctggcaccaggcacccaaggaatcagttccactagcccccacgcctcagcaaccagcactaggcatggaggggtgcttcctcccaccaaggctgagtgctcagtcacaccctatgagagcaagccaatgaaatggaaaaatagctcttactcctgactctgacatctgccctgcaggtgagagccaaattctcaaattgccaggccaatggcaaataagcccacactatgcacagagggtatcaacacaaagagggttctgtgggaattcacacatcctggaagccaggctgaccctggtagacagtttcattttatcttgtctcagccacatgatgagtggagagagagaaggaaagtgcacagatctccagaaatggggtttgggttcactcttgagaatacccctgggcagtactctgacccttgggcccctctctgtaaacacacaagaacagctaaaatgtctggaaaggggaagggctggttccactgatgcccctgcattcattgagtttcctgcttcccaagtagctgagaggcagctggatataaaaggaacaggctttggagtcagacccagatcaaatccccattctgctacttggtacctgtaggacaatgagcaaggctttgaccttctgtgagccatggtttatctgtaaactaaaggaaatggtagattatcatgaaaattatagataagaatatgaaacagcacatagtagctgcttggcaaatgttagttgccttccctcccttttcccccactgcattcatttgtaatgcctttttttaaaaaaaaatgacagtaagagcaattataattggcacaggttgctttatgagctaaatatgttacagatcaataatacacaatctctggcctggcgcggtggctcatgcctgtaatcccagcactttaggagaccaaggtgggcagatcacaaggtcaggagttcgagaccagcctagccaatatggcgaaaccccatctctactgaaaatacaaaaaattagccgggcttggtggtgagcaactgcagtcccagctactcgagagactgaggcagaagaatcctttgaacccaggaggcagaagttgcagtgagccgagatcgcgccattgcactccagcctgggtgacagagtgagactccatctcaaaaaaataataataaaaaataaataaaaaccacaatctctatttaagccactctcacaggactgactgtaccctatatcatgtcatatatttgacagacagttgcttttcttccttttattcttctaaagaagtccagatgagccccagatacaggttcataccctagatagcctattccaagggttaaaatcaggcctgcttcacatcgaaggcattttgttatgatctgttcataacaaaagctgcctcctggctgttgcctgcagctgaatactgttactctgaagccatcatttcatttgtttctgattgttctgcagtgtttacataccttacatattagcgtgatcttttatagagtacaggcagaggttaagccctcccggatccactttccctctgagggctctttcttcttttttactgtcccttgcctctgtgttacaaaccatttctcttttatagaaattcatttaaatagaaaaacaatttttaagtgttttcttttttttttaacatgaggctcacttaacatttttagaaaatgttgaatatggagaagagggaaaagataccaccaaaatgtgtgattttttttttcttttttcctgacataggaaaatcccattacctctcttgaatttaccaagggacatattccatttagggcatagaaggacctgggctgcctccagacctaatgtggaagaaggtgctgtctgcctgctatttccttgcttctccttatttcaatcttttttttttctccaaaaaaaaaaaaaagtgacttaggaaggatatggacttgtgagtcagatttgggtctaagtcttggttctgccctatgtgtaatcccaggaaggaacttgagttgattttctgaagctcagtttccttttccattaaaactgggagtgactcaggcttgcctagtatcttagctggaagaatgtgtgtgaaactggcccacctttcacagataggtcaccctgctgattgcagtggcttccaggcacccaggcctgggaaagattcacaggcctagtccagacctggcaggaaagaggctgtgagcagttctgcctgccgcagatgtgctggcacatgtaccgccgtgtgctgccccaggtaacatatcaggcagctagggaatgtaggctttcagaccctctctcttcagttctcttctgctgacttcctcccatccagccatcatactttcttaatcctctcatcaatcccctttgttatagagaagatggaagggttaaattccttcaccctcatcacttccactgatatttgataaacacctctcagttcataatacttttgcactcaagcaggggagctacccaggtgtctatggaaagttttgaattctttttgcctattcagtttagtcttctcattttctatctggccagaaatggagaaagtgttttgaaggtcaggattcttcaggtctagacttgtagggatgtatcctgaattcctctgagctaagcctgagaagcacaagtgggttctattgggaaacacttccaaaaggcaatgattgatgcttatgcacagaaattctgacttttagtaaaagatgcttggatataaatcaagcaggactctccttgcctttatacaatatgcggtaaacagggtaaatcctcaattttacttatgcccactgacagatcttacaagtagaaattaacccatctgagtgatcgtgttgattctttctccctcttctctagagccattataacctctgtaccctacttcagaattctaatcaagatagtgtcaagtcttttaaaaaaaagttaaacccccacatgagctccaatccataaataagaaactcaccctggcttgtatggaggtgatgatattaacacaggctacatttctctgggtcactgaatgtacccggcactgtaccaaggccagtaatagactgtgccacatttaatctttacagatctgtaagagaggtcttatttgtcccatttttcagatgaacaccccaaagaccaaggtcacacagcagagactctcggctggagactgccctcaggcatccttttaacggaactctaaagtctgcaggagggagccatttttcctaccagccagtttagaatcaaaaaagagcattggttttgccgtattagagaactaattcataattagtactatgctcactcctggaggatttgacagaaatagaagatatggttctgactcaggatccacctcactacgtgatgtcagagcaacagagctaagactgcaactgatgagtattgtgcagatggagcacgctacctcctcgttagctctctcccctgcacccactctgccccacccactcctcctcccttgcgtgatccatagaatagaccaatatgtgtttacccaccacagattgtttggattgtgaaaaatgcatgatataattttatatctttgaaggcacacagctctcagagctttcaaagctgaaaaccagtctgggctcactggagccagttaggcatttgtatatagaaggccaagtgtggcttcttgtctataggagagagaaaatgtggaggaacttttggaaggcttcagagtttttttggctattctctctctcttgcaaagcaatctgggtgcattaactataaatgaatgagaaacatatggattaaattttatctgtgatcacatatgagtttcaagaatgataaagaataaggaattcagtgtttaaggagtccagaatactttgcaagtaattcaggatattgcaggcaacatttggctgcctccctctatccaaatttgaggactgtttggtagggtgacagacctgctcagtgccctccccacccactcagattgctaaacctcaggagatacctgtggataggttttgtgtgtatcttgttttgctgagactgaaataaagagattgggtttctaggaaaggcaaactctatgagaacactcttaaccactttgaaacccccaaatagaagaggaaaatttggtaagcccgatctttattaaccatgtcttgcttacagataatattagatgtgttttatatcctattattgcccttaatgttagtgtcattgtcctgttaatgataatggtagccatgtcctgcacttgtgtagtgatctaatttacaaacaggtacacattacctgttaatacacattacagatgtatttgtagagatgtacacttacaacatatgcagagtatgttatgacaagctacaatacaggaattacagagttaagtgaagatgcaggcaggagtacctaacccagcattgtggtagaagtcagggtttatggaaggcttttcagaggagataacattgagttcagtcctacacatgttcgtttgtttgtttgtttgtttgtttttgagacggagtctcaccctgtcgcccaggatagagtgcagtggcacgatcttggcttactgtaacctccacctcctgggttcaagtgattctcctgcttcagcctcccaagtagttggtactacaggcacgtgccaccacacctagctaatttttgtatttttagtagagccagggtttcaccatgtcagccaggctggtctcagaactcctgacctcccagtgatctgctggccttagcctcccaaagtgctgggttatgcatgttcttaaaagaatatgaataagtaagtggctgggtgcagtggctcatgcctgtaatcccagcactttgggaggccgagacgggcggatcacttgaggtcaggagttcaagaccacctggccaacactggtgaaacccatctctactaaaaatataaacattagctgggcgtggtggcatgtgcctgtaatcccagctacttgggaggctgaggcaggagaatcacttgaacccaggaggcagaggttgcagtgagccgagattttgccacttcacttcagctgggggacagagcaagactcaaaaaaaaaaaaaaaaaaaaaggaatatgtataagttagctaggggaaagcgagagggagtgccctctaatcagtgagacaagaatttatgaacactaagagttgagaaagaaaatggcacaaggggaatttcaggttcacttaagtctgaggcctagcttatgatgggcttggtgcaataaaaatgatgggggcagaggattgggaaatgataacataggggatttcaggagacaaaaaggtaaaagctacatcagacagtcccatatgtcgtggcaagctgctcaaggactttagtaaggagaatgatagaattaaatttgtgtattagaaagatcattgtggtggaggtatgaaagattctctgagtgacgcttaagagagtacaggatggaggacactatttgggtcagggaaacgagtttaatccagtttcatcacccttgtaataatccaagcaagaaatgatgaagggctggactaacgtagtggcaatagttggaaacaggaagacttgtgtttgaaaaatatttgacagagcaccgtgacctactgtggggcagatgagagcgatgaatgatcaggaagtcaagaatggtatcctgagacagagatacttctgacatgtcaaaaatataacgtgccatccttcatcccagagctacagaacaagacatgtcgattagccatccaggtcaaaggttccatgtggagctcaggagcaaggcctgagtgtgggataaaaattgtcattgcacacataggactggatgagctgaccctaagagatgtaggcagtgagatgaacataggagagaatccaggagggaagagaaagaagagcctaccaaagagacgaagctaataatgagtagaggctggacctgcacccagctctttggacaccaaacttttccaccgtcccagaaagttgcagaattaagccatctgtggcttaacatgccttgagagcatactgtgtcctaggatctttatacacattaccccatctaggacttagacacagctctgtggttaatgagatgatccccatcgacagataaggaaactgagtctcaggtcagcaaatgacctaaccagaaatatccaagtttgtcagactcctaagtctgtgctcatgttactaaaccatgtttctgcctttaagataagatatggctcctcactatttcctgggagaggcagacattaacagctatttacaattcaatctgagaaatgtagaaataaaggtgaatgctgagagcccccattcataaacaaaattctctatgcttttttttttttttttttgtaccatgtggtgatctaggagttggctggattgtgtataaatggtttttctctagtaagacgatagcaccgtccatttggagggtgagatgagccaccatggaaatacccggtcccacacatgcctgtggctaccctctaaaattcccaacctggccggaggcactcaaaacaaaacctcctgttccctcccaggacgactggcgcctggagcctgccttttgcccctgccagaggcttaggccagcctcggagtgatggcgttgcagggaggcagaacaaacggagctggagcagctccccactctgagcccagtcatctctcccagaagaggtgtgagcaggcttctgggctttgtcaccacagggaaactcggctgacgggcacattgccttagatgaaactaagccaatggcatgcactcatggagccagcttgagcatagacaaaaagagaggcaggagcacatggaaagaggcttctaatcccagctccatcatttctgatctttatgatcctgggcaatttgcttaccctcttcatgcctgtgtcttcagctataatatgggctgactgtgtttgactctatagactgtcagggtaactctaagtctgaatgcaaatgtacacctacaagtcacttgatatctgagttatgccccagcccatactgaattccaagtccccctagattataaacttcgggaggacggagactacatcacttattggctctgatgtctgtctttctatatcttttcatgtttaaaacagtagtttgaaatcagtgtgtatccaataatatttactgaatacttaatcagctaatgtaagatgttttagatagtagccattaaatacaactcatgaagttgacagaaaaacccacaataatcttggccacaggttatggagcaaagcaagtactaggggtactaccaacagagcaaagtaagtacttcaagaagccccaggagttagcccaagacaatcccatgaagcccaggccatgtgagggcagagtctgtgttgaaatagctagctgaagagttctgattgaccagctgggctagaacaactcagcttcatgaaatcttagaaaacctcaaagacaaaagagatattaaatatttctagtccaatcaattgattttatagctaaggagagttagttatagagagagaaataagttggtggttcataatttggatcctgaaagccctcctcttctatttactagctatttgacctcctgcagcttctatttcctcatctgtgaagtaaatataataataggacctctctcattgggttgtcatgagtgttaaatgtgataatatatgtgaagaacctagaagagtctgtagcatatgataaatgcaaataactcttagcaatgactattttattatttctatatgatttattattataattgttaactgatttaaaggctcatttcagtgggttttttccccaaccataattgttttaaaattggatttttgagaatcagtaggatctgttgatgcaaaactatacccatccttcaaaccatgcgatcttttatttaaagtaaaatgcagaactttatatggggccccctgaaatcaaaatgtgtttacagcttcatgactctgagccttgtctacatgactgtttctgcccgggctgcccttcctctctgcccaagcaagtatgtcctcctcgttcaaagccttgcttcaaggtggccatctctgtgaaatgctcactcttttcccaggcagtgagttattccttcctttgggctcgtactgcactcctctcttacctttttgtagcacttgccatgttttgttgttatttttttatttctacctggctgccctgtcagattaggaactccctgaggtaagcgaccatgccacttcattagtagtagtagtaatagtaatagtaatattttgccttattgttatagctttattgagctcagtgtctgacatacagtatgcaaccaaagtttttattactgtttttgaagtttttataatgatatttatatcagacacaaagagtacaccagatgtctaagtacagtttaaacaaaataccaaaatgaacaccagtattcccaccaccaaacctgtgaaagagaatattgccaataccttttaagtgtaagtttttaactgtgtgagtaaataaatgttacttgttttcttaattttgcttagtgttttagctctttgaggtaattttgaatcttgatttgaacatgtcccataataagctatttttccaagtgttagcatctgaaaatataagcttttcttctgtatcatcttctactccattattaagcatattgattaaaccaagaccaaggacaaatctagagacccctttacatggttgtgattactattgcctgtggttgttcagccagtcacctgactattccatcatacaagcctcatttcaaggagagctaacgtttatttggtgtttaacatataataaaccattgatatgtgacagcttacttaatctttacaaaagtcccccagcattcatgcattcctcccattttggagttgaggaaactgaggctcagaaaggctaccttacgtaagatcgcctagctgagaattgggcagagtcaggactagaatcacgatgggcctttgtcccgacccatagtttctcttctgttgttcactggtatatcagggaacacttaatggaaactttttagaaatgaagattccctaacctacttgtcatcaaggccagaaggttatgttcagtttgagtaagtctgtgttggctctaatggcccttgctttctgctcttcaaaacagatgaaagactcaaagaagtaatggtagcctaaaattaagactataatttggcagagacaaatatagaacctgatgcctgactgctttcagtttttgtaacactgggcatgttatttaactctctgcctcagtctacatatctgtacaataggaataataacagaatttttaagtgatttaatacctgtaatatgcttagaatcaggcctttactaagtacacagtaagtctcaactattgttgttgttgccaacagtgccgttattactgggaagtcagtgtcctgcatggacacctgtcatcaatgtagtatgatgagctccccttctttagggtcatggagcagtctccaggccaagacagccatcagcatggaaggggctttcacaaaaagatttttaaatatttaggtttgttgcaaaagattaaacaacacataagtacacaagtgtacattctttctctctctctcaaaacaaactaggaattcctagattcttctaagaacacagggtttgagagtgactagaagtactctttgtttccttgctttacacaggatgtctgaggagaagcatgtgctattccagatgagtgggcacaaacagaggtcaactcaaaactttctccctggacagagccaagcaaaaccattctctgacatttctgagcagcaaagcagcaaagccacaatcttctaatgaagtcttgctgcagctgatgcagtaacatccccaaattgtgggacaggggatggggagaagggaggtgaagtgtatccttcctaagcaatttatgcatacaagtaaagagcattatcatagagtttgaggtcaacatctgcctcagttgaaatcccatcgtggtcatccatgtactaaccatagacaacttacacaacctcttggggactaatctgtcaaatggggccaagagttctggaggcaaggggctgcaagacacagaaagagatgacttggctttggctctacctgtgcaaaccctgggtcctaagtggtaatgaatatggactgcctcattcatctcaaagaagctctgggacttaggaaagcaatttctagaattggcacgtgataaaattttcactgggcaaagaaaggcagagtggtgaaaataagtaccagttagtatgctctccttgtggctggaacattcaccatagctcactcgtgcattctttctctctcatacacacaacactcacactcacccacctgaataatttccatgcatgttttaaatcttaattcatgtaccatttccttggagaagcattccctgtcacctagactgaattaggtacctcccttgtgtgctctcttactaccttttggctttccctcatttacttctcacagttggtaattacatatttgtgtaatgatctgattaatatttttcttaaggtagccagttgccccagtttggctgaaactgaggggttttccagaaggcaagactttcagcgctgaaactgggaaagtcctggccaaacctgcgtaattgttcactctggtctgcttccctctcaagatcggatgctctttgagtacaggcactatgctcttgttcaccatttatctctgtgcctggcacagacctggactgggaactcaggaaacatctgttaaccagtaaagaagtaaatgtatatgttaatctaagctgaacttacttttcttatgaaagcctatcttttttctccctgaaattattctattttgatgttaaaatatcccttttgaaaaactgtccttatttgacaaaatttaaagttcacaatgttatgctgtttttgttttttgccttccttcccccccttcccattttgtggttggaaatcctactgatttgaggaatcacttgtttagtaaagagagaaccggggtagctgaggtcaagacaaataaggtctgtccccatgctaaaatgctagtaatcacttctgtatcctctgggcctagcacattaccaagcacatagtaagggctgagtaaatatttgtgaaatatataaatgaatagattttctgcccagcctcaagacctgctggaatacaacttgtatgcctaactcccttttcttccctaccctctagctaaacatttctgtgaccataaatgtgacttcagcattccttactgctgaatagatgagaaacatgtaccactgcagatgaatgaacacatggtctatccccacccgttctagttcatctctttaaatgctttccttactgttgaagggactgctatggtctgttaaaaaataataataataataaaataaaaaattttaaaaaaatggcactatcttgattactgagagcacctctcttacccacatggctttgttcaagctcctccctctacttggaacacctgtttcactttagcaaaatcctactagtcttttcaaacttagcttatgtccctttctctaagaagccacctctgtacccttccacttgtcaaaagtaaaatgagaacaagttagggaaaaatttgaaagttttctatcttacaaaaagtaccaattgccatcagcaagacttcaagtggtaagaagctcaccttacggcagttacagtgcagtttatgaagcattaaggagaaagtattttgacctttttagtcattggctgttatgtattaacatttttttttcaggggaaacaggactgtttaaactgatttgtctatagttgattgatttaattttcctgaatcatgctgacaaggacctaaagcttatgttttaatttcatcaaatcatgctgacagggagataaagcttatgttttatgctttgtttataatgagagctagcaactcagggaaatcagaatgacttaagttttaccacttgactctgggcagttggccttggggtatatatctaaatggcggcctctatctttgtataatctttagtacattcctcacctcctgtgcccatccacaatattttgtattttgtctttaccatctcatgaaccacactatattctatttgtctatttttttgtatagctcctccactagatgggagcttcttgaaagtaagaactctgattcatctttgtgtccccagcacccaatagggggacaggattgctattaggtagcagtacatatttgtaaaaggaaagaaatctatcagttattatagtcccccaaatgctaagttacagacaaatagaaaaccttagtgacaaacaacagtagacatttatttttgctcacaagtttgttggttggctaggtgagtctgatgatctgggctagtcaatgctggtcacctacaaatatttgctgatgttacctgggttctttcatatatgtgggacatcacctgagacaactgaacagactcagctctgttgcacatctcctgtcacccagcagccttgtagggcatggtcttgtggccaagtttgaggagcgaaagacagaacagaagcacacagcccttttgagacctaggcttggaaaactgacccagtgtcacatctgcctcattctcttggcaaaacaagtcacaagactggcatagattgaaggggtagggagatagacccacatctcaatgtgaggagctgcaaagtctcattgcaaagagtgttgacacaggaagggtggagaatggggaccacctttgcaatctctgccatagtgagggagccaacagggaaacaccttatcagtttctttccaaaatgaccatttttattaccttaacatttaaatgaatttatcaggaaagtttctaaaaaaaggagccatggcctttcttgggagagagtgacttccccaccataaaaggcattcaataagaagctgaattccatggtcatagaaatattaggaggagaacccttcccctacccctgagagtcaatgttttcacatattttccatctttctttccagatcagcaaagacccgatttttgtaccaggcgtctgggggccttatttctcagccatggtacctgggttctggctgaatgaaggtggtcagagcgttactggaaaattggtaagttgacactttctcaatagggtcatggatgtttttatgtcattgattagtccattttgtcacatgacccatatacccaatatctggaggatttgcagacccctgaatcggggtgtactttctcttagtgcacagcctaacatgtcatacacatgcagcatatattgcttaaggaagaagtgttacagcaggcagtgatgaccagcccttcttctcacctgatctttccttacatcaatccatttttctcagagtgatgagaatgatattctacttagagaaaacgacatgttactccccagcccaaatccttcagttttccccatagccccttgagacatggctcagataatattctggctgcattatacacttcatggtctatcccctccagtcccacacatgtgcctgtaatttacactaggttgctctcctcacagcttctccatgcctcctgtcattgcacttctctgtccctttatacaggcttctttccctgcttggggagttctttaccacctcaataattttacttgtcctttaagatccaactccagctcttagcacactctgttattcttattggttactaatccccttttctagaacactctgagttccttaaagacaagggccatgcggtacacagtggctcatgcctataataccagcactttgtgaggctggggcgggcagaccacctgaggtctgaagctcaaggacagcctgaccaacatggtgaaacctcatctctactaaaaatacaaaaattagctgggctcgatggcaggcgcctgtaatctcagctactcagatactctcctaagacaggagaatcacttgaatctgggaggcacagattacagtgaactgagaatgcaacactgcacttcagcctgggcgacaagagcgaaactccgtcttaaaaaaaaaccccacaaaataaagacaagttctctttgtatccacctcagtgccaggttcatagaaggtacttaatacaaacttgttgaattattaaggctgtccaataggggagagagaagattcataaaagtgagatgagtgctgtaacagaagtacacggtacagagttggcacaaagctaggttaggaaactctttacaggggagaaggcattggtgctgagccttaaaagataaataaggacaaaccaggtaaagaagggtacagatagtctacttggtaggaaacttgtatgggaaaaaagacatggaagtgaaaaataacggctaatttgagggtaatggcaaatagtccagaagttcagctgtggcacaaactattcttagaaaaatggcttacgataaaagttagagagtagggcagagaccacatccctgtaaaacatgctaaggaattgaacttcgtctagcagaccaagaggaaccagtgaaaggttagaagagtatgtggacatgttcataactcagttgtaaaaatctctgcttagaagccatgagggtaaaggcctgaggacacatggccagaggcagggagactagttttagtaggttagtcaacagacaaaaagccacaaggacttgaatgaggacagtaataatgatgactgggaattgaggtcaagagattggcaggcttctgagagatcaaatgtggaatacagagaaagtgagacctaggctcagttacacacactcacatttactgttaaattggaaatatctgcttatgttatgatgtgatttgcctaccaactcttctaaatgttcagccaattggaaatgatcttattcaaagctggatgtatatgcaaatatctgtgagtttacatttcttagtataatcctattttatacatgactgcctcaaattctctttcaaagtaaatggaagcataggtgggtagatggattcaaagggcatgttctgtacgttactgttgtgccaggctacagaaatgaattaaatgaattggacctcatcagtccctggttttaaggagctcatacttggatggggaatccctgagtatgaaataaatcatgtttgattggtctcagtaaccagtgctagaaaagttgagaaggaagacatcatctatggctacagtacagtagaaatgcagcccactttatattctcctatttaaacttgtgctatgtacttagtcaacttattttattttactttcagttccgggatacaagtgcagaacctgcaggtttgttacataggaatatgtgtgccatggtggtttcctgcacctgtcaacccatcatctatgttttaagccttccatgcattagcaatgtgtcctaatgctctccctccccttgcccctaactccccaactggccccagtatgtgttgtccccctctctgtgttcatgtgttctcattcttcaactcctgcttatgagtgagaacatgcagtgtttggttttctgttcctgtgttagtttgctgaggatgatggcttccagcttcatccatgtccctgcaaagagatctcatgcctttttatgaaggcatagtattccatggtgtatatgtgccacaatttcttaatccagtctatcactgatgggcatttgggtcggttccatgtctttgctattgtaaatagagctacagagttccaagatggccgaataggaacagctccagtctacagctcccagcatgagcgatgcagacgaccagtgatttctgcatttccagctgagatactgggttcatctcactggggcttgtcagacagtgggtgcaggacagtgggtgcagcccacagaccgtgagccgaagcagggcgaggcatcgcctcacccgggaagcacaaggggtccaggaattccctttcctagccaaggaaagccatgacagatggcacctggaaaattgggtcactcccacacggctactgcgcttttacaatggtcttagcaaacggcacaccaggagattatatcctgcgcctggctcagagggtcccacgcccacagagccttgctcactgccagcacagcagtctcagatccaactgcaaggcagcagtgaggctggggtaggggtgcccaccattgctgaggcttgagtaggtaaacaaagtggcctggaagctctaactgggtggagcccacctcagctcaaggagacctgcctgcctctgtagactccacctctgagggcggggcatagctgaacaaaaggcagcagaaacttctgtacacttaaacgtccctgtctgacagctttgaagagagaagtggttctcccagcacagggattgagatctgagaatggacagactgcctcctcaagtgggaccctgaccccctcagtagcctaactgggagacacctcccagtaggggccgactgacacctcatacaaccaggtacccctctgaaacaaagcttacagaggaaggatcaggcagcaacatttctgcaatatttgctgttctgcagcctccactggtgatactcagggtctagagtgaaacgccagcaatctccaacagacctgcagctgagggtcctgactgttagaaggaaaactaacaaacagaaaggacatccacaccaaaacccaatctgtacgtcaccatcatcaaagaccaaaggtagataaaaccacaaagatggggaaaaaacagagcagaaaaactgaaaattctaaaaatcagagtgcctctcctcctccaaaggaacgcagctcctcaccagcaacggaacaaagctggacggagtatgactttgacgagttgagagaagaaggcttcagacgatcaaactgctccgagctaaaggaggaagttcgaacccatggcaaagaagttaaaaaccttgaaaaaagattagatgaatgtctaactagaataaccactgcagataagtccttaaaggacctgatggagctgaaaaccatggcacgagaactatgtgacaaatgcacaagcctcagtagccgatttgatcaactggaagaaaaggtatcagtgatggaagatcaaatgaatgaaatgaagctacaagagaagtttagagaaaaaagaataaaaagagacgaacaaagcctccaagaaatatgggactatgtgaaaagaccaaatctacgtctgattagtgtacctgaaagtgacggggagaatggaaccaactgggaaaacactctgcaggatattatccagaacttccccaacctagctaggcagaccaacattcagattcaggaaatacagagaatgccacaaagatactcctcgagaagagcaactccaagacacataattgtcagattcaccaaagttgaaatgaaggaaaaaatgttaagggcagccagagagaaaggttgggttacccacaaaaggaagcccatcagactaacagctgatctctcggcagaaactctacaagccagaagagagtgggggccaatattcaacattcttaaagaaaagaattttcaacccagaatttcatatccagccaaactaagcttcataagtgaaggagaaatgaaatactttacagacaagcaaatactgagagattttgtcaccaccaggcctgccctaaaagagctcctgacggaagcactaaacatggaaaggaacaactggtaccagccactgcaaaaacatgccaaattgtaaagaccatcaaggctgggaagaaactgcatcaactaacaggcaaaataaccagctaacgtcataatgacaggatcaaattcacacatagcaatattaaccttatatgtaaatgggctaaatgctccaattgaaagacacagactggcaaattggataaagtgtcaagacccatccatgtgctgtattcaggaaacccatctcacgtgcggagacacacatagtctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaaccatcctaaatatatatgtacccaatacaggagcacccagattcataaagcaagtccttagagaactacaaagagacttagactcccacacaataataatgggagacttaaaccaccccactgacaacattagacagatcaacgagacagaacgttaacaaggatatccaggaatagaactcagctctgcaccaagtggacctaatagacatctacagaactctccaccccaaatcaacagaatatacattcttctcagcaacacaccacacctattccaaaattgaccacatagttggaagtaaagacgtcctcagcaaatgtaaaggacagaaattataacaaactgtctctcagaccacagtgcaatcaaagtagaattcaggtttcagaaactcactcaaaaccactcaactacatggaaactgaacaacctgctcctgaatgactactgggtacataacaaaatggaggcagaaataaggatgttctttgaaaccaatgagaacaaagacacaacataccagaatctctgggacaccttcaaagtagtgtgtagagggaaatttatagcactaaatgcccacaagagaaagcaggaaaggtgtaaaattgacaccctaacatcacaattaaaagaactagagaagcaaaagcaaacacattcaaaagctagcagaaggcaagaaataactaaaatcagagcagaactgaaggaaatagagacacaaaaaacccttcaaaaaatcgatgcatccagaagctggttttttgaaaagatcaacaaaattgatagaacgctagcaagactaatgaagaagaaaagagagaagaatcaaatagacacaataaaaaatgataaaggggatatcaccaccgatcccatagaaatacaaactaccatcagagaatactataaacacctctatgcaaataaactagaaaatctagaagaaatggataaattcctggacacatataccctcccaagactaaaccaggaagaagttgaatctctgaatagaccaataacaggctctgaaattgaggcaataattaatatcttaccaaccaaaaaaagtacaggaccagacggattcacagccgaattctaccagaggtacaaggaggaactggtaccactccttctgaaactattccaatcaataggaaaagagggaatcctccctaactcattttatgaggccagcatcatcctgataccaaagcctggcagagacacaactaaaaaagagaattttagaccaatatccctgatgaacatcgatgcaaaaatcctcaataaaatattggcaaactgaatccagcagcacatcaaaaagcttatccaccatgatcaagtgggcttcatccctgggatgcaagactggttcaacatatgcaaatcaataaacgtaatcctgcatataaacagaaccaacgacaaaaaccacatgattatctcaatagatgcagaaaaggcctttgacaaaattcaacaacccctcatgctaaaaactctcaataaattaggtatttatgggacatgtctcaaaatagtaagagctatctatgacaaacccacagccaatatcatactgaatgggcaaaaactggaagcattccctttgaaaactgtcacaagacagggatgccctctctcaccactgctattcaacatagtgttggaagttctggtcagggcaatcaggcaggagaaggaaataaagggtattcaattaggaaaagaggaagtcaaatttttcctgtttgtagatgacatgattgtatatctagaaaaccccatcatctcagcccaaaatctccttaagctgataagcaacttcagcaaactccccggatacaaaatcaatgtgcaaaaatcacaagcattcttatacaccaataacagacaaagagagagccaaatcatgagtgaactcccattcacaattgcttcaaagagaataaaatacctaggaatccaacttacaagggatgtgaatgacctcttcaaggagaactacaaaccactgctcaatgaaataaaagaggacacaaacaaatggaagaacattccatgctcatgggtaggaagaatcaatatcatgaaaatggccacactgcccaaggtaatttatagattcaatgccatccccatcaagctactgatgactttcttcacagaattggaaaaaactactttaaagttcatatggaatcaaaaaagagcccatattgccaagtcaatcctaagccaaaagaacaaagctggagacatcacgctacctgacttcaaactatactacaaggctacagcaaccaaaacagcatggtactggtatcataacagagatatagaccaatgaaacagaacagagccctcagaaataatgccacatatctacaactatctgatttttgacaaatctgacaaaagcaatggggaaaggattccctatttaataaatggtgctgggaaaactggctagccatatggagaaagctgaaactggatcccttccttacaccctatacaaaaattaattcaagatggattaaagacttaaatgttagacctacaaccataaaaaccctagaagaaaacccaggcaataccattcaggacataggcatgggcaaggacttcatgactaaaacatcaaaagcaacggcaacaaaagccaaaattgacaaatgagatctcattaaactaaagagcttctgcccagcaaaagaaactaccatcagagtgaacaggcagcctacagaatgggagaaaatttttgcaatctactcatctgacaaagggctaatatccagaatctacaatgaactcaaacaaattcacaagaataaaagaaacaaccccatcagcaagtgggcgaaagatatgaacagacacttctcaaatgaagacatttatgtagccaaaagacacatgaaaaaatgctcatcatcactggccatcagagaaatgcaaatcaaaaccacagtgagataccatctcacaccacttagaatggcaatcattaaaaagtcaggaaacaacaggtgctggagaaataggaacacttttacactgttggtgggactgtaaactagttcaaccattgtggaagtcagtgtggtgattcctcagggatctagaactagaaataccatttgacccagccatcccattactgggtatatacccaaaggattataaatcatgctgctattagacacatgcacacgtatgtttattgtggcactattcacaatagcaaagtcttggaaccaagccaaacatccaacaatgatagactggattaagaaaatgtggcacatatacaccatggaatactatgcagccataaaaatgagttcatgtcctttgtagggacatggatgaagctggaaaccatcattctcagcaaactatcacaaggacaaaaaaccagacactgcatgttctcactcataggtgggaattgaacagtgagaacacatggacacaggaatgggaacatcatacaccagggcctgctgtggggtgaggggagtggagagggatagcattaggagatatacctaatattaaatgacgagttaatgggtgccgcacaccaatatggcacatgtatacatatgtaacaaacctgcaggttgtgcacatgtaccctaaaacttaaagtataataaaaaaataaataaaatattataatgatggtaatattaattgtaataattgtagcttactgagtatttttttgtgagagggatttatagacataattctgttaaactttgaatgatagtcataattacaatgcctaatattattttgaaggcttgtttccaatctcagttccaagaacttttcatgtattatctaattaatattctcaaaagtcctatgatcatacctatagatacagtcattatctgtattttatagttaagtgactaaaggtagcaattacagcctggagagtctcctcacccaccagtgatggccttttaatatgttttatttactactcacctttccttaccatttactaattcttgtttattctcttgtaaattccaatctctggttttaaaatacatcattgtcacataggacatgataagaaaaagttgcatcttttttattcccgcttgcatatgcacatcttctctaataagccacatctgaaggtgtctgctccagtagtacattgtccatggtttcaacgatgccacacagtcataaatacaccacctaaagcataagagacgggaagtgagaaaacagagaaaaaggaaagtaaaggagaagaaacaatagaaaaaaagagaaggaaaagaaatgaaaaatatattaaaaaccatggattttaaaaaaagatatttgtctcatttttacaattaaatgcagatcttccattacaaagcaattatttcattctaagtatgtgaatagatttgtatttttaaaaaaaatcttcatctggttatcctcagaatgaaggaaaagaaacaggacaggatcttttgatatttacttcttcttagaaaacacatactcccttcctaaggatgattgattttagtttcatcacacatcaaggcctgtctcatgcttgccgatattctcttctgaatagttgtgcaaaaaagcattgctttttccccagactttgtccacagaacactgaccccgtgcagttcctacatccagatactgaagcttatttccagctggaccttggccatcaccctttccaggtgctcttgtttgtctcacgtggagtgatttttattggggatggcattgggtaaggaaggctaagacaagttcctaagccactgctatggtggcattgactttctggaacaattgtgcttggattgagtcacaaggtcacaatgcaacaagttactatgtgctcttgggattttaggatgtgtacattgtgagtgtctatctgcctcctgcgtcattgccaaggctgggactagcctcaggatgtcacctatggaagacattctgctataaatgggtgtatggaatgacttgcagtgtgcacagtgtagtacagattatggagataatgatttcatgccttcattcattcactccttccatcgcgttacagagatttcctgagtgattccactgggccagccaagaatacggtcactccagtcatccaccatcaaataagaaagttggatacagaactgatcattataatttattgtaggacataaaaatagatagtacaatcactatagcctactggaaaaatagaggctaatactgagtacctattatgtaccaaatatttttaggcccattaggatttggtatttcatctgatcttcacagcatgtgtatgtggtcagtgttgttatattagttttactgatgaagaaataggctgagaatgtcaaggtaatctgatcaaaatcttacagttataagtaggagagccacaatgcaaacccaagctggccaccagaggcccaagatctttccaaaactgaatctgacttttgtggaggtgcatttctgagtttttctttcagttctcttgtagacttctttgagaagcaactgttgtccgttaacatgacattctctttaagtgtcttgaaacaaatacagttggcaggctttgtaaggccatgggagaaaaataattaaatacaataaattaaatacaatatctgaaatacatatatagtagatgggcctaagagctgactggagatgacaaaagtgtcctcagtgagaatgagacttagactgggagacttagagagaaagagagagagagagaatatgaatgagaatatacactgaaaaaattaacaccctcagtctctcaggggcatgggagacaatagccaaaggtcaattagcattgacacgatctatgtacagatgtaggtgtgtccccagcatttcacatccactaattataattacttcatggatacaaggactaactctgcaaaaacaaatgcctccctgttcccttctcccgccctggcttttgcttattttttgtatacccacctggattgctacacaacttcctaattggcttcttgcctgtaatctttccccctctaatccctttgttgcattgtaggtatagaagtctttctgaaacagttatgagtctgtcacttgtgatagctcttcagttgtcattagaataaagtcttaattctttagagtgatgtttatttatacagccagtatttacggagtgcttactatatttgaggtactgttctgagtgagaaagtagcagtgagtaaaacagcctcttctgcactctcctgcactccaccaagactcctgtacccttctcaagcttacattctaacaggaggagacagataatacacaaaaaataaataaattccactttatggtataagttattaagacaaatagaggaggtagcttgtgagttcagatgggaaggttgtagttttaaatagggtggtcagggtagacctcactgatgtgacagttgaacaaagaatgaggaaaggaaggaatttagctattttgaaacctgggggaagaatataccaggtcaagggaacaaccagtgtaaagattctgagagggttgcttgcctggggtattatgggaatagcaacaaggtcacaatggatgcggcagagtgaaccaaaatgacagttgcagggaacaagttcagagaggtgatagggtctacattattggccacagtaatagtttttactctcagtgaaatggaaaccattggagaataatgagcggaggagtgatgtgatatgacaggttttcaaagaatcattcttactgctgcctactgtgttgctgattgttaactggggagtggaagtagggggagggaagcacagaagtcagaaagaggctattgtagtaagccagctgagtgaggaggatgatggcatggagctggtaaagaatggttagattttggatatattttgaaggtagagccaccttcaaaccttgaccttgaccttcacaccctgatggattaagtgtgaagtgtgcagaaaagagagaggccaaggcttgaggaatgtagcattgctattaatgggtgaaggtggattcaatgttatggagtcagagggaggaaggagtcaagaattactacgttttctgatggtagtaactgatccccaaagttgaccctccattatcttccttcatcttagtaaagagtaccatcatttatatttttattaaagccaaaaaataaaataaaaaattaggattaattcttgactcttcctttcccctctctcctcacatctaatccatcagtaagtcctaagggttccacctccaaaatatgttgccaatccatctctcttttttcttctcttttcttttcttttctttcttccactcctagcactgttgggcaaatcaccgtggcacttttcctctcctggtctatgtaaagtatattttttgtacacagcatatagttgggtcttgcttttcaattttatgatctctgaattttacttgggttgtttagatactttatataaagataaatatgatttgatttacatctttcattttgttttttgttttctgtgatcacttctgtctttccttcctgacttcttttggattaaatgactatttttcaattttaagaattcaattttaagttatctattggcatcttggctttctacacatctttttgcattattttttaatggttgctctagtaattataataaatatcctaaacttttcagcctactttgaatgcatattatgatacttcatgaaaggtataaatacccttcaactgtgtagttctacttaccactcctatcccagctcttcacgctgtagtttgtgtgtgatatctacatatgctataaacccaataatgaaatagttgtcatattgtttgctttaaacaatgtattagtctactcttgactaccataacaaaataccacaggttgggtggcttaaacaacagacatttatttccttacaattttggaggctaaaagtctgtgatcaaggtgctggcaaatgcagtttctggtgagggctctcttcctaacttgtagatggctgccttctgtgacctcacatggccttttctcagtatgtgtatatgaagagaaaacggttgtattccttccttttcttataagaacaccagttatatcagattaaggccccactgtcatgagctgtttaaccttaattacccccgtaagagccatatctctaaatacagtcacatttgggattgaggcttcaatatatgaatttgaggtgaacacagtttagtccatgtcaaagatacataaatgttttaaagaaattctgagaaataaaccatagtcttttgtatttacctacataattactatttttattgcttttcctttctttctgaaaatttgagtttccatgtgatatcttttcccaagcctaaagaacttgtcttagcctccgtctcaaaaaaaaaaaaaaaaaaaaagaacttgtcttagcatgtcttacagtgcaggtcaactggcaaaagacattctctctattttttttcaatgcatttattttatatgctgccttgaaagatatttttgctcactatagaattcttgatttacaggtttttttttccatcagcaccttaaaatgttagtattttctattctgacattattatttcttataagaagtcaaccattatttttgtcattctttccctttatataatatgtcatttttttcctctggctgctttcaaattttctcttaatctttggcttttattacggtatggcgtggtcttctttggattcatctttcttgaatttgtaagttgattcctttcaccaagtttgggaaattttcagcatttaatttttttttgtttgtttcttctccttgctctcttccctcttactgtgactccaattccacatatatggtacctttggctattgtctcccatgcccctgagagactcagggtgttaattttttcaatatatattctcattcatattctctctctctctttctctctctctaagtctcccagtctaagtctcattctcacgaggacacttttgttggtcatctccaatcagctcttaggcccatctactatatatttatttcagatattgtatttaatcaatactattacatttgtattttaatagtttgtttctttgctgtttcctctctgtttaataactatgagaatatttttcttttacatccttaagcattgttaaaatacctactttaaaattcttatcttctaacgcctgtgtcacctcagatttggtgttcactaagtggcttttctcttaagtatggattacattttcctgttcctcaatatgtataatgatttggggtcatattttggacattgtgattgatatattctagagacactgtattatttctgtttctcttttgagtattgattttttggtttagcaggcagtttatttggctgaactcaaacttcaagttttgttactctcctgtgatgaacatgtcctaaaatctctgttgcattattttagccttagctggactacttctggtgttcccatgcacatgtaattgagagatcatccagaaattagggtagcatttataggcacagtgttgcattccctttctatggctctctctttctgacatcccctccacaacttacttcctagctactatggttgccttgaactctaacctctcatttcttaatcagaaagactgtgtatttctatctgagtattagttatcttgcatgccactgactggggtccacccatgggcaaaaatgtataaaatcaggaaacacacaaagtactgttttttccttccttgtgtctactcctctccagtttctacctggttttggccactttccagtgtcttcagagaactatttgctgtattttgatcagcatttttaattgttatcaaaatgtgtctcatcattcattcattagagatgtcagcattgctctaggcactgaggagtggaaaataatgatgctcttgctttgaaagagctcagagtatagggtaagagacagacatataactaaggattgtaaaagaacttgatagatgctacagtagagtaaggatagaaaatatctgtgccttatattcccattgccaacctgtgatctttgtctgcatttcctattctccatgcctggtcatctccctgtcctttatacattaccaaatttttcttaacttttcatcatttttctctccaaatcaaaataatttttatggcctttgatctaataaaagtataaactcttatgacattcaagacacactgtctgccttcgccctctttattcatccttattttcaccagtttactaattctgtaatttaacctacagtaatcctatgaccaatgtatgcacaacacaaatagatacaaatgcaaagtgtggtaagtgccaccaaggagaagtacatggtgctatctgtgtttttcctgtggttcactcatcccacatttattccacaaacttttattaaccacccatgttatgccaggcatgaggctaaaccagtccgttaccattcaaatcatatatgtctttccattttcatgtctctactaaccagcctcctttctgtcatgccttgcctctagccctttactcctccaaactctacctatttatggcctctcagctgaagcttcacctactccaactgtataatgattgccaaatgattgatctctcactttgtgctgctatgcatcataactatttcttatttttcagtgtatctccggaacctaggtgcacagttcctggaggcacattaggcatttagtaaatactaaataactgcattcatgcttacaccacacatgctaggttctagctcactcctggaagctcatttaaatctctcttctctgaactcctaaagcacttcccataaaaattagcatcaaatcaagtaatgcctctaattatccattactgttcccagcgagtttatcttgatgctctcagtggattgcaaactcaggggatccaaagtgtgatgaggatatgcttcatcacagtaatgcaaagttgaacctgaaggagataaatattcaataactgcatgagtttttttttttcattgaaatgaccaatgtctttgatatcattttgaaacatttccacaaaaactgcaccaatggtattcaacaacgtatacctggaagttcagtagacaatatgacgtggtggttaagaacaaggtcttaaaatatagagactgcagtttgagacctagatttgtcgttactttactgtgaccttgggcaagatattcaatctctttgagctcagtttcctcatctccataatgaagaatagtatcttctccataggagtgctataaggaataaatgaaatagagtaatgtgtgtacaatgcttaagttagtactgatgtatgggaaatgagtcagtatatttcacgtgatatcatttatactactgttggcactatagtagtgtattagtccgttttcatactgctgatacggacatacctgagactgggtaatttatacagaaaaagaggtgtaatggacccatagttccacatggctggggaggcgtcacaatcatagcagaaggcgaaaggcatgtctaacatggcggcaggcaagagggaatgagagccaagtaaaacaggaaaccccttatgaaaccatcaaatctcatgagacttattcactactacgaaacagtatgggggaaactgcgcccatgattcagttgtttcccactgggtccctcccacaacatgtgagatttatgggagttacaattcaagatgagattttggtggggacacagacaaaccatatcaagcagacacacttaacttcctagaaatcctgtttaaaaggaggccatggaagttcaaaacagtttagtgacttgcacaaagtcactcagctagtgagactcagagccagaacccaaccctggcctctgtgtctcctgaacaaattatcttctttacacagccctagctctcaggaaacatgctcagagagcctatccctgtgcagccaaaagaccaaatcttttccttgttggaatgaaaataaatctatcagaatggttgttttagcatcctagaaactcaagtaaacattcagaaaatatacagatgaggttcaggaactcaagcacggtgttgcttgggtgtgttatggcaagcagagtaaatgcatggagaaacatttctgtccctgatacatatttcatactattttgtttagagccaccaagtggattaaggaataagatcctagacctgggatttcaaatgagaggtgattatctgcagagctcagacatttctgtccttggagagctgtgtttcccatgtgatgattgttcagtcaggagagtttctcctgacaggtctggggcatctcaattttttttaactgagagtttcaaaaaatttttttaatgagggttttttcaaaaaccctcatcatagtctctttcattcagcttctccattagtaagacacagtgagtaattcaaggtttgacattgcccagggatgacagcctagatcaagaaggggaaatgatgtgatccagaaaaggttggtgcttttaacactcagaccccccccatttgacataagttacccttccttctcattcttgggcctgttgctaacctgcttctaccagtttagccttggaaatttcatttctgtttactcttctctctaaacttctttgttttatgtatttaagaggctagcagtaggttaaatcaaagctaaatttcttttagctgaggcactcttgctacattggcattttaatgttcttggaacccgtatggacaaagagttgaaagaaacatatactcattttaatataaatttttctatcttatacataaattaaagaagctataaaattgacccatgtctcttatttttcagatagaccacatggtacaaggccatgctgcttttccagaactacaagtaaaggccacagccaggtaactgctgtctctgttccctctaaaattttccttgtgtgactgtattgagagaattcacgttgggcagttgggtgattttcagatcctacagacaatgaaaatgcctgttagtgcttgaaagatagtcacctggatgatccagaagatagatgtattaattctttaaatgaggtaagagaacttagagaacctagagataccccaagaatatacccagggactatagataagaaactctgatgtagaagaaggaccatggattctggagtcaaaacttcttagtttcacatcccagccatactccttaatagatacaggaccttgagctagttacttaacctctttatgcctgtctcttcatctgtaaaactgaagataataactgatatggagtgatttctagaatattttgaagcaagctgagtgcaaaaaaaatttacgatatactccctttcatgtaaaaagaaagacataggaaaatacatgtgtatctgttcatttttgcaaaagaaatataggaagtggccaggtgcggtggctcactcctgtaaccccagcaccttgggaggccgaggcgggcagatcacgagttcagagatcgagaccagcctggccaacatggtgaaaccccatctctactaaaaatacaaaagttagccgggcatggtgatgtatgcctataatcccagttacttgggaggttgaggcaggagaattgctcaaacccgggaggtggaggttgcagtgagcagagatcgtgccactgcactccagcctgggcaataaagtgagactccgtctcaaaaaaaaaaaagaaatacaggaagtttaaaccagaaaataataagattagttacctacagggggtgggtaggaatggggtggaaagaatgtgggaatgggaccatggtagtaggaagaaatgacacttctctgagtatacctttttatataactataactcttagaattattgtcatgcctcatgtccctgataccccgataaaataggtgatagataaccaggatatatgtgtatgttggcatgggcaaaatgaaatgcacacagtaaaaactgaacctactgtattacaaagggggttgggaaaagaaaagaaaggaaaagaaaaaagaaaagaacctaagtaaatttgggaaagaatattttgactatatgccatatggctaaagagaaaaataaccatacataaatattatactctaattggtaaatctgtttttcataggtgtatatgttagctatagtgacaactctttatgtgtatgctacagttgagtgaagaaatcaatatattgtggataataagagccaggttcctcacaaatgggaaaaggagaaggttagaatgaacctcatggtgtcaatatcaacttatgattttatatatatatatatatatatatatatatatatatacacacacacacacacacacagctggatataaatataagtaaatatagatatgtatattcatgcatgaatatacatgcatatactccctaggtctctctgctgagatggcttggaagcaatgacacgatagtagcaatgtgtgtacctagctcacaggtactgtattctaagtaccattctcccatttctccaataaaagtaatcaggacttcttagaaagatggctgagtctacgctgcggcagtaaaattatggtgccagaaagaaaaaagttactcaacaaggaattgtcaaggtacattggaaccaactttaagaatctctcagtggcctactcaggataaaataaacagtaatagcgtaaagtaagtccataagtaaataactttgtaagtaaactactgaagaaggaaataaacgaggacgaaatgacaggtcttcctcttcactgtcaggacagtagccttacaattaataaatgtagaagaaataatggaaatagataatcaacattaggtaaacactacagagataaatgttgtaggcaagaatcattaatggatgctaaaattagtgagtaaaagtgggaagcaggatattttcataaacccagaggatttcagtacaagatactgagtaataggaagaggaaaataataactttccagtagtatataagtatggcagacaccaccttacccaagtgatgaaagtaaacaacaccagcaataacatgtagtgatatcatgtatctccttttatgaggcaccgataaagatacaacatcatttctgccatgttcttgcccaaaatgattaaactcagtgtaaatatgggaagcatcagacaaacctagattgacattccacaaagctattagccagtttgctccaaaggaaaattaagaaacttaaatactgaagaactgtcctagattggaggagacttaaggaggtactacagctgtaagcagtatataatcatggattcaactctggaccagagaaaggacattggtggaggaaaactgttgaaattcaaatagagattaatagtattgttatttatggcaatttcttaggtgatgagtaaaagggaactctgtgtattatttttgtaacttttgtgtaaatctaaaattattttgaaataaaaagtctaaaaaataatgaatggattttcatgctgataatgcttagttgtcaggctgtttaagtaaagtaagatatttttatagaattatcagagaaacccatgtagctagctagcacaggacaaaagagagatagtctaaggtggccactaatagactctgaagccaaattgcctttgcctcagctttgtcgcttattcactttctgtttctgggctatttacttaacctctgtgccttagtacctcactgtaaagggaataatagtaaacatttcataaggttgttgagaaaattaaatgaattagaataatgggtgatacagagtgatgattaagagtcaggctgtaataggtgttcaactaaaaaaatggtaatgataaaaattactgttggggaacatcacacaccgaggcctgtcgtgggatggggggataggggagggatagcattaggagaaatacctaatgtaaatgacgagttaacgggtgcagcaaaccaacatggcacatgtatacatatgtaacaaacctgtacattgtgtacatgtaccctggaacttaaataaaaaatgaataaataataaataaataaataaatgattgttgtagttagtatattagacatttccattctactaagtgacttacattctaataggatcagcacacctacacagagcagaataaatgaatactgtagtaaaatatacgtagtgtgttatcaggctgtgtagaaaaggaggactgattttgacaaggagtttaagaaaagcttcataggcattcccttctaggagtctttagttataatgccattgcaattagtcattaattacaattaccattgagagggattatgtcacataaccttaccaactagcatattagtggcatagagaccatataacctagaaaagggattcctaatttcggatcatcaatgaacctctttaaattgtgtactgttctgctgattacataattctgcatgtatttctgtgaagggaccataacggtcattattttcttaaagggtttaagcatttataaaccactaagccaaagaaaagagcactaaatttatagtctggagacctgaatccaaatctcagctccaacatgtatcattgtgtgaaacccattttcttcattataacataggatagtaatggagaatcaacccgaaacacctctaaggatttattttgagtttagaagaggtaatatatttgacggggccttgtaaactgaattgtgacaataatgatgatcactactactctgttagtccattcttgcactgctgtgaagaaatacctgagactgggtaatttataaaggaaagaggtttaattgacttacagttctgtgggctgggcaggcatcaggaaacttacagtcatggtggaaggggaaacaaacacatccttcttcacatggtggcaagagagagaagtgctgagcaaaaggaggaaaagccccttataaaaccatcagatctcatgagaagtcactatcacaagaacagcatgagggtaaccacacccataattcaattacctccaaccaggtccctcccacaacacatgaggattatgggaactaaaattcaagatgagatttggtagggacacagccaaaccatatcaactactactattactactaatgattgtaagaggaggaagtttggtggtggttgctatgggttcaagcagcatacgtcagtcattcataccttgcctgccttcttatggaaagcatggaggaacagcaaggacagggactgtgaattagagtccttgagttcttgtacctgttctgccctgaatgtctcaatgactactagattcttcatccataaattacaataatgataccctacttacttcattttacaggcattaataggatgaaagcaggtcacaggaatgtctgtatatgaacattttagtgtgtaacacaaacttactgaatatttagttttgcaatgacatactctaaacttccagaactttcttctatagataaacttcatttgagtagcttctgttgcaaatcataataaaaagaagaaagaatttatggattaccatgcaaactcagagaaacaacagtatcgggtggttcagaagcagcaacttacagaactcagtgatggagtcagaactggatttaaatcccacctcttttcacataacttcaaacccacttccagctactttcctgtatttctccttctgtttagagtggagtttctccaaagcatcgcctgtactcttggtctctacttctccacttcctactccttccttgcccactgcagtttgaattctgtcaccatcagccccctgaaacgtttcatattaaggttatcagtgacctctattttgctaagtccataggatgttttttattcccctttctttagttctcagcagcatggggcatcagtgatcactttttcctccttttaacattctctttccttgactttctggaatgtcaccctgtctgttttctccctatatctctgattcctccttcctaaccacttttcttgagtttatagtccttttcttgaccattaacattaatttttgtcacagctagcttcctggccctcttctctctttgccatctcttccaagatgatctcagctatgctcttgacttcatttctgtctatattttgatgactcttttatgtccagcccagatacttagtaggtattcagtaaatgttagttcggtttccttccacttttcttttattgtcttacaaaggaaagtgcatctgtgtcttattagatctatgagtacaatattctaaaactatgggaccctttatgcttccggtcttagaaagaaacaggcatagctgtttttgaaatgaagttagctgtttggaagagtggacaaatccttctgaatcaagaaccatgtgtctcttttactatgacttggggctttctgaaaacagcaatgcaggtcacccctatctcagagcttagggtcagcaaatcctgtttgaaactgtggaaacaagtgttgataaacagattgagtattttatactcttgatttacaataatcctcttaggccccatctctgaagagaagtgttttgcaagcttataaattaagtaaacaagaactggatgtgcccgtacatgtaactggtaaccaaagtttctcttcatgtggggccaaatttgcagatatttcactctttagcagagatcaccttatgtcaatcataaattttgactcttttcctctaaacttgattctcttagaggttcttaactaacagtgtctctgaattaggttctggtgacaacagggtttagtgagaacattttggcataatccacaagtgctagattcaaggttggcagcaaagcaaaacttaaaatccagggtctgtggcccatctgtctgatgagtatcttttgagcatttgtgatacatgaatgaaccaagcaaacaaagtctttgctttcataaaaatatacacacacatacatatataaacatgcagtacatacatgcaaatatgcatactatatacatatacacatatgcatatatacagatatagccagccattgataaatgctctaaggaaaattgtagataaataaggagatatagagcattggtttcaaagcccttaatgttgtctttgttgtgctagtgcatatttttttcctcagcctttcttttttcctactttccctgaatttttctgttattcctctgaggacagctaatttttcttgatctgatttattcctcaaacttcttttgcttttgtaattcccataatcccactaaatatcaatttcttaaaattcactagtcctctatatcgcgaatcgcagatagattaaaacttcccattaaaggctgtacaaatccccctcaagcaaagaaagggaaaaaaaggacaataacatttattaagaatctgcagtatgtttggcactgtgcttagtgataatagtttcacgtatattatctcatttaattctagatgaggaaatgaggattattgggagctctcaaacttcacttctaaaaatttttctctctttccattctgctcttttgtattgagagtccccttttagcctttatgactttttaaaccttggaccgtcattctgataactggggtgttgagtctatcactgaatatttacttagccttccctgagctaggacagtcagtgtgataatattaacacctttcattcccccatggtatacaaagataatcagtaaattcttgatggctctgagttcagaaagatttcttacagaaattagctggatattattatacatttctttttttttttttttttctttttttttgagacggagtctcgcactttcacccaggctggagtgcagtggcactatctcagctcactgcaagctctgcctcccgggttcacaccattctcctgcctcagcctcctgagtagctgggactacaggcgcctgccaccgcgcccggctaattttttgtatttttagtagagacggggtttcaccgtgttagccaggatggtctcgatctcctgacctcgtggtctgcccgcctcggcctcccaaagtgctgagattacaggtgtgagccactgcgcccgacctattatacgtttctttggtttctgttttgcatgcaaataaaagaaagtgctcagggcattggggtcttctctagaagaccaagggtctgtgctgatttaggacataaatcctcttattttctacctcccaactggttaccagtagctcagcacagtgcctggtggcataggggcatgtgtagggaagtcataagatgcctgttcctttgccctgtccccatcttctgtatattccagcatgtctggaaggctgtgtccatctgaagggttttagatggtgtgggagtaataatcaaggttgcattgtagaagaaccaatcaggaaagagtacagaaagcctgattggacattcttagttgagttgtctttggacatctaagaggaggcatttgaagagtggttggatacttgacctggaactcataagaaagaaatggacaggagttaaggtcatatatttggaagtcctcagcactagatggtaactggagcaatgagaagaggttaggatcatccaagaggagataaagagtaagaaaatggtgaaagacagtagatctctggaagacgtcatatgtttaatgaacaagtgaagaaggagaaacagccaaagaggagggaggaaaatcaagagagaatagtgtttcagaaacaagagaacaaatgaggaaggagtggtcaaatgatgtaaaatgcccaaaatgattcatcggcattaacaacaaagagggtattgttcctcatggtagtaccagtttcagtagaatggagcaggcagaatgcatagtgtattgggttaagaagtaaggaactaggccggttgcagtggctcacacctataatcccagcactttgagaggctgagacgggcggatcacgaggtcaggagatcaagaccatcctggccaacatagtgaaaccccatctctactaaaaatacaaaaaatttagctgggcatggtggcacacgcctgtagtcccagctactcgggaggctgaggcaggagaatcacttgaacccaggaggcagaggttgcagtgagctgagatcacaccactgcactccagcctagtgacagagcaagactctgtctggaaaaaaagaaaaagaaaaagtaaggaactagagacaggcaatatggaagcttcttttctaagactttctcttgttggtagaaaaggcacaagtatattttgttataccatgtattctgattttttggtttaagagtatgaccaccatactctctgggcagcctgtgaacccatagaattaggtgatttatggagagggagaggacatgagagatttcagggatgttgtctgcatttaagatcacaagcaataggtccgaaaaaaaaaatcttctttgattcttggatttttaaaaaactagaaatgagtttcttatgatggcaaagaagaggaaactatttattgataaacctgtcattttatagtgctcagggctctatgtttaatcttcatagcagcctttaagtagacagtattagccccaatagcaaaaaagcaaataggctcagagagggtttgcctacctgatcatccagctggtacgtggtaaagtcactttatgattattgaaactatattttcttcatgatacccagtgggatgtggacagcaaaagtttctccttttgagacaggatatatcaacctggggttcatgagagagagggtgagcgatccacttgggatcacagttaatatgtgattccctagctagaagaaggcaggctgccatttgagaaggaactgataaaacatgcaaaatgacacaaagtcagaaccaaaaaaggcatcatgcaaggttaaaattatgtgaataatgatgtgtattagttagtttaatgtcttccaagtgcatttcattttgaatgatatactcagatagcacacatggtaaggtataattgaaaaaacatgtaggagaatggctgcattcaaagaataaacatacagctgcaaggaggttaggagtcaaaggggtaagcatatgccccatccctcagggatctcattagtgcatgagtggccatatatgtagaggctaaatgaatctcactgtttgcaaagacctgcagtaaatgagacaatgacgaatcaataataattaggcctatacgttcttattgacccagatgtctgaaaccaaatgccctgctcagagattccttgagaggcagaatgaaaagatttatagacatgcgtttccaaaaaaaaaaaaaaaaatccctttactttaagaacagtggctattctgaagtggaaagtcgcaagaattagtgcagactcttgacttctggctagaaaagatgttctcaaggcttttcttgtgaatgtgattcctgttggaccaggagcagagagagcaaagagatggaaaaccaggaggttatcatattcgtgttcgctgatacgttgttctggctgtaccttgtatggaggcttcagaggatcctttcctgaagccataatagaatcattctaaaacagggtttgtgtttttagggctttgataaataatttctgacctaagatacagaaagtccatggcttcagaatcacaaggagaagggtttaaagctggactcagacctgtctcttcacctcttgaagcatctcctctgtatgttagtggtacctccccaactgggcagtgttggaaggtctggtgtacatttagggaatggcaactggtgttaactgtagttgttaagccttttcccagtaatatcttattcctcctaataagatctaaggaagaagatttttgcagatgagaatgagctattacagcaagaagcaaataaactgctggtaggtagggcggttgggctgccctcacctccaccctagtacacatcacacgcactcacacacacacacatatacatgcattcacatttacacactcactcatgctcacacagagcagctttgcttttctatatttttacattgaatatttacatacaatttttgtttaataaaggagttctactggacgggtgtggtggctcaagcctgtaatcccagcactttgggaggccgaggtgggcagatcacgaggtcaggagattgagaccatcctggctaacacggtgaagccccgtctatactaaaaatacaaaaaaaattagccaggcgtggtggcggacgcctgtggtcccagctactcgggaggctgaggcaggagaatggcgtgaacccgggaggcggagcttgcagtgagccgagatcgcgtcactgcactccagcttggtgacagagcaagattccatctcaaagaaaaaaataaaataaaataaaaaataagtaaaggagttctactggtaaatggggaaaaaaagagaatttaaaaatcaatgctctactcattggtttgtttccctacaccaagtacaggaaacttttggcaacttcatgggatccatgggatcactcacccaatcacaaactagaactagaaatcactgagccttccttctaaaacacttttaaaatgcaaagcataaataatgccttaggtatcttagatattaacctcctttggatattgatttcctatacttttttttctgccattatacaagccatgtttttaacctttaaagagacttccaaggaccccagtgggaagtagcacagatgccaactactgcaatatccactttcttttgaaatcattggttcagaacttttagaaagcagcatcttttaagaggggaaggttgaccagctttcatctttgtgtcatgtggtgtgatttaacccggtgaggtaggtgttattaaacctattttatgagtgggaaaattggaggtcagaggttaagtcactggcccattttaccgagctaggagaggtagtatcaagatttgaactgagtagtgctctcatgcccatcatcttctctccacctcctcttcacctgaacatgtaaagaatgaaggagttggtttgactccctcattctacacatgaagaaactgagacttaaaaaggagaaaaaaaaccaggcgaggtggctcacacctgtaatcctagcactttgggaggccgagatgtgtggatcacctgaggtcaggggtttgagaccagcctggctaacatggtgaaaccccgtctctactaaaaatacaaaaattagctgggtggggaggctgaggcaggagaatcgcttgaatctgggaggcggaggttgtagtgagccgagattgcaccattgcactcccacctgggcaacaagactgaaactccatctcaaaaaaagaaaaagaaaaaacgtacacaatgtcatctggtgggtttaggttgaaaatcaggtctctaactcctgatcctaactgcatttatgacattcagtcactttacttagcaaaatcctatcctgagtctgggaacttataatttctctccatttatcaactcatcatcattattacaattaggaatactgattttaataaattattgacatatgaccagtactgtacagtttacaaaatactgcgccttcacatacataatcttctttgatcttcacaataaccctatgaggtaagttggacagggattatgatatctgtttttacagatgagaagagggtggttcagaaagtttgaataactttctcatggccatacatctactaagagtaaagccattcctggatccagtcttctgactccaaacctttctactaggatgtggcacctttcttggtgatagtacagtgtgatttgagagtacagtgggctagcttctctgaagcttttaggagcctgcttactttcctggatctggaagtacaaatggtttctttctatagaatgatttgctccctgaccctatcccccctttaaaaataaaattcacttctcttccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtaagtaacagctagtccttgcacatgggtgaaggcaggccaaagggctacaaagtttggaagaagcaaagtgaggaaaaaggaaaagaaaaaaataaaacaggccaacagccctctggctttgtgcagatgcattgctgttgctgctccctgggatgagctgctgaaagttttcattgtttctgagccaaccttgaaagcgttaaaagcagcatttcctagttcagctactgctgcctctttgtcctgtggagtggctaaaagtcatgcctatgtaattttggcatttatatcagtttgtaaagtcaaattttccagctgcatctttaggttgcccagtaaatcagtagtaaatattaccacccatggtcttgctggccacagccacacatctgcctaggctctgagtcagggctgttcagattctacactaatatagttaggatttcagattaaactttggtataagtaaatgtaatttataacttatgttggaaaataaatcctgctcttagtgccctttagggtcacttcctctgtggatattctaggctctcctagaggggccagatgaacttggtgggagaactctcaaccaccccagttgagatataaaagtaataacatcttagacaccaggagaatcatgtttgaggtgtgatgaagcaggttaaaggtagaggaggggccaggtgaggccacaaataagaaaataagccatgaatgcaggaaccaggaaaatgtcatgaagctgagaaggtgagtgtgaggtacattaaggcagagttcagaatggaggctgtaaacaaggcaaggcttatgcaaaggaagccgcgtaacagtggagcaggcctgatggagtcaagaattcaagactcaaactactacaattttgtggttagttttattgagattgttttaaatatttttatgatgccagcaggaagacctgaaatttattttcattacctagttgacatgatcaacttctattactaaaagggagtcatggtgaaaagaaaagaaaattagacatgacaaaggttatgttgatctggagtccatgaagcatgcctacacaacaaatcatgagcttggtgtccttttttatagaggcagaagaataatgtccagagagggccatgtggcaacagaccgcaactagaaagtcatactttcagataaccaactctctctgtaaacagggggtaggggaagaacacatttcatatgggtacagaaataagtgtcttaattagagacaaatatctgaagccaaatagagctagatatttaaaatgttgaagcagttaagaagcttgaccagtgttttaaatgaccccaaaacaaagcagtgttgcatagtaaaatggtcattgctctggaggtcatttgttgctttagataaaactgacctaggagccttccctagccaatgtctgtcatacccaaattcagtacccagcatgtcaggcttcatgtctcccagtagcttttatccattttttaaaaccaatcctgacatccaagacctaagaattatcatcagaaggatattctaatacagttgacccaaatgcagaatgaaattccaaagaaatcaatggagtgttctgaagaattctcatatcatgagaataagtatgtatgcaccaaaaggaacttcttacatggggacatatgcccagttgtatctaaaaatcctgggtatgtttacttttttaaaaagttgtatgtttgttcacatacctcatatatcacttggtagttcttggcaatgattccctttataactgtccttgggttaggctgcaatggaacagttatcactccatgaatttgcatcacaacactggaaggagaagatgacctaaataagatagaaggaaagcaattctgagctaaacacttcaccccaaatctccttccttcagtccagttttggaaaacatcaaaataatgaccctgaaattcttctgttatgttatatccttttgctggaaactacgatgatgcctatctccagcactcattcagcaaatattaattgggttcctattgtatgccaggcactgccgtagatatgagtaagatgcaacaatacctaccttcatggagtatgtttaaagttgggagtgggcgagtgcttgaaaaaatgttaataggaactagcaggataattccaataaagcaagatccatgtacaatttcttcttttggcccctaaaacgtttccctggacacagagtaagtgctcagtatatgcttatttataatttataggcaacatagagataataaagaggtcatttgttgccttagataaaacaaacatatgaagaatttaataataccaaatgaattaagtggctactgacactgactatccatatcgtaagtatttaataccaatattaatttccaagtaaatgaagataaactccaattgtatcataattatgagactgtttattcatcaaacaaatacaggccctgttacagttgttgggggatataagagtagctagacacaatcccagccctcaggaatatcaccatctttgggaggcagacaaaatatataaacagggaatggaaagatagtattaagctccagatgtccttcactgtccagagctctccagatgcatggaagacgattgcccaacctggtcccagcggtcaggaaagctccagacaggaagtaacattgacactgagtgaagctgggaagggggtttgaggccaagggaatcatagtatgtgcagtattctagagggaagagagcatggcatgtgaatgtctacaattttggctccttgtatcattgtctaaccaatgatagattgcctttagcattttatcttaataataaaaaaagaaaattttctcggatttctcagagaaccactggatatctgtatattccggctttggcagcgttgcactctcccagttctctactctcccctcaggtgactcttttcttgcattgttaaacatttacccattcactgtgtttttattgaatacctgctatgtgcaggcctgtgctaaacccaggtaatacaaagaaaacagaaaagtacctatcctaagttcacataaaagtaggggaggtaattattgtacatgtgtgtatgtgtgtgtatataatcattttacagtgtgatctctgtaataatcagtgcaagctgaaggagatgctcaatacatgtctgactttgaaattgtttttatgtggcattgggctagcaaaccctgatgcagcctttttctgcttctcttgaaaatatttgtaaaaatgcaaaaaagtcatgaattcatgcaggccttaggaattaggatggtgttcaactaggaaaactagaattggtattcccaattatatgatgaatgcaacttgtttgataacatcatatatgacataagaacaaagtcatgtgtgatccactgtggaaacagtttggacctcgccaccttctgctcccttgcataaaagcacaaggttcttttaaacctgaaaacagcatagctattcctctactttactgctaatggttgggttttttgttttctttttggaaagcagccagtgagtttaaattcctagatccccccacaaccctgttcccagccactctttcagttcattccatttgaaaactgccagctcaagaatccacccaagcaggaagtgtgaattaggaggaagggtgatggcttgcattctaagcatctgttaatggggcagatgtaggaaaggccttagtagttctgtaaacttgggaggaagggtgtagtttgcactactagttctaggctcggaaagccaggcagtgctgatctacctcagtccaacaaagctacagaaaataaaaactgctgtactctgccaactggcatttagctgtagatctgaagagacaaatttaagtatacagtgagtggggataagagcaaatcacggctgtgtgcggtggctcacgcctgtaatcccagcactttgggaggccgagccagttggatcatgaggtcaggggttcgagaccagcctgaccaacatggtgaaaccccgtttctactaaaaatacaaaaattagctgggcgtggtggtggacgcctgtaatcccagctactcaggaggctgaggcaggagaattgcttgaacctggtaggcggaggttgcagtgagctgagattgtgccactgcactccagcctgggtgacaagagcgagactccgtctcaaaaaaaaaaaaaaaaaaagagcaaatcatgtgtactgtatgctgggaaatactgaacatgtgtacctgtctagttagcgtaaatgttgaaaaataatggccccttagaaaaaccattacatacggctggacgcggtggctcacacctgtaatcccaacactttgggaggccgaagcggatggatcacgaggtcaggagatcgagaccatcctggctaacatggtgaaaccctgtctctacttaaaaaagtacaaaaaaattagccgggcatggtggcgggtggctgtagtcccagctactcgggaggctgaggcaggagaatggcgagaacctggggggtggagcttgcagtgagccaagatcacgccactgcactctagcctgggtgacagagtgagactccatctcaaaaaaaaaaaaaaaaagaaaaaccattacatacaaagaaaaaaataccattgtgaacacttaaaggaaagccctcttgaaaattatttactactgaaaccaaaagaaaatgttagagaactttgtggtatattcaatggaatatttttaatttttttttaagagacaggatcttgctctttgtcactcagactggaatgcagtggtgcagtggcctaatcagaacccactgtaaccttgaacttctgagctcaagcagtccttccatctcagcctcccaagtagctaagactacacaggcacatgtcagcatgcccagctaatttttaaaatatttttttgtagagatggggtctcactctgttgccaaggctggtctcaaactgctggcctcaagccgtcttcccacttcagtctcccaaagtgttgagattataggcatgaaacactgttcccagccagaaattttgtttcaaggcatatctctatgaaataggccagaaacttattaggaaagaacaagttaagatgaaaggacaatggaatgagaaaaagggggaaatggcaaagaccacaagacaactaaaaatgcaatcaaagaattaaaacctacattgaaagcaatagggagtataattttcactgaagaaaataagatcaaggctgtcataagacataacatatgttttaaatttactctataggaaaaacattttgaggataggagcaatggcttatttactttttaaaatatcaacagttcttaggtcagaagctggcaccaaataattgccttatggtcaaacagttatttcaatcactgtttgccaaatgaggaatgaacagtgacctgcccaaagtcacaaagccaagaagtggcagcgcttgccttttaggatgcaaactctggactttgcaaaacgcatggaggactattaagaaagggagtttaaacatgcattatacatggtttcatagtgaaccatgttccttaagctagtccttggctcttctgttcttctgaccaccaaccttgtggcttgtcctcccacttttaccctaaccatggtctttggatttaaactctgaccctgtctcttctcagtaaggtactagtttccttcccaccctaactgactcagatttaaaaaaaaatagccactcgtggtttgacctggttctaatgccttccacactaggtgcctaccttggtaagtaggaacaggacataacccaggaatctcttccttatgcttgatagtatcattttctttttgttctggtaacagttgactcctatcatgtgactagctgtttcatttttcttttgatgatacaatatcagcctgaagcactggactaaagagaggtggaggaggtgggggatgagcagcctaatagcatggctggactaggtaccccactatgtaaacatttctcctttccagttgataaatgaagcacagaaaggtgagggctacacatacgattatttaaaagaagcagaatcttaagtaataacagtcggtctcaaaacagtaagcgctgatgattttaggttcattaaaaacaagacagacacgcccccccccacccaaagaaaaatgcttacttttaaagtaagaaaatgacatggtcacacataaaggtagatgaatataggccgggtgcggtggctcacgcctgtaatcccagcactttgggaggccgaggcgggtggatcacgaggtcaagagattgagaccatcctggccaacatggtgaaaccccgtctctactaaaaatacaaaaaattggctgtgcgtggtggcacacacctatggtcccagctactcaggaggctgaggcaggagagtcgcttgaacccaggaggcagaggttgccgtgggctgagatcacgccactgcattccagcctggcaagacagcgaggctccatctcaaaaaaaaaaaaagatagatgaagataaatactcaccatcaggaatagttgcatgttttagggatttttttggtggttatttttattttaaatgttttgttgaatggtttttaccactgcaaagcagtaaagagggcccaggttttgaaatcggacttatgtttgaacttgtcttgaagatataccagtgtatgacctttggcgggttaactctgtgcagctgatctgctcatgaggaagcaggagtggcccaggcttctttgcagggtcactgtcagcgccagacagtaggtgttggcacgatggacagacagcacaacaatgcccttgaattggcagctcctgcttggtggcctttacttgcatctttacgagatggccagtaggatcctgtgtggcttttgaaccctgagcagccagccgtgggcctcccactttagccccagaactgactggactcaccagcccaaacaaccagccagagaagcccaccagtcccttggtcctcacagaaagcaagtttcatacagctcttgagattgatcttctttgttcaagtccttggccctcagtttcctcatcaatacaacaggaaactcaaatgtggtgtaccttatggaatagctagcattgtaggaattttcaaagagtccttgccgtctggtatatatgagcagtttctattcacaaaaaattggcgtggcctttgttttgtggtgtttgggatttttaaaaattattttcctgaaataaccactcaaccactcaacaaagcaatgaccttggagacatatcaggccctgaaaacacaccaaatgcaccctattcatcattggttgaaacatgttttctctgcttcatgttaaaagtacagaactacccagaacaaaaagtgattttctgcttctttgaagagctgtgacttctaacatcagagcgtatgctactcaaactgctggagaggttgaatgctgctccaacaactcttcaaagcaaacacagagatagtgtgtatgtgggagaccaggagagagtcagggaggaagcactgggagatcttagccagtttccaagggactgaatcccagctagctgtaggcatcactaaacagatccagatgtggaaggagtcagcaactcagggtatctgcaagagctcaatagagagcagaggttgcacccctgtggcttttccgatagggagatggatgatagagctggaagctcatgagctaattgaagtagctttcaaatgatgtatttataagctttggaaacacatggtctctttgatatgagtttgtggatgtttttgctgttatttaacactgatttattcggactttttttttacatatttttgcttatgaaaaatcaaatcctataacaaagcttaatatcctcagtgtctttacctggttttctgattatatatatataatcacaataccaaattggtgttttccaaattggtcacaaattttactgaatatatatatatgttttactgaaaatacatattttttatttgtatatttatatataaatttacatatttatattttatttaaaatatgtattttactgaaaaaatatatatattttactgaagtgactaattcgccagctggtattgtgatttttaataggtaccatttttcaggcacctgatgcaccaggcaccatggtagatgctttccatgtatcatcaacaaccttcacaacaaccgtgcaagacaatgttgttgtcccatttaaaagaagagagaaaccgaggctcaaggagtttaagtagcttactcagaggagaaaagggtataagtggaacgggaaccagtcaattcaaacctgggtcaatgacattctttggggaaaaagaaaaataaaaaactagatctttgtcattactgttgttttcattgcttctgctttgtttttaatgtgcctggcatctttctttttcattttaatgactttttaaattctatcacagaatcagactttcctttcttactgctcctttatctttcctatatacactaaacaacaagtaaaaccagggaatggactatgggcaggagtgtttcccaaggtcatgtggcatgataaaagactgaggggcgaatcaggtggaatctactgggaaggtccaagacataaacaatgcaaaggaactaaggccagaggaccaaggatagagtccattgtgtataatcttggtgtgcagacccaagacagggttagacaacagcaagtatgggccagaagagttgtacagaccagcttcgagaaacagtatatgagcatatcaaaatggcttagacttaaaccctcagaagcaaggcaaacaaggtgtgaagggcctttgggtaaacagcaaacaaagtagtgttgtgtggtgtagaattcaccaatagagtaaggtcatgaggggcagtgtccatccatcatttttgcttgctataataaattacacaaatctagtggcttaaatttattctcttacagttcttcaggtcagaaatctaggttggttctactggttcctccgtaaccaaagaaagtgttcacaaggccaaaatcaaaggttttattggaaggttctgggaaaaatctgcttccacactcattcaagtggttgacctaatttagtcccatgcagttgtagggctgaggtccctgtttccatgttaaaggtcagccagtgatccttctcagctttcagaggcctccggcattcctgggcccaccacccctgccaccatcttttttttttttttttttttttatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatcgagtctatcattgttggacatttgggttggttccaagtctttgctattgtgaatagtgccgcaataaacatatgtgtgcatgtgtctttataacagcatgatttatagtcatttgggtatatacccagtaatgggatggctgggtcaaatggtatttctagttctagatccctgaggaatcgccacactgacttccacaatgtttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttggttgagttcattgtagattctggatattagccctttgtcagatgagtaggttgcgaaaattttcacccattttgtaggttgcctgttcagtctgatggtagtttcttttgctgtgcagaagctctttagtttaattagatcccatttgtcaattttggcttttgttgccattgctttttgtgttttagacatgaagtccttgcccatgcctatgtcctgaatggtcatgcctaggttttcttctagggtttttatggttttaggtctaatgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttttaggtatgcggcattatttctgagggctctgttctgttccattggtctatatctctcttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtctttggtagcttgatggggatggcattgaatctgtaaattaccttgggcagtatggccattttcacgatattgattcttcctacccatgagcatgaaatgttcttccatttgtttgtctcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattggataccctttatttccttctcttgcctaattgccctggccagaacttccaacactgtgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctgttgagataatcatgtggtttttgtctttggctctgtttatatgctggattacatttattgatttgcgtatattgaaccagccttgatcccagggatgaagcccacttgatcatggtggataagctttttgatgtgctgctggatttggtttgccagtattgtattgaggatttttgcatcgatgttcatcagggatattggtctaaaattctcttttttttgttgtgtctctgccagggtttggtatcaggatgatgctggcctcataaaatgcgttagggaggattccgtcttttctattgattggaatagtttcagaaggaatggcaccagctcctctttgtacctctggtagaatttggctgtgaatccgtctggtcctggactttttatggttggtaagctattaattattgcctcaatttcagagcctgttattggtctattcagagattcaacttcttcctggtttagtcttgggaaggtgtatgtgtccaggaatttatccatttcttctagattttctagtatatttgcatagaggtgtttatagtattctctgatggtagtttgtatttctgtgggattggtggtgatatcccctttatcattttttattgcgtctatttgattcttctctcatttcttctttattagtcttgctagcagtctatcaattttgttgatcttttcaaaaaaccagctcctggattcactgattttttgaagggttttttgtgtctctatttccttcagttctgctctgatcttagttatttcttgccttctgctagctgttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtacgttgtgtctttgttctcgttggtttcaaagaacatctttatttctgccttcatttcgttatgtacccagtagtcattcaggagcaggttgttcagtttccatgtagctgagcagctttgagtgagattcttaatcctgagttctagtttgattgcactgtggtctgagagatagtttgttataatttctgttcttttacatttgctgaggagagctttacttccaactatgtggtcaattttggaataggtgtggtgcggtgctgaaaaaaatgtatattctgttgatttgggggtggagagttctgtagaagtctattaggtccgcttggtgcagagctgagttcaattcctgggtatccttgttgactttctgtctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtatctctgcacgtgagatgggtctcctgaatacagcacactgatggttcttgactctttatccaatttgccagtctgtgtctttcaattggagaatttagtccatttacatttaaacttaatattgttatgtgtgaatttgatcctgtcattatgatgttagctggtgattttgctcgttagttgatgcagtttcttcctagtctcgatggtctttacattttgacatgattttgcagcggctggtaccgattgttcctttccatctttagtggttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatcagccgttagtctgatgggcttccctttgagggtaacccaacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttgcaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacgtagttctcgagccttggttttcagctccatcggctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagagacgctctgcgttttagattttccagtttttctgttctgttttttccccatgtttgtggttttatctacttttggtctttgatgatggtggtgtacagatgggttttcggtgtggatgtcctttctgtttgttagttttccttctaacagacaggaccctcagctgcaggtctgttggaataccctgccgtgtgaggtgtcagtgtgctcctgctggggggtgcctcccagttaggctgctcgtgggtcagggttcagcgacccacttgaggaggcagtctgcgggttctcagatctccagctgcgtgctgggagaaccactgctctcttcaaagctgtcagacagggacatttaagtctgcagaggttactgctgtctttttgtttgtctgtgccctgcccccagaggtggagcctacagtggcaggcaggcctccttgagctgtggtggactccacccagttcgagcttttgggctgctttgtttacctaagcaagcctgggcaatggcgggcgcccctcccccagccttgctgccgccttgcagtttgatctcagactgctgtgctagcaatcagcgagattctgtgggcgtaggaccctccgagccaggtgtgggatatagtctcgtggttcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggcttgcgcatggtgcttgcacccactggcctgcgcccactgtctgggactccctagtgagatgaacccggtacctcagatggaaatgcggaaatcacccgtcttctgcgttgctcacgctgggagctgtagactggagctgttcctattcggccatcttggctcctcctcctgccaccatcttttaagccagcaatgatgggtcaaatctttctcatgctttgaaccactccgatttctatttctgcttcatctctcctgtcttcctcttctactgtgtcgcttgactgactcctctgcctttctcttctgcttttaagagctcctgtgattactctggatccaaccagagaatccaggataatctccctattttaacgtcatctggctattaaataattctatctgcccagttcctttaaagcagggcctcagttagtgtttaattgaataaccagggtacagaatattgaggggacatatttaggattctgcttaccacattgtggtagcacagtcatctgcatttctcaaatgtggataggatttaggcaatgccaagtgttagcctagattccagacacttactgacacctctaaatatttttggtaagatgtgtccccctttctcttccaagcgggtgattatctcagacttgtcctccaatgtcccttttccctttagaggcttcctataaatctttctctgatcctcctcattgccttgtccatcagctccaccttcattattgactgagcaagcagagcatttctgcctctccattgtgttctggaaagctttcagtgaattcccctgagccttggatacccccatcaagctctgatgaccatagaaaaatctcaggacttgtgaatcccattttcttgtcttttgtaatcttttgagatcccttgggaaactatttttaagccttttttttcttgctaatatgtataaacacttcaattcctttaacaactaggaaggaaaaagtgtaattgctaatacatttattaataatctcaactattttagaacctatgaacctataatttataataccaaggtttagagcagtcatttccacaatttattgtgcattaggactgtggtgaaatgcaaattgctggacccacaccaaaggttcagtaaatctagagtaggatcccaggaaacctacactcgactaggatcccaggaaagagttgagagaggtgccgtagtttagacagctactaagttgcaagatttaaggtgaagtccagggtggacagtaaccatctgtctcttctttttatagtgaatggaagtgtgtaggttgataagtactaaggcttcctcaaggagttcttgcaagagtccccccactctgtgtccctgggcactcaggggcttctccatactcctgcatgcctgtacctttaacattatggtcccagcgctgatgagcaacttctgccctggcttccctacactgaacagtcactagtctccagtgcccctcattaatatcctcagtagtacccacagcatggtgaaggagatacgttactcccatatcccagtaaatgaatgggattgagcctttcatgcaattcgagagaaagagaatgaacacttattaagagaaacggaaagaaaatgaatacttattttacttttgtaagtttactttacgttctgggatacatgtgaagaacgtgcaggtttgttaaataggtatacatgtgccatggtggtttgctgcacctatcaacccgtcatctaggttttcagccccacatacattaggtatttctcctaatgctctccctcccctccaccccaccccaccacaggccccagtgtgtgatgttcccctccctgtgtccatgtgttctcattgttcaactcccacttatgagtgagaacatgtggtgtttggttttctgttcctgttagtttgctgaggatgatggtttccagattcatccatgtccctgcaaaggacatgatctcattctttttttatggctgtgtagtagtccatggtgtatatgtgccacattaagaaaatgaacatttaaatgccacctctttgcacagttggcaccataagagttacaggagtatgtagctcttgtagactcagtacagcttactgaaaaaagtaattcactttgcaaatgatacctcatgtaatcctcacaaaaataatttgaggtattatccctttttttgtggatgaaaaaattgagctcatagatgttacaaaattcatatagtgtcatgcagctaaattagagaaaatgtcaatatttaaacccaggtgccttcctctaaagctcattgtttcaattggcatacaccgctaacctcgaaaatcccaatatttacataagtgctttatattcataatctaggaggttaaaattaggcaatgcagttatttgcattgttttggccattatatatagttttcatgcaccctaatattaattgtaagagctttctcttatagttctcttcattacacaatatccaaaatagataaaatgtgcttacccttgcaactctcacatcgggcttccctacacatttgtctgtctcgcccaaacattcaaaataggcacaggcacatcaataaacacactccttctactcatgcttcctctccacttcctcttgttggaaccattcagcctccagctagggaatcagttcatctggcctatcctagccttttcagccatttcaaagctgtgcctctcccaggacttctttggcactcccagggcactgtcaccacctcccttcgaagacagctccccgagggtcctttgtagcctctcaagcagtcttcatggcactccttgcaaagttccgtcatgggttgactgggctgaggtccctggtatttgagagaaaattaaatggacttaacgatcatctgcatatcagatgagatgtcaaggaaacaaggacctcagaccacagtgtctttgcacttgagagataaatatctttcactaagtcacatttcaataccatggctctagtgttagtggtgagggaatactggaaacggttgtatgagaattgtgtttgtggcttcccttttgatactgaataccttctatattatgatccatgcaagaaatctcttctagaatttcttcccaggaataattttgtctcccttcaaggatagctatgttttatttatcagaaaaaaagctatttcaccctcatgtgtccctttttgccatagctgctagcaagctcaggatttaaatttagtgctcaattacattgattatatcattctcagtttctggggaaaaaaattatcctcccgtttctgctctatgatttctgagctctggaggcactggaaatttagagaagggtccgtgatatctttttgcatgaataccaatgctttttggaaattctcgtggatatctgctggggattaaggaagttaaatccagctatgtcacaccctttcttctctcttatggattcttactaattgagaaggatatcagaacccattacattatcagtattattatacaaagcactggggttcctaataaatattgttaggggaatgcatcttatatacaaagtcatattttacccccactcccaacaaaaatcatccaaatctggtcttcaggagtgggtcagccacacagaggatcatggcttaatcctcttcccattgatgaccagagagaggaagccaaagggaggcagcctcctggacaggctctagaacagtgcactaagccatggcccagcaacttccctaggagacctaatagcagaggtgctgttgaggccaggccagtacaggagagacagagaaaccgtgtgtgaatggtgttcatgactagtgatcattgccaggaccaccgcatgctagcatggtgcaggcagctcgcagaaagtgttcagctcagggatgttcagctcatgactggtgttcatgactagtgatcattgccaggaccactgcatgccagcatggtgcaggcagctcacagaaagtgttccactcagggggctatgaccaggctgaaatcctgcttactctgcacctttttataattcatactcccagatggggtgcctttttcaaactcaagacaaaggctctatatgaggtacagggacccttccttttaccctattctcataaaagccacttctctgatgagaaagggtaagtttagggatggtggagggcaggtggcaacatggagcaagtaactaaaagtgttcttccagtgttcttttctcttggggcatggtctcctcctctctgattgtgtgaggagctgaggcagtaaactttgtccacctgtacttgtagaatttaacaaagaaggataggacataaggagagaaagtggtgtctaaaaggtgaaaagaagcattgaattgtcactggttcatagttcacagtgctgagtgaattgtcactcagcaaatattaactgagtgcttactatgttccaggcacagcactggacattagagctttggtgagtaagacgagcaaagaccatcagaacacctacattctggtgtccattctctgtgttcccttaggcacattatttcctcactgtgaaataaagttccataatgtcagcattgttcatgttctctctgagttccagaattcttaccatatgcttaggtctctgggaaactttgtgaaggatgttctttcacagttaatggcttaggatgattcagcgccagagttcttctcgtgtctctcatttaaattttccatcttcttgtgtattaaaaaatcaaagccatcattctaatctgattgcccaattatttgccaagaaaaactgtcagcaggtagctctactgaatgtaggaatccccgcatcaacagacttagataaataattcagcatagctggagcataggatacagagtgaggagggacaagagtaaacactggagaagaagcaagggcgagcccaggaagaagcacatgagacagtgaacgcatttctactgtgaaatgagggcaatggggagaacgttttacagggagtaacacgatcagatttgcatttaagaacagtcgatctagctctagtatggaaaggagcacaattagaaacagtgagatttgctcagggcctctgtcagcaattaggaaggacataatggtggcttgaattaaggaagtgaatgacagtaaggatcaagaaaaggagatgcattcaaaagagatttgggagatcaaatgtacaaaactttgagactgcttaaatatgggaagacaggggaggtcaagaaagatggcttctggccaggcgcagtggttcacaactgtaatcccagcactttgggaagccaaggcaggtgtatcatatgaggtcaggagtttgagaccagcctggctactaaaaatacaaaaaaattagccagatgtggtggtatacatctgtaattccagctactggggaggctgaggcagcagaactgcttgaacccaggaggtggaggttgcagtgagccaagatcacaccactgcactccagcctgggagacaaagcaagactctgtctcaaaaaaaagagggttcccaagtttcctggtttgggtaactgaatggtgcctgtgcactgtcataagccaattgcagtggggttcagggtgaaatctggagagagtaattaaatggggccagagaatatgaaggaagggacctaggtagaccactcagctcccttattttgatgcaaaccgcatgtccatacctggttgagctcaggacaacacacaccataggaactgagtaaatgaatgttggtgaattaattttataatgtgataatctaaagtgaactatggtgctgatgcccacaaaagttgggctcggcttgaagaacccagcagccctcaccctttagaaatgtcccaagagaacaccttgatgagtgggagacatgaaagcaggactgtgagcaagtcctgatggcatacaaatccggcatcctgttcagttctggactctctcagagattgacatactccatataaacatccgattctgattgactttaatgggatccccttgcaacccacagattctaagttatcccctagtaggtataatatttgtaggagacatattatattaccctggattggacactgaatgctgttacactgaagtctgacagtagcagaactcaaaacaagatcatcttgtactagaatgccactgttagtgttgatttcttgtaagccacagaaaataggtatttgtaagaaaagaaaatgttttaaaataaaaagtatttaattatcgtctaagaaatatcaaacataatcttcctgtggtatttgttttgtttttgtttaaggtcagggtattttctcttggggaggaagggatagtttttcccaggtctggagattaaacaacttaataggcatttcacgttccgctcacaaaaaggggatttgcatatgaacttgtttcggcaagaaaacacatctgaacgtatttcatgggaactatctttatccacggcagcttcttttgaccatcttcttcttttcttcccttcatgcctgcaggtcaccggattgaaactgtctcaggaccttgatgatcttgccattctctacctggccacagttcaagccattgctgtaagatactgtaatgccatttttaaagagacttagagccatcagtatactctaggccactggctccccaagatacagcacatgcttttgtgacagagattcttaattaaaagattgtttgcaaaaaagagattcttgtatgtctggaaggaagtgttgatgaaaggcctcacctgctttaactaataacctcacataacaaaaagctgaaaggagttaaaatctgtgaagattatacttgtcatttatctaatttgtcttctaaatttaattaaatagaagcaagcaaacagatgctatgtatgcttgcattaagaaaagttgttaagaatgtctgatttataaaatacattatattgttcactttgcaaaaggattcatgataggggtcctttaaatagtaagcttccttagaacatgaaagtgtttgtttttagataattagctgcttaagtgaggttaggatgattagggaggaagaggggaatttaaatctgaaatgttaggagtttctacactaaagataaatcaaaaatggaaatgaaatcctaaaagcttaaccattgtctaaagaatcttcttatctagaggtggctatggatgggctacaagagggttctaatcctgaaatcacatccagaaggttgtgtgtgtgcatatattacaaagtgcattttaggagagtagatcatggtgttcggggtctcacagcaggtatgtaaccgaaattaagttaatccagtgaggcttagccacttctgaaaagagaataggaattaacagaaaggaaaaatcagtttatctaattttaattcaaaatttatttttcagtaacacctgttttaagcaaatatgtttaatgctatacgtacatatatgatattcaattattctgtttcttcacacaactgttttcataactttattcctttaaactatatgtatatttattcacaccaccaacagaagtgcttttttaatgctcagatttgtccatgcaccatgtatgtgcaataaagaatggaacctcccagatagtaataatactaatactgaagggatataacttctttaatgcaactacatagaagtatggaatcagtcaacttgattaaacagcccttttagattctacactagttttactatatcttcctgaagcaattttcttattggtcttaatagcttggccaattcagtgaaatcagtcaaatatctttatgcatggaaacttggtcaaaagcacacaattctgacatctgtaaaaatgtaggaaatgaacagtaagatgaaaatagagaaaaaaagtgtgcatcagtagtaaagataattatttagctgtcctgttttataataataatgatgattatgatgataataatgagtgaattaagagggtgttttgtttttgtttttgtttttgtttttgtttttgtttttgttttgagacagagtctcgctctgttgccaggctggagtagagtggagcgatcttggctcactgcaagctccacctcctgggttcaagcgattcttctgcctcagcctcccgagtagcttggactacaggcgcatgccaccatgcccagctgattttttgtatttttagtagagatggggtttcaccatgttggccaggatagtctggatctcctgacctgatgatccacccgtctcggcctcccaaagtgctgggattacaggcatgagccaccgcacctggccgagttaagaggtattttataggccaggcgcggtgactcaacgcctgtaatcccagcactttgggaggccaaagagggcagatcacgaggtcaggagatcgagactatcccggctaacatggtgaaaccctgtctctactaaaaatacaaaaattagccaggcatggtggcgggcacctgtagtcccagctactcaggaggctgaggcaggagaatggcatgaacccgggaggcggagcttgcagtgaactgagatcgcgccactgcactccagcctgggtcacagagcgagactccatctcaaaaaaaaaaaaaaaagagagagattttatatgtgccaagcactgtgctagatacattacacacacctgatttaaccttactacgtagatattataattcctattccacaaactagaaacctaaggctctgtgtgattaattaacttgtgcagggccatatagcttgtggcagaggtgggatttgaacccccagcattctaaaacaaaattagacatgtgaagtacagtcatctgctacataacgttttggttaacgagggacttcctatatgatggtggtcctataagattatgatactgtatgtttactgtaccttttctatgtttagatatgttcagatacacaaatatttaccattgtggtacagttgcctacagtattcagtacaataccatgccgtataagtttgtagcccaggtgcaataggccatactatatatagcctaggtatgtagtaggctataccatctaggtttgtggaagtacactctatgatgtttgcatgacaaaatcacctaacaatgcatttctcacaatgtattcccatggttaaaggacatttgactgtattgaggaacttttattttcagatttgttaatgttattgtataaaagagtcatagaatgaatagcttatattgaaatgaataatcttggaaaatcagagtggtgtgatattcccccttttgagcacatgctaagaggaggacatgaaggatgaggcaaacaggagggaccaaggggcaccatcacatagtggtaatgacagttacctttcgtcagacacgactgtgtgccaggcaccaaagacggtgccttgcctactggtagcttaacactgtaaccctgtaagtaggtgggtttgttctcattttacagacaaggggaggaccatttgccgaggtcaaacagctagagtatggtagttggaatctgaacctttctccatctcactcccaggcttctgctctttccactttaccatgctgcattttcctttgatctgtttgtaaaagctacatgggtgaaataagctttcagatattcctaagaatcgtttttacttaatatatattagaaaatatcattaatttggccaggattgtctcacagaggttcctttcctggtaagagtactgcagcagaagtccagaaatgtataaatgaggttaaacttaatgcgggcaggagaggggaagaaaaaaagccagctacattttctcaagtaccacacacttggaaaatcaatcttgtatttaatgggccgtacatgtattaaaagctatcatatttattctgtccattgtcttaatgacctttataataccatgaaaggaaggcattttaagacagagatttttttcaataagccttttttgtggagtcaagtgaattgtgaggggttcagtctgttttgcaaatgtatctggatgtgctgatcttttaggcaaaaaaatgtgcattttaatgaggtattctgataacagatattttcccataatgttcaacttgggaaaaaaaaatgttgtttcattagccctgaatattgccggagcacttatttgttgtcggtcaactgaaagttaagcaaatttctctctatatatagtcatatctttgggtgctgttttgtaggggtgaaatgaaattaaagaggattgtaatcaagttaacttgggactgtgcaaaaccctccatgaagtaaaattctctcttgatcatgcttaattgaaagacctgtcaaccacccggtttatccatagcctgttcatctatagttttctttgcagaacagacccttaaaaggtactatttgcatttgaagtctcttgatttgcattcggttctgtacattcccagtggaatagcctaattttaatttaaatttctctgtgaaaacattttttccagaaaggtgagcacaaaatcattttcacacaaagccctttggtggggcatttcagtagggtggagtattacacagattggagtctgggacaccgaaagggaaggtcctctaaggaaccgccagactgagtgggaaattccagccgacaataccacatgggggagagacaggctgtctgtcacagcccctctcgagggagtgcctctcattcggatcatttctttccttttcccaggaaatgtgctttgttttattcttgtctcaggcctgctaatcgcaagcccctaggtccctggttttagaaatatcaaagataccagtttttcctgacatttccatacaaattaggagacagcaattctcccattccatacagactgtattgcttagtcaaattatatatctcctaagtggagaaaacaatatgcaggtttcacatttgccttaagattagagatgctattaaagtgcatagcagagtgcctagcatatagttgataaccagaagaactctccttgtatgcacctttcgtgagctggacacttctacaagttttacctttgctgcctacagcagcagacttgtatggtaggtattactagatttcatcaagcctaagaccacatttttaatttttttgcatgttgacatttctgacaatctatagaatttttaactaaatgaatatgatactattattcccatggcaaaaaaaaaaatggcaattgagttatagaaaggttaaggtacaagaaatatgtgaaatgcctaaatgccagcctgggttttttgaattcaaaactcatgctcttagctactacaattcatgccgttagagcagactggggttgcccagaatccacaggcatcaaatgatccatgatggacttcaggcatctgtagacctcctgaaattatttatagtactattttgtatgtgactttttttttctggggaggtcagtaggttttggcatattctcaagggggttcatgaccccccaaaaagcttaacaaagaacatctgggaataatcagccctagttagtatgtaggatctggccttatatggcacaacatgtttgaatttttttaaacacactacatctgtagattgtttatggaggcccaggttttacctaatccatatttttaccagattcatgaatagcttcaacaaaccctcaagacctctgggctagaactgctgtgccttttgctcctgaactgcccctgtccctcatgatttatgccaaaccaattaggatttcatgtcctatggttcccagatcaccctctgaccactcctgtccccaggttcccccatcccctggggtgacagctccccagacagccttgtcaaaggaggctccatttgccctctacccccaacccccctaagacgtgaggtcagggcagcatcctgctgacttccaaaaccctgttccttttttttttttgagatggagtgttgctctattgcccaggctggagtgcaatggtgtgatctcggctcactgcaagctccacctcccaggttcacaccattctcctgcctcagcctcccaagtagcttgcactacaggtgcccgtcaccacgcccagctatttttttgtatttttagtagagatggggtttcaccatattagccaggatggtcccgatctcctgacctcatgatccgcccgccttggcctcccaaagtgctgggattacaggcgtgagccaccgcgcccggcccaaaaccctattccttaccttggctaaactccgattcttcttgccctcagctaaaacacctcctctccctcactacattcctaggtttcaacctgaacaatactgtcacactttcactaaaaaccaagatattggctcatgccttcttcttggtggctgtgccatctgtggagacacattgtcctcccagatccttgactttcttatctcttctgacttctcttccctcctttttagcaattcactcccaggtctacacttaggactgtgacatctccccagattgctcaatctctaaacatttcaaagacttgctacccaccaaaaaatcctcttcctctattttttctggagcccctttctcaaacatcaccatgtggctgcccccttatggccacatcacagttcatctttttgtttttagtccttatcccaaataaattttgattttcgaactctagtttttgaactttcaagtaaattaagatttttcagatgttcaactatcctatctaaaactgaagaattctacattgagattcacttccataactctaaggcaataatggtttttactgagtttaatgaacttagcaagacagacatgaggataatgcatattaggaagatattaatgcacaagaactgagacacaaggctgaattgaaaatatggtgaagccctgaaacaaccagggaatggatttggctcagaagtctccttttagagaaccactacctggtttcaggcaatagcagcggtaattttagcccttagccaccctgaagccttggatctcaccttctttatgcagttagagccctctttccatgattctgctgctggattttttggtgctttttctaaggaaaaagcctttagttcccatttagtaaaggaagactgaccaagataccattgactctgtttcagagtactattgcaatcactgctaatacagggcctgggctatagtagacactcattaaatatctgtttgaatgaactatgttaccattaactgtgttgacattgtcaactgtttttgtcagtgttgtgtaactactgatagaagcaaatggtgtaattaagagggttttggaatcagtcaggcccaacttgaaattcccactctgcgatttaagtaactgtgtgatcatagacaacataatctctgtgagtctcagctttctgagatagtgtatgtagagcttagtacagtgtctagcactgagtagacatttaagaagtgttccctagtgtttacttttgtgactatactgatgctatcttctgcttttcctttcaagttggggactcgcttcattatagaagccatggaggcagcagggcactcaatcagtactcttttcctatgtggaggcctcagcaagaatcccctttttgtgcaaatgcatgcggacattactggtaagtctgggaaagaggagagaaggtcactttttggcttggcagcaaatgggcatggccaagttctgggtgaagtgagaataggaggatatatgcggtatgccagattattagaataatcctgaagtctttatattcacaatggagaaagtgacttctatgacgtctttatatgcatgatggagaaagtgatttctgtgtatatccaaccattgaataatggtgagaaataacacgagagaagttggccaggactagatcttaattcaagcatttacacaacagttttgaatacctcttctgatccacacattgtggagaatattgaagatacgaagatgaataggacatgatccttgctccccaccacccaggaactcacagtctattgaggaagggagacagcaaacaggcatattaaagatagtatggcaaaagcttggcgtgagaaaagtacggggtatcatggaaacatagtggggcaccttgtctggtttgggacctaatggcagctcagggcgtgtggtctggaagaagtgataagaaagctgtcttgaagaaagaatgcagaggctggatgctataggatctgtgggtatgattgcagactgggaatttgagccctaagaccctgagatcctgtgattccttctcagctcatcagaatcagggatcataatagagatgcagggaatcacaaataatgggctgagctctttgtgatatcagcagacagtgggggagaaggatccttagcaagcccctaggacccaaggaaggggccccattggcaggaggctttctgttgtcgcagagagtggcctggacctctgtctctctggacctgataccctcaccccttttactccttgcccctctagtgtctcctggggactggagacccattctctcccaggacccatcactgggtggccaggtaccaccagggcagggcaaggggagggaaagtggggaagggttgtacccatcccatagtcccaactccagcctgataagagcccacttgaccctacctccatttatcattatcctttgctgtccctcatcccctactttcttacctctgacttctggccaggtcaaagtccctgccccattatatcctccatccccctctaagccacacagattcctgcagatgagagccttgtctaacacgatggacgtaactgatctttgcacatcatgagatgaaactaagtaagtcacttattcccagcttagagataagcagactgagacacaagtctgaggacagtaagaaaagcatacagtcagccgggcacggtggctcacgcctgtgatccccacactttgggaggccgaggtgggcggatcacctgaggtcaggagttcgagaccagcctgaccaatatggagaaaccccatctctactaaaaatacaaaaaaaaaaaaattagccaggcgtggtggcgcatgcctgtaatcccagctactggggaggctgaggcaggagaattgcttgaacctgggaggcggaggttgcagtgagccgagattgcgccattgcactccagcctgggcaacaagagcaaaactccatctcaaaaaaaaaaaaaaaaaaaaagcatacagtctaagggcagaactattgggatgtgaagtatagaaagtattaccattaaccaagcacctactatgtgtcagtgtgaatcacgctgtagacacttaatcctcccataccaccaaaggtagaaatcggtgcccccatcttacagacaagcaagttgatgggtgggtaggtgaattaaattggctatctaaagtcaaacagccagtatggggcaggaccaatattgtaactgtggtgtgtcggggcccaccgtccctttgtactgtactgctgacccaggtttcttgacttttctgccaagtttgtaaccagttgatgatgacgccactttcctgagatgtccaaaaccctatagaagtgggccgttcaaagcagaaggaggaaagacataaaaagagcccagattgccttataattgtcctcaggagaaaaaccataacattttatctaaaaatcagctggctagttcagataacattcaagcttaaaatttgatctgtgacattccaatttctagacttctttttttttttttttttttttttttgtattttttggtagagacagggtttcaccatgttggccaggctggtcttgaactcctgacctcaagtgatccacccgccttggcctcccaaagttctgggattacaggcatgagccaccgcacccggccccaatttccagccttctgatagccaaaaaacttcctatctggatgcaagaggaaagatgaaagtcagctttggagaacacagtactctagaaaatgggaaacagggcctcccagagcagaacagctagctgtgagtgaccccggcactgactccgcgctgcagccctggactttgtgaaaatgggtcatcttccaggccctacatccctgggctgactcagaagcacggcggggagtgcagcggcttcacagaaagttctgctttggaaactgttctcctctaggctgttgaatgaaaaggctgttaatcgttatttggattccgattgaaactggaccttttgtctctaactatggaccagttacagttccagacaaagagaccttttatttagcctggaattcctctgcctttggaagcctgtgactgacaagtgatggcaaagtgcatctgcctttgaatgctttgggttctgctaaactcattaatgcatcagataaaatagttcacattccagccaaagctgccctcttcctctccttcacccaggactcagagaaaagaacacatttgcatttgtccctgtaaaaggcacgtacacaagcagccagtatagaggtagtgtcattggtgcctttaaacattgtattgctctagttttcctacaaagacagttagggaggactgtagacctggaacatgattctcagaaatgcatgtgaaaaacacattcgaatttgggagatttttttggagatagtgtggaacagtggaaaaagcagatcagctctgtgactttgggcaagttactttacctctctgagcctcagttccctcttctgaaacaaacaaaccaaaaaacattatcatctccctcatgtagatcactgctgaggaataaatgcttgcgagtttgtgagcatcaaactctgtgcctagtccaagtaggtgatcagtaaatgtcaattctcttattccatctaggaagccccatgccaaaaagaaagaggggcatttgagggaaaaaaaaaagcagcttattattttgaaagtgaatctttgccatgttgagaacagcctgctctgtacaagcagggagagcggggccttgccagcttgggaaatgctgtctacatgaggaggaagaacctccttgtaccctggtcatttggttaactgtggtttcaagaaatacttggtatgtactaagtaattgttaagtttcccccactgacttgggactaaatgttccttcttctaagttttattttttagtactggtagtttcagtaggggtttccctcttctggtcttactcattattttaattatttgttctttcatttattcactcaaaagcattctctgtgcacaccagtgtgccaagccctgaggttggcacagggatgctaagaagaacagtaatgtccagccaagaggttctttataaaacacagaaaaagtgcccttggtcttatgaccaatatccagagtgagtagagtggggacccagaggacaaaatgtgtcggtgtcagtcaggtccaggcagggaacagatacacactccagttaggttaaccggagggaagttgaatagtcagtgtacagagctgtgggcagggtgctggaagcccagacaaccaagaagtaccttgggatactaacagtgtttccacccctgggctcacaagggtgagggtagggagcaggcaatctgagcctggtgggatgtgtgaagagggcagcccagcagaagcttagccaaggatgaaaccagagggcaggggcccacagctgtgatccccactggccagtctcccaggctcagagtaggtggagggaggaagggaagaggtgggattggtcttagaggcaaatggaagcagtggattgatttcaccctgggtaacaggtgtgaggagagacttcagaagtaaggtaaactttaagaataacaactaatgctaatttagtgctttctctaagccaagcaccattttaagagccttattataatagcagttttaattctcacagcaactctatgagataggcggaattttaaccccatttttcagatgagaaagctgaggcacggaaagattaggtatcttgcctaggatcacacagctaagtcagtggggaagccaggattcaaaccctggcagtctgggttcagagcactttgggcagcaacttgagagctgataggggattcaccaggttcactcacatctctggttcgcaaggggaggggcctgtgagtagttcctccctgctcacaactcagggagcttttggcagggtaggaaggcccgggaagtgaatggtgtttggaggcactgtcttcaaaaacgtcccaggtccatagagaaggcttgatggtcatagtcgcacacccatctgtatcattcctaggattcttcaacggcttgcagtgctctctcctgctggtgtcagcacagccctgtagtgtggcctggcatctgtccttcccctctggatggttgatgggaacctttattgtcccttccccacttatccagtttttagtccaggtctagtacatgcatagaggcttcacttgccatctacctgaattctaacagtagcagccatcatttctccagggcttactgtaggccaggaaatatgctaagcaccaagtgtgtgccctctcattaagcctcacaacacacctgtgtggtacatcttatcatcatccccattttacatttgggatgatccccatttgcatttgggaaccaaggcttaaagagtgtaagtgacttactggacacagagctagtggaaccaggaaataaactcaggtctgagcttctcccagcattcccaccccacctgacaccatgttggcaatgtcttaagtcctggcccagttgagagctggtattcctaaattctctggggtgtctgtgggaatttactcccctgccctttttctctgggtagctggaggaaagaattgagtggggaagtaatgggatgtagagagagtgtcttctcagacaagataggaaaagaaatctaggctttgggaaaataactcttatggcttgagtagaagacagtttttacaccacaagtttacctctgtaaagtttgctgccatctcccgattagcagactaatctatacattatagacctaagaatcctaaattatttctgttaatcttaaacctaccatgaaccctcaacctctgggcattggcatatggagggctcctccctgcctggtggactcctgctcacccttcagatgcctgtttaagcctcatctccaccgtaatctgtgatgaccgctaccccagaaatgtaagtgactcatcattcagtcacttaccatgtgctagatactggtctaaatgccagggattccgcagtagtcaaaacagagtccctaccctcaagtagcttaagtttttggaggggagacagacattaaacaagataagtaagtaaaatacaatgttggaaggtgggatgaagcagttaagggggtaaggagtgttgagggaagttgtaattttaaatctgatggccagggaaagctcagtaggaaggtgatgtttgcggaaacacttgaaggatgggccggcaattagcatgtgggcatctaggaggaagtgttccagacagggaacagcatgggtaagggccccgaggcacactcaggaagcagcaaggaggccaggactacgtggctggaaggagaagaggaggatatcagagagggagaagtggggccagatctgggagggagagccccttgtcagccactgtaagggctgtggcatgcaccctgagagaggggagaagcccctggagggatgaatcacaccctctcttgctatctcctttcccttagcacatctcagttagagaaccaaccccctccgtagccttcatctctctcatccatttccctctgaaacctgaatagcagggcacagtccgattcatctcagtattccctcggccagcagagcgcttaataaacatcagtggatctgaacttgaatcaaatggcaggtagcagcttgcagaagcctgaaaaacctgggcactgaggtctcgtgagttgatatatatggtgttggttcccttgggctcttggctactgcaccagcaggcacaggcagtgaaatcttttagaaccaaataatcccaaggaataaagaagggaggactgcagggagtcgggcggggggcctgctgctgccctgatgtcaggtgtttttgccactgcggctgcttgttggctcctcacactcccctggctctgctccctaaccaaggtgtggccttgtcctgcgcaggcatgcctgtggtcctgtcgcaagaggtggagtccgttcttgtgggtgctgctgttctgggtgcctgtgcctcaggggatttcgcttctgtacaggtatgtgaagaccagggggtgggctgtggctcctcccctgtctgaggccatccttcctcttgacagcagctcgcattttacaaaatacacacaggatataattaagaaatgataggttccagccagggaaagcacaaacacttctagcctcagacatatttattgcagttttcatttgacttggcctcggttcgtgttggtcgttctgtttttcagttgttttttttctttcttctttaaaataccttttaaattattccttttaaatttccccttgaccacttttctttgagcacatgaaacaggtaaggctcaaaacttcagtgtttcatgtgtatttcagatttttatttgcttatgtcaacctcaccattttctaaataccttgaaggcctctatcaacaagagacacaaatgaaactgtcagtatgaaataaaaaaggaattaaaagggaaaataaggaacaaagatataggaagaaggaaacaatttggtggctgtgattaaacacataatttggctcagagcttcctggcaggcaagacaaaaaagaacacatgataaattgcataattcttactttcaaaaagaggaaacatactagtttctggtgagagggaaaacttttcctcccaccaaattgcgaaagaccttgcacacatggggctttgtggagaggttttgagtgctaaaataatacaaggtaaacaatgaatgtggtatggaagctaagagcatacaggctctggcattagaccacctgggctcaaatcctagcttgattacctaccagctcttgtggcctaaacagtcttctctgtacttccactcctttatctgtaatagtaattgacagcgcatcgtgagttctgtgtgtcaagcatgctcatttagtccctgcaatagctctattatccccattttatagttgaggaacctgaggcataaagaagttaaataacttggcctaaatgaaacagctagtaaatgccagaatcaagaagtctggctcccacttctcaactgaacgttcaagagatatttgttcagcaaagcagcagagtccaaatgacttgcccatggtctcaagcttaggactacaagccaggtatctagtagctcagtaattagagctttgtttattgtgaacctcttatgttccagacactatgctaggtgctttttgtataatcttcctaatacctataacaatgcttcatgagccacagagattgggccatagagatccaaaatttaagggtacactattgggaacagacagatgtaaaagtgtgatgctgtttgtactgcattttggaaaatgtggtacactacacactatccaagcctctgaaactaatgactgtgaaatctccctcacaaggaattaaatccactcatgaattcttgtggattctgagtgagtctttaaacaaaggtggtatagttcagttctcgactttttctggatagtctcgtcctttctcaaaaatagcacatggagatatttgttgttgaaatatcaatgaattgtcaattattattttagtgtatcagctgacggagatgttctcacaattaaatatcttgcccttcctgcggcaaattataatagttaaaacaggggggatgcttactaaggttctgcagaggttaccctgtgttgtgaactgaatatttgtattcctgcaaaatttgccctgaccctcaatgtgatggtatatggaggtgggtctttgggagctaattagggttagatgaaatcatgagggcaggagcctagtctgatgggttatgatggtctgatgggcccttatacaaagacaccagagagctggcttgttctctctgccatgtgaggacacagcaagaagtccatttctataggccaaaagagggctcccacgagaccctgacattgctggcaccctgatctcagactttgagcctccagaactgtgagaacatagatttctgttgtttacccagtctatggcattttgttatagtagcctgagataagacacctcatttaatcttgacagtcatcctgcttgcaggatgcgtgtttttatccttctgtgataggaagccaagcttcagagatgttttaagtaatttgtccaaggctacacagaaagggcagaagcagaattgaaatgaaggtctctctgggtctatatcttatcctgtcattctttttctaatttgttcgatttgttttttctttaaaaatattttctggcttcttaagtgttcagtggtgtattttctgaaaagaaatgccataggtcacaaatcaggagatagtctgtagctcaaacagagaatagcctttcaagatgaggctgctatactagatacatcataccatgactcatggcttcattgatatcttattcaaaactgggatctccagctccaaaggaattccactcacatcttcccctaatgggaaactgagcttaattccacactgacatcttgactacatgagatttgctgttagtcttctgtaacagaatctaagatatagtagatcagatttggaactgatgacttgagtagcagctgcaaggctcacagcattgtaaagacaagctcatgtctcctattcaacccaaggatgtgtgtgcctgtcctgatcgttttcaggagacacaatctagtaaagggagccaccagctgagagagtcctgaggtcttatctgtcatcacttacctgacagactccccatagtctggagctctgtgcttgctttactgtcctcagacgatgtcacttgttctctctgggtgcttgttttatttgtctgttttatgtattttttttaatgtttaaataagaattgccacccatatgggactatcgagataaagagcctttgaaagttccagtgacctctcaggtgtaatcaatatcattagaatgataaaatatttggaactgctttggaaatgaaaatgcatgtagacttggcgtcatttgctcccctccaaagaagaggggccaacctttgtgccccaggtctgaggaccagcttcagattctggcaaggtgaggcaaaattgaattgctttctttctgtgattcatattttcaacctgaacttcaacacagtcttttctttgaacttcagggaccctggcttggtttgcagggtacctgccttcccctccttaagaaagttgagcaattcctgccagcacctcaactattccagcaagtcagatgttttatcttctcatggaccacacatctggtggttagatggaggatttcacttcttatctagataggccaattttggtagactcaaccagagtcacctccttcagatgctgggaaggctgggaagaatccagaggacccagacagtagaggtaggaaaaacttttatgtgcttgaggagacagggttttcataggcccctgaatggatgattttcagccgggggtagagtcctatacctttcttgggtgataccaatggatccacagctgtagattttacttgtagcttttgtagactctgtgtatctcaattctgggagaattttatcaggggaagggagactggatggaatattctggtgggcccttaatgaaagattggccaacaacaagatctattgatattgcaaattttgaaacatgctgacaattcctagcttccttcttttgttcttttatccattcagattctccttctcttagtttgtctctgtctctcttcccttgtcctttcctgctctctctctccctttagacatctaaagtcttcttactatttctttgtcaaattcggatctcacaaaggatactgacatagccattcgttcattctaaagaatacaatgactaatactatcttaaagagttgcccctctttagaaagggtgttttccttttagtagttttcaaaactgtgtctttactaaagagaacagtctccttgtggacaagtattcttgaaggcaaatcatgatcagctttatatctgcggtttaatgaaaaatatggaatcaagccacagatatgctgctctcacagtaaaaatttagctattgaataagtgggaggggacacaaagaaggcagttcacttcccctccctttactcttaggaatgtggaatccctgcagtcttgacctctgtgacctttctacttgatccctcccccatcatcagtagagtacaaaatgatcctctgtaattctgaatatcttggaaaacaaataattataattagaagctgagagtgttccataacacttctctaggctcccaggtcctggaaaatcaataaactggaaaaaaactaagtttatgaaatatcactatgcttacactttctaagcacagacagttaaaagattctaagaaatacaaggacaaataaataaaacaagaagcagtttcaagtcgttgtgagagaaaactcaatcaaatggcaaagagacagcaacatgaaatggctctccactttctgtttccttcaggccccctgcagatgtcattagctttctgtaatttcttatcttcaggggcagtttttattcaagtctatttagacaaaacaagctttaattccagcagtgctatttgtcttgaaccaccaccccccacccttgaaaaaaaggagtggaggaagcatctgaagcaaaaatcagtaaaaggagacagtgacaagagatcaaaatgcattcagcagtcattttaaggggagtaccagtgtaaagaaaataagcccttggaatcagccaattaatcacagaccttccttcctcccactgtgtgagtgttgccacccctgtaaaccactgactccatgcactctcaccatcaactttccctgtcacgttccagacagactcctgtgtcttcaagaccaatacatgtaagtggccagttgagagctgtgattactcaccctttctgtaatgtgtgcccacaagataaaccatccatgctgaccgcagtggtctacccttgaggtcattccttgcaaacatcctcattgcttagctgaaacctctacttctgttctttttcatgaaattcacttcatttagggccagttatactcatcacctgttatgcatttcagagcctatgatttttgtatataacatgtctcccattctattttattttgtaagagtcaactttctgtgatttttttttttagctctatttggctttctgtcacgataaataacagttttgctatttgcaaaataaagctgattatcattattttagtttccagaggttagaaaaaactgaaataccgtagatgttcagaagtatgaaaccatcccatttctcggtgcattcaatttagtttacttgcatttttttctttgtctggaatactaacatttcatgttcattggggacaaaaataagaaaatttaattaagatgagtgaaaatatgaaaacattgatcttgttatcctaaaataacctattttaaattatttacttattaactatttaatattatggtttctattctcttagtctttttgtacatattttaaaatcattttatacttttaaattacaaaatgtattatacaatgcataaagttttatctttttagacctttttcctatactcaaaaatatgtagtaaacttctttatttatcatttttgtaggctgcataattttctacctaatagaatatattatagcttatttcaccagtcctccagacttgaatatttaggttttctccattgttttaaagaatgctgcaactgacatctctgttactaaatgtttgcacacatcctaaattatctctataaaataaaattagaggcatataattgttcaggcaaaaagtgtgcccagcatttagggttctgatacatagtaataatttatactcccatcagtagtgtctgaaaactcagggtttacatttcttgtatataaggaatctcttgccatggattttagttccattttagttctatttagctttcatccccaggcctcttataatcctacttatttcacatatggtcctgatattatcagcttttttttttagtagccttttgccctttgctgcttaagcatgtgtttctggatgagattctgattcctaattaaatagattcagattactgattgaattttctgagtatcctgtcccatatgtcagtgtccctcagaaagtcaacagaaaactttggaatggtataataattaataattgaaagaagaattcaattaagaatatgaagttggccctaacattcattattcttattgccacacctggttaacaatacattctttttttttttttttaagagttttttcgacccctccagaaaaaaaaaaaaaatagaataaaacaaaaatagatcaggttctgattaattataaaacctctggtttcaatccagtttgcagaatgataccatgggtataaaagtcaaaacattagctgaaaattgtaattttttaaggaaattatttcaatataagatacacatcatttgactctcttgttccttacagagtgatccaagaacaggacctgttactttccatccattgtcatttcatagaccccttgaagcaacccagtggttggtagcagcaatctttgtgcagatgaggactctgaagctcagaaatgttgtataacttgtttaatacaaagcccacgctctttgtattccatcagaccatatcctgtagatacatatacattgctagggaagtacactatggcaactgagacacctctcacaaggtggtatcgtttataaaaaatagcattatgtatttgtcatcattgcttggttgagtgtccaacacagaaataaaaataagcagggtgccctctttggcatggaaatattctaattcatttccccagagaatgaccatactcaccagtattattttgctctacttgtttgcttttaatcataatatatgcctgtttactttttgtagctataaaaaggtagataaaagaagcactttaggtagatataaaaagcactttaattaagaacatgaattaaaagatacttcaataatgaagtacaatagattaaggaatactttaatagattaaaataacttgaattaaaagatacttaaatgctattgttattaacacaaaggtttaggctaacaaaacgcattttcccaaatatctctctcacctccccccacaatttttattcaggaatgtaagaattgggcttttataaaagcaaccaagggctaaacatctactaagttcttagaaactttgaaggattacagaactctctttctataataaggtttacctgtttgacttgattttgttcaagatggcatttcatactggtgtaaacctaaacaaaaatgtgtaagatttatctcatagaaagacgtgcctgtaagtaattaattcctcactctaattactatttatgcctttactttttattgtaaacattcttgttggaataaactagaaataggttttttttctttacactaaaataactcatgaatagcaatgaaatccatgctgtataatattcaaatgagagatcaggaaagacaaggcttttagttaaatcagtaatattctgtgatggggaaaattgccttgaaaaatacacacacacacacacacacatgcacacacacacacacatacatactactagaaaaagtttgaggttcgattcagagtgtggaaggtacagtgtcttaaaagagtttcagttgcagcatttaggcagatgatcaagaatatgcagaagaaaacaaaagaaatcataattatagtttcctaacagaggtatttgatcctctgcagtgaaccataaaaaactagcgtgggatcagaatcttgagtagcatgtatttaattgtatgcatttcaaagaaatttgaacattttaaaaagttacaccatatgaaaaattgtatataaagacattttctataatattataataattttacaaatgaggaaacagggttagagagagtaagtgagttaccaaagccaatggctagaaagtgagagaggcagaatccaagtactagcctgggattcccaaaccaaagactgttcagctcagccacaagtggaaatggattcttatggggctaagtgattaccattactttaaaaactagtatcagaaatagatgacaagaatttaaatgtatatcaaaatatccctttggtaaatgttagtgtcctcacaggtaaacagagggcaccctcaaatttgagtaatttgagagggtttaaaagagggactgtttacaaaattgcagtcatagagacatagagaaatcacagggagaatgtgaccctcgggtttgtaacagctgggcctgtagaggcgagggaaaagtgcagttactggatgcccagaacagagggctgtgtggagactgcacagtgaccctggaagaaaagggctgcactgttaaccctattctccctctctctaatctcctgcctgcctcaccattggctggaatcagaatcagagagcaagggaacctgttgatgtattctgtagaaggccacatctctaagctcagaggagggtgggaaggaatcttcagaagcacttggagacattcaactgagtcacccaccctggactattcagagcggtctgcagactagagggcagtctctaaatggtttgttcagatttgctatgaaacaaggaacttgcatcagaatgtaaatcaattatgtcaccaagtgtactgtttagttcagctgtcattttattcatagcaagatgttctcaatgaaggaaccggtgtgctggcttacatcctggggccaactcctttcaccacagatgggccctttgaatagcactaaactagattccttgctctgtaggtaatgataaaaacgctggaatccctttccttgttttgattttcctaccttaacttctgctaaagagaagaataacgagtatttttctgtacctaccctgagcctggcactgtgctaaggtactttagatgacatttaattcttgcaagttagattattcacttcatctttacagacaagaaacagggccagaaagtttaagtaatgtgcctgtggtctagcaagtgagagagccagcactcaaattcagatcttactccaaagtccatgcccctcactgtttgtaggctatcccaggactgtgcttaaaattatctgacattaacaccaagaaataaagcagggttgttgggggattgccttatatggagacctatgactatgttctgtatacatatgctatgcatgattcctgggaatagataaaacccagctccccccaaatcagatggcactgtttgtgaatacgatgttactccacgttacaaggccttgtccagcccagccagccaggtcagagatgaattcagtttgtttctaagtggctgttgtctgttgccatctctttttaaacctgggaggtcaggaagaagatagggagaaagaattcatgagagggatgcatttccttagaaatgttattaattggctgggcaaaacaagagaaggaaataaaatagctgctccttactaagtaaaggcatcttcttcccttatctcattaaaaattaaaagcactcttggtttaagtagggcaaattagtaattaagtgctatataatgaacttgtataaacagaatattgaaggggaagccaaattaatcactctgctggcttgtttttgcccccattaatgcaccttttactcaggtccttcctgtgataccaggatgcattttctgctctcctctgctgctggagattgggtgggctgtgatagttgggctgacagatgacagtggactagatctggaaaagtcatgtgtaggggcctcgatggccatttcattttttaagccaaggctcatcagcacaagcctgcatgtgacgggaacagccttagacagtagcagggcaaggaagaattagacacaatgtcggtacccaaggaattcccagtctactggtggcgggaggttgggcacagatggatacagttatgaaaaagtctaaggtgtaatggcaaagactatttccttggactcaaatcttggctcagccacttaccttgggtgagttacttagtttctctgtgtctcagaggcctcacctgtgaaagattccattgcaattactctgcaatggaatgatggagcatttgaggagtgacttccactgtcttaagagggctgggaaagtcttccagaagaggcaacctttggctggtgacggagctagaactcagggtaccgtgggaccccccaggcctatgctcctcatctttgcagcatagtgcctcctctgaaagcggaagaaggagcttgggcctcaacccaggacaaatctctctccatttcagctcaacatagtaaatattagtaataacatctggatcctcagtctcatgatatgttagcaactacctgccaagtatgtggggtgaggagtagaaagagtaagtgagctgagtccatcacaggctgggtaagatgaaatcaaatggagcagcagaaagtagccctctaagtcaccttgctgaacctcacggtgatgccatctcctcggcttgctagctgtgtgaacacacctggctgggcaagctacttaatttctctgatctcagttccatattaactgaccccattgagtttctgcaaagattctgtgaatgaaagcacatttagcacaatgcctattcagcagaaaagtactattatcattccctgtgttcatttgatcttcaccacaaccctatgaggtaggtggcatcattgtgccactctattaagcaagaaattgaggcaccaagctattgaaaatctcgcctaaggtcatctagatggttagtggcagaacgatggtttaaactcaagtggtctggctccagccctgccctctgcgtatcccccacagccctgtgctttggagggcacctatagctaggtttgcatgtcacatgctagaaatagggtagacgcttctcaaggatgtccggacctctctctcactactgaggaagaagttatttccttctgcttgagggaatggtggggcagagcctacagctgtggtgaccctttgacaggtggggcaggtagagcaggcacaagtgactcaccagggagcattagccctaggatgcagtaggaatgcagctgctgcactgatcttggcagttttgattagtgaacagaataatttatttgtcattcatactctgcttccataaaggatttaagaaagcttacaataagtgactaaatagttactggaataaaactcataagttagaaatgatgtaaaaagaggaaaatacacatatatatacatataaacatgggaagataccagcaaaggacaaggtgatttgattctgtatcaggtaggagaaaagtactagaaaagtattagtattaatatttgtattcaaagtactgccaaagaatgttgaaaatcagattgttttaattctggattggtgagtgccacaccaaatatctatgggacagatctggcttatctatgggtctctgatctggactaggcagttattattatttttttttaaatgaggtctcgctctattgcccaggctggagcgcagtgacataatcatggctcactgcagcctcaaacacctgttcaagcaatcccctagggggttactttgactgaacttcaggcaaccaaggcaaaactgggaaaagtgtcaagtcatatggagtcaaagaattataccaattctttgaaagagaccacatttttccttataccaaattctaaaatcattatttctttaaaaatgaacttagaaatccttccatggaactcttatagaagaaggcagaattcattatataccaccttgctgagagcccagatcataacattgaaacctgacttcgggtctaggataggctgggtttatagctttttggagatgtcacttgactcagtgatagaaccaagaatacccagtttggtagagagatagcatgtcccttcacctttttccatgaatattccttcccttggccagctttgcaaacaaagctgtgttactgacctaggagtgtctcatagtacctcagtactaaagctttttacaagcctggcatcagagaagtgctaaaatgaagcacccgtcaatcgagaagggcaacagatgttgaagcatatcaaatatcagtaaacagcaagccacagagactgctgaacttggcatcctcatagcaaaaataccctgttgcctttaagagagaacgctgtggacttttataaaccacattaagtgatgtatttttttctccatttggacaattgctaccctatgaaatattttccctgaaagatggtctgctatcctctattatttttttttaatctctacttttttaagggcaaacttaatgctcacagagtgttctaggctctcagccctggaaatataggtctccagaaattgagaggagtttcatattcagcttatctagtaccctctcttttactattagccgtatgattcatattataagtaataaatcgagctgtatttcaatcctgtagctgtgcactagattagtccctttacctctctaagcctgcttactcatttgtataaaaataagactattaagaacacatacctcatgcaattgttgtgaaaattaaatgagatgatatgcaagaagtatttggcacagttgctagtatgaataaactctcaatgagaggtatacaaaattatagcaatatttatgatgatatctatcattactattagctgactataagtcacatgctgtattaatgctttacatatattactgaaaggtggctgggctggtcctttgcctgtttgctctcagagagtgctccttcccctgctctgctgtgtgttacacttcctaggctctcttgcacctggcctctgagcaggcttggccattgggaggtaatggtgggagaatgactgatgtgcaggcagaagtcaggtcatttctccccttcactacagcagcagctgcattttctgtctgattccagctcccagcctctctcagatcccagttctggccactcagcttttctttggtttccgttctatactgacattccctgttcctggctctagtcacaccactgcctcctgtcatcccttgattcctaagaggggtagcatctgtctgctgtcggtaacctctgtgtggcttcaacaacctgttgggcttctaggtctcttctgtcactaatgaaactaatttcttttttttttttgagacacagtctcactctgtcgcccaggctggagtgcagtggcacaatctcggctcactgcaagctctgcctcctgggttcacgccattctcctgcctcagcctcccgagtagctgggactacaggtacccaccaccacacctggctattttttttttttttttaagtagagatggtgtttcaccgtgttagccaggatgacctcgatctcctgacctcgtgatccacccacctcggcctcctaaagtgctgggattacaggcgtgagccaccacgtctggctgaaactaatttcttatatttaattcctcctgttcaaagacctagagtaggtctttgggctacctagctaacttgactggtagtccagctacctgactggactctgactgatatcattgcttttaactactaaaagaaaaggtagtccttatagagaattcacttctcctcctctccctgttggagtgagccaagccaactggagaagggatggctggttatcatggagagacgttcacttggactaaagctcaaaagacaataaattgacctaagcatctttgatgaatactgcctatacacccagctgagtttggcattgaggccaggagcctcaggtagcttaccccctctctgaggagacaagattcaagtacaagtcatagccaagcacactacaagatagtgtctagtcagaaggaataggaactcctctttcttgagccagagccctggaccattcactattctaggtaagtaactataatagatatgtgattattctcacatgaaaaatgaggaaatggaggctcagagagggcaagtgatttacccaaagtcacactgcaattaagtagtggtcttagcagcttaagtctgtatgtcctagaacctgtttatgggacttatatctgttcctcaaagttttctaatctttttgtcagtttcaaagcagatagtaagaaaactacatacataattcatattgccctggtcttgtagaaatgaccttacagaaacaatattcagccttattcacctaattctcagaacaggtttatgtggaaagtttattgtgttcattttttacagatgacaaagcagaatcaaaaaagtaaaggaatttacccaagttcataccgaacgttcatattcaacctggaatttgaatgcaggtttttctctccccaagcatatgctctttccacttggggacgtccaagaactggaccatatgtagtataagaccaagtgttttttagaattttttttttttttttgagatggagtctcactctgtcgcctaggctggagtgcagtggcgcaatcttggctcactgcaacctccacctccctggttcaagtgattctcctacctcagcctcccaagtagctgggattacaggcacctgccaccacacctggctgatttttgtatttttagtagagacaggatttcaccatattggccaggctggtctcgaactcctgacctcaggtgatctgcccacctcggcctcccaaagtgctgggatgataggcgtgagccacctcgtctggcctagacatttttttaaaaggttggggagaaaggccaggtaccctatcttccaggaacagacagttgggttagagaagtatatataaagtgacctgaaaccagagagtgctgttgcataatctactctctggtagtgactaccagcaggaaagagtagcctggctttgtgtaagaaatggggcttgaaatgggctggagtggaaacattaatttaggacaggcagagaagcagcaggaagagggatttttagataaaggtgctggtgagagcaaagaaacagatacagacagaacggagatcaacgttaactcctgggaagggtcccagttcaggagtagtgaaaaagaaagttggatagataggaccacagttgattacaggtaggggttgttaaccacaaacagatcaattaggaatttgatcagcagtcttgggagtactttttgctcagtattcccttatcctttaactgtcttttaaaaaaatgttgcaagctgatagtctcactttaaaaaaaaaaacgttaagtccttcttagataatactgctttctgcttaagaaaaatagcttttaaattagttcagcctgtgagtaataataaaagtttattacttatctctcacagttttgaagagtctctaaaatagaagggaatactctttaaatgcccctaaagtgctatcctctttcactacagttcatttgtgtatagggtgttataaaatcacacatttgagaatttcaggatggagaaagcaccttctgaagcaatgtcattgagagatggggagcaagccactttctaccagctcaaaatctactccctcctccctccccaacccctccctgacacctgggcctagaggagcctgtgtgttggatagagttgacggcagtgaaattcctaccaagttggccctttcagtttcacctgtcagtgtctctgatgaagagggatcttgacaaaccagactggtttggataattggactacagcagttgtcttcatctcagtaaactgactaaccactacagaggctggaggagaaatttatagaaaatcctaaaatggaaattgaagcaagtgtttcaatgactaggaaacaacaggctttagtgaggttccaacatattatagtatggtggggtgctgggactcctgtcttcaaggggcccctaaaagtgatagaggggattcatttagtatgccccagctgccatttaagcactttgtggttattggctcacttagtcctcacaacggtcccatgagatcctgatattagttgtactttgcacacaaggaacctgaatcaccaagaggccacgcgctttcccaagcttacatagctggtaaaaggtgaagctcagatacaaacccagattttctgactctgtggtctgttcactgtaaatactgaaacccatctctataaagctcctttgggaaactcatcttggtgaggcccacctctacacggccctacccccatgtgcccatctcttgcaccgcccttagatgttgccatgtttgctgatctcactcaagtgtgagcttccatataagggtccaagtcttactgatccttagccagtagtcagtgctggatacatgtatgctgtaccagactggaggtgaagttttacagagactttgtaatcttcctgaagctggctaagaaggcagccacctgtgactagttacacagaaacccagccacttaaagcagtggcactgctggggatggacttagatttaaagtcgctagcaggtaaaatctgacctatgtctccagaaacaactttacttgtgcacattagctgtgactgtaaactgctgcttaacggttctcacttgctctaatttttcaaagactgactccccagtcattagagtctgttctgttactagtaactcagtggatgatctggaacaagaggtctacctctttgggccacagtttcctcatctttaaactgaaagaatcagattctggttttcaaaaatgtaaagcagtggaacctttgggaggccaatacagaaaacagaaggtgaactgtgtctctggcttatccatcacaccctctttccccactgcctggcagccttggagggtctttgctgaacataagcactggactagatctttccaaaggaaataactgaaaatattataatgtttaataatgatacttaataattcaataataaagtaacttcaaaatagcctagcctaccttgagaaaagcaggttggagggccctcaccatggggtcactgtgcctgtctgtgttactgtcaaacattgtgtgttccaggcacggaggggtgtcagctcagcctgataatgtacagtggattggggaagctaaagcctctgggcctcattctccttggctgaaaacagactgcgtgtcatggcactggtgaattagaaattctatccagccactcttggagattgattttccgtctggggatctgacctcttgcttcactagcagaggggatcagactgttctgggaggagtcaacgagctggccctcagaaaagccttctctttcttttttgttctttttttttcttttcttttttttttttttttaactgtatgtttcaaagggaaagtctgattactttggggacttaacactaccagtttgaattcttcttggtacttacagccttaagatatccatacacccccacatccgtcctttgtgctagaagattactgaagatttaattccatttatgtcattggatttgtaaaaaaccccttttggattcaaagatgaaggcctcacttactttatttttgtcattttcacagaccccttatgtaaatgcctcaagagtaagaatcttgctcaagtgatttttgtatctccaatggctaacaaggagcctgacatagagtagctgcttggtaaatatgtgttcattcattcaacaaatacccccaaggtacaacgataagaaaaataactatagtcctaatactgatcacctctgcagttgactggaagagacagttaaaaagataagtacaaataaatgtatcttgggttaagtgctataaaggaaaagaacaggttcaatggaaggaaaaattagaattgttgatacatgaatggaagtaaatgacccggacttccaactctaaatctctgtctcatttcacctctttgtaaataatcattgctattatgttaaatatcacaactactgtcatttcttgtttacccactacattctaagcttggtgctgacatctttgtatttattatataaaattctcaaaattactctgcccgttaggctttcttatcacttattccaaatgcaaaaataaggtccagggaagataattatgtaacttgttcatgattggagagctaataagtgtcagagatgaattgaaccaaagttggtgtgacaaagcctctgttttaagcaaaagggaaaaaaaattctcattaactccaaggattatcatcaggagtccaacagggttcccaatttgggaactactatatcattatcatatggcaaatggtccactatgttagatgagaggacaaaaaaaaaaaaaaaagttgggggagaaactttgctgtagagtgggagggaaaaagaggaagatagtcttcttgcatgggccgtcttatcagcctagcaataataaactatcaccatagcaacaggaagtctaattgatggcagatgttgagccactttaaaagccacgccaactgaatgccaagctgatgctgtaaacctctctcctctcccgcggctagactaatcatgctatggtcatattggagagacccatctttcaagggtggaagaaactctggacttggcatcagaagacttgagtctgagcctcacatctgcccgtgctgagctctgttgccttgagcaagtcagttcatcaaaagtagaagatagttatcattaattttatcatcattattactaccagtagtaggaactctctgaaattcaatttcacaatctaaaagatagataatatttgtgtaagcatcgtcagaaggtttaaatggaataaaagatgtggaagtgcttagtaaactataaagtaattcacaaatacaaaatattaacaccaagagacagcttgacgtgctagaaagagtttgcattggcatcagacagatatggctgcttacagactgcttcatctgaacgcatcacttacatgctcagcctcagttttctatcagtaaaatttcttagtgtaaatctgtaaaatgttctacccatgttacaaacctgtggcttaattaacctctctacacttcagttactcctctgtaaaatggaggtggcactggcacctccctcataaggtcgttgtgatgattaagtaagttaatacaggaagaacatttagaacagtgcctggcacaggcagcgtgtcatacatattaatggtggtaatggtagtggtggtggagaagaagaagaggaaggagaagaggaggaagaaagagcaattgaaatcatatacgtgcatagaactgtgaaagctggtggtaatggtagtggtggtggagaaggagaagaggaaggagaagaagaggaaggaagaggaggaggaagagcagttgaagtcatatacgtgcacagaactgggaaagctggccaggctcggtggctcacacctgtaatcccagcactttgagaggctgaggccagtgaatcccttgagcctaggagtttgagaccagcctgggcaacatggtgaaaacctgtcactacaaaaaatacaaaaattagctggatgtggtggtgtatgcctatagtctcagctactcgggaggctgaggtgggaggattgcttgaacctgggaggcagaagttgcagtgagccaatgttacgccactgcactccagcctgggcaacagagtgagaccctgtctcaaaaaaagtaaatggccgggcgcggtggctcacgcctgtaatcccagcactttgggaggctgaggagggcggattacaaggtcaggagatcgagaccacggtgaaatcccatctctactaaaaatacaaaaaattagctgggcacagtggcgggcgcctgtcgtcccagctactcgggaggctgaggcaggagaatggcgtgaacccgggaggaggagcttgcagtgagttgagatcacgccactgcactccagcctgggcgacaaagcaagactccgtcttaaataaataaataaataaataaataaataaataaataaataaataaaatactgaaagctccatgtgatacaagtgaggacctccatagtcaatgtcaaaatacttttggtcagttcgtggactggttcacatgtcttatcagttttctcaaagtttccattgtctacatagccttttttgtcatgcccagtatgcatgcctgctctgatccttggctatgaagttttcaatgggaaagggacaaccaggacaaagaattggtagaaaccatgagaaatattttctcagagaccaaggtctccacaggccaggatttctcagagtcttcttcgatatattaaaaagtatttctggaaaaaattagtttgaaaactgctatgatgttcaagataactaggtgtcttttttttttttttttaaagagatggggtctcaatgtgttgcccaggctggactctaattctgtgcccaagaaatcctccctcctcagttttccaggtagctgggactatggatgtacttcacagtacccagctctaactaggcgtcttcatagcaaggcatctgttaagactttaaaatgtaaacatgcattgtgaatctcccaggttggataggcatagagagtatggtgtttcccaaatttacttgatcgaagaattagtttttcatggagcatcttactttgctaaagtttcaagtaccaaaattgggaaatgttgatgtaagcccatagccaagacaatcaagccttaagcatagtaccacaaaacaggtttgaaaactcctactaatccttccatcaattcatgtatctatttaacaaattaaaagagttctatatgtggcagtgactatgtgctagatggtggagaaacaatgacaagcaagactagtatattctctaccctctcagagttctggtgggcctactggggagagggaaaagttgcccactaattttattgcaatgacaagtgaaaagatggagaggacaggtgccatgacaccgggagcagcggcttcttacctaacctggtgggtcaaggagagtttcccagggaaaataacttctaagtggagacccaaaggaggagttacagctgtaggacacataggagcttgcaacacactcgcccatgcattccatgttgtatcctcatgacaacctttcttggtagatgcaatgagagtggtaaaagttactaagtggtcattacgacctaatgagttcctactcaatgagtcaggcactgtgctaggcatcttacaaatttattgcatataatcttgacggcaatgagcagtatcctcagtttacaaatgagaagttgaggctcatgggagataagtggtttcccaaccctgtacatgtagttagtacaaaaccaggactttcagatctgcctgattccaaagcccattacactgtggtcaaccagtgctgggcctggaccgtggctggtccataacagggtttttactagtcagaaatacggaagagtaagcagaatgtcatgagttcttccttaagctaatttttttcttcttaaatgacatattatcctgagatgtccccctcccaaccatttgatgtagaaagtcctgtgggttttttttttatatattacttgtcagagaaaactttgagcttcttcttagcaaaataaaaactttctaaccatatgtcagtctcccaagtcattttggaagtgttgccatctatgaaatctaaaaatcatggaagttctgtgtatgcaactttctagaacatattccttctaaaagtgagagaaatatgaaccagcacattgctgtgagttctgctggttcaaaattggatgagttgctgaattccatgggcaccagcagccaaaaatggagataaaataagatcaagtgtcatcttccaaaatgtacagacataccaccagtgacattcaggcattctacgtcctggtttatagacaccctttttctaagttttaatagatactagaaaagtacctagcattaaacctgggttttcatgaacatttttccctagaaaattttaaaaagaaagaaaagtttttttcccaggacttaaagaaatattttatgactaatcaatactataggtagtacttgagaaaagaaaataattgtgaagataggacctgaattactaaaatgtgtgaaatagtacgataatatgtataaaagtgcctcatgcataaaaggccccagtaaatgctttcttcctccctgattcacatggtgagcaagtggcgggggcccaggactaaacctcatagcatcagactcccagtccagtgctccttccaagaggcctttcaattgttttctttctgtctacctacctcacactgtgtccttcatctctctgtctagcccccaggaaaagtgcagcaagtgcaggtatttctgaaatgacgagtggctcgcaaaaaggatctgatgagtgttaatagtaagcaatgtgtacctaagagtgtagacactattagcatttggaaaaataggaatctgaactgagaactggaagggcccttagagatcatcccacacaaaccctctttttacagatgaggaagttgagacccagaaacgggaagtgctttgtgcatggccagagagctcgttgctgatcaaaccaggacaagcatccatatgaaacacgcaaatgtaaaattacatgaaaaaaaaaaaccctttacctccagatgtactgctttccagaaaagtggcgaggaaataccacaaaaatacctttacttcaaaaaatttgaaaatgttgaaggtcatgcttcatattgtgccaggcaagagaacattgtacataattgtaaatcaccattggaggaggtggtcctggttgtattcttttgtttgtttgtaatacacataacataaaatttatcatcttaaccatttttaagtgtacggtttggtggtattaagttcattcacattattgtgcaaccatcaccaccatccatctccggaactcttttcatcttgcaaaactgaaactttacccgttaaacaataactctgcattgccccctcccccaacccctagcaaccaccattctactttctgtctctgtgaatttaactactctttagatacctcatataagtggaatcatacagcatttgtcttttgttgactggctaattgcatttagcataatgttctcaaggtttatccatgctgtagcacgtatcagaatttccttccttcttggttgtattcttaatgcaacatagcttgttctctgtgatctgctgattataaccatcgtcgctgtgaagactttggcgtgcttaacatttttgtgacttctttccagtgggggaaatagatagctcagttgtggacgatagcagcaatgggaagcagtatttgagaagaaatcagactctcttcttccagtcttttgcaagtaggtgacacaagaggtaaacagaattgcatgctgtgcccctccacatcaccccctattttctttgtttcttctgcccaaggcttcagtcaatcagagaagcaatgagagttgaagattttaaaagtgggttttcaaataagacaagcttgggttccagtcctacctctgaaacttactaaatatgtgatcttgggtaacgtgattgaactctctgagcctcagttctgtaatctgtacatagagataataatacttttatcaaaaaagcatgtcttttttttccttctgattgatgagatgctttctgtattttttctggatttaaacatagtttccaaagttaaaatattaatagtacttttccctgtcccattgggttgtttagaaatgtaatgtgatatatgacattttggcctctctgagatgtcttgttccagcccaaagattattagggaacctcatgtcatttgaaaggggagaaagataatttattgataaggttctgcatgtcatatgtatcatttttttctcatcaaaaacactgagtagaactctattatgatacttggtcctttacttcatacttttctatcttcccagctagtcagaaccatgcccaccccgcagttcccaccccttggtcagtacctagcattatgcccagaaaaactacagatgcttcttcacactcccctccaacccccacacccccattaccaaagtgtttctataatgctctgggaatcagcatctcaattcccccatggcctcatggttaaacataccattcattcgacctctcaactgtgacaaagaaggaagcctgggtgtagaaactgatttcagctcccctctgaagttgggcgtctctctttgctgaccacttgggaatttttttttcttgcttctgacccacctctcccctttcttttgataaacaggacagctgtccccaaagggatgaatccattacctttcaccagagttgagttcgttttccatttcatctttctgcttaaagagaaagccctttaaaagcgcagcgcatacattgagtgcgtgtacttaatttttaatatgtgtgtgcccacagccaagagaacagagaaccttaaataataatgaaactgaattgtacatgtcgtatgttttatgtggcactgattcctaaatatgctcctagcagccaggtattatttaatacatccccattaatcaagctgccaaatctaaatgaaaaccatgtttaaatatgtttaataagattatagcttttggttgaatatcaaactaacatagctacatttttccttccagccagctctcatttactgtcttacatttttactctgaaagcttttgtactatcaaaccaatcttgattataaaacaaattataccacaaacttttagtatcgtgagcttcagctgagtccctcagtgtaaatgttaggagaaagaacagttctgagattttttttctggctaaaaaatgatatttttcttcttcttggggtgagcctttgagtttaaaaggaaattaaaaattcaattagagatactaaattgtttgtagcttctgtattaaatgatgtctgccttttgcatagttattgaaagtgtttcatattaaatgtactttttctttttgacggttcaggcttctgttagttttgcaatagtgacacctaggggctgtagagaacattgcatgggctgctaaaatctcaaaaacaacccctctgctcttttgccatggatagaaaaagtatttgtgggtcattggggctgatggagaaagaaggcaaatggtaccctgggcgaggtaggtttccagttctatttaccaggcttccaatatgcaaacaaaaaaaggaggtaaataaaaagaggtttttataaaaataaagaactagctgaacttggagtaacatacagtattctagcagatttttaaagttattgataaaacaacatcatatttattaacatgtttaattctcgttcttatttgcaacagtttgcctgctgttcttgcctttgtaacaggcatgtcccgcgttgattgcagagaagtgatgactgtatgtggtgctttgacttgttctgtgcgaatgtctcgcttctcacatctctaattcttctatttgccttgttcaatattctatatccatattcacccttataaagttgtcattgagacttttagcctatttgttctctccactgatatcattatttcttctagcttctcagagcccttacattttctccatgtttatatggcttgaagcttttaaattcttgatcaaagcaatcataaatgtgtctgttacaaacacattaaaattcttcgattatataaaaactgacaaacaagtcttataaaactgtttttgtactacattaagttcaaaataggtggcacatgtttaactttgtacactgtaggaattctaagaatcatttcaaaaagaaaaagcaaatacagtgcacagcaatgcatataattcttatagatgagtattatctatctgtcatatctctctgtaaataatgatggtgacaatgatgataggcaaagtttattgatgttttttatatgccaagcactgttctaaccactttgcatgaattaactcagtcaccatgggacaggaactgttattatcccaatttttacccacattcacagaatgcttctgtgttccaacaaggaaacttcaacaaagtagtgcatgagcttatcacaggtcgtgtgcaataagagtttatgttattagtttttccttgaactgcttgggagtcagtgtcacttttcttagccccattagcctgccctccctttggagtgtgcacgtctcctttactgtctgatacctgtctgctttcctcactgagtgcctctagctttgtctagcaacacctgccctcatagaacttacattcagttgggaagatcctaagaaacagcaatcacaacaagtaatattgatttcaggtaacaagaaatgttacaaaagaaagcaaagtgatatcagggagcaaaaatggaatgacagactgggtgtgaagggctggctttgtgagcaggagagaggccctcctgaggaagggatgttcgtggtgagtcccaaatgacagaaaggacagcaagtgcaaaggccctggagtgggaatgaattgaacatgtgtgaaggaaagcaaaaaaagcagggaggctggaatgtgttgagtaaggagaatactgtggggctcctctctctttcctttctctgctgccaacacttgtgttttctgtctcagactctagtttcactgaattcaaagaaatggtttggaattgcaaaatcctgagatgtcatccactgggagtgctggggatagggggacacgtgcaagagaattggcctaagaaaggttataccctgagtatcttccatatatacccatagccccacacatttttatcttgcaaagtcagttaagatgaacataaggcagaagtggaatcccagcacagttcatcctcagtgctccacagcacggaacagaccttggatatcgtacttcacacaagtttggtgactctttttttatgtctgcctctccactagactggaaattgactgaggacagagcttatgtcataatcattcttcagtcatttttctttcttgcattcattttatcagtaaatgcttcttgagtgccatctgtgtgccaaccactcgtactaggcccatctatctctgcttggataaaattccaagcaagaaagatacagtccctgctctcaagtttccaacagtattgcagaagaggcataccataaaatagcatcatacagtgtgctatgcctcagctttggggaggcagagaaaatgttccaaaggaagtgacagttgagtccagtcaggacttggaagtataaataaaggcgagtatatgtctgtatgtgtgtgtgtttctgtgtgtttggagaggggtatgcatgtgtagtgggcccgagatgggagagaatgtgtgcagaattttaaaccttgggaacaaaggattcatgaactcagaggtgaactcaactgtgtactggatgaaaatgtgaatgaatgagtacatgaatgtataaatgaatgaatcagtgagtgagtttttcagaggcagctcatgaaatggagattgtattagcgtgtttttacactgctataaagatactacctgagactgagtagtttaaaaacaaaaaaaggtttaactgactcactgttctgcatgacttacagtcatggtggagggtgaaggggaagcaggcaccttctttacaaggcggtaggagagagagagcaggggaaactgccatattaaaaccatcagctctcgtgagaactccctcactaccatgagaacagcatggtggaaacagcccccatgatccaatcacctctcaccaggttcctccctcaacatacggggattacaattcgaggtgagatttggatggggagacaaactatatcagaggtataaagccaaaaggcatttttattaatttaccctgagaaatcactattccaaattctgcccattatttccatgtaggcagactcatatggagacctatatctttatcaaaaatgtgcttgtcaagtagattattcagtgacttattgggagaaaaggttaggcattcatcttattgtagggatggctttatcaatggaactgcatatagctgatggccaatattcatctttatcctgaacattgcttagatgagaactatggggtaaacaaatgagtgaaaaaaataagttaaaatgtcaagggtgttcatagaagagagagaggctgttaatgtggtctagatgccagaggtggagagctggcttggaaagtagggactagattctagtctttgctgtactactctcttgtgtgacattgagcaactagccatcttcaaacccgtaaagtggaactatgccaggcaatgtctaaatttagtctctatcagctctagaattttgtgttcatcttagttatacctgctgaggagggagaggtattgaatgtgtatggacaccagctgggcagcttcctcatggtccctggatgacagctttgtcctggggcactcaatcctccagagtaccttaagaagctgtcctaatctgccatacacttgggagggttctggctgttaaccacctatgttggacacactgctgctattctccttccccacttttatctgttattctaaagtgatctgagaatttggctattcctgatgttgccttttcttatactccacgtagggagcctctgctcagagggttattcgtaaaaattaatgagatacatgtaaagcagccagaacagtacctggcacatgaaaaatagtttaatactatttgtcataattattcctgcagcccttcattgttgcctttcttcctcaggtattttctgccttgttctccaacaagcacaagggatacaggggtaaataggataccatctctgtgctgaggggttttgtccagtgctatttactgagtgccttccatgtgccaggcactaaggttaaatcattaagcccccaccacaatccattgcaatactcattatacccatttcatcttccaggaaagtgcatcccagaacagaaaagtcatgtgacattcccagcatcacacaattagtaaatggcaaagttggaattggagctccagtctcacagactccaaatccagtgttctttccaccatgtcacccagctaccacaaggctgccattgcacagttttgaaaggacaaagaagcagcagtgcatgatggaagtcagcataatgggaaataagctctccttccctgggcatctacttctaacttgcagaagaataggaaggctagtcttgtgagcccagctcccagcagtccttgctttagcccatctgaaaaggatctgtctttaaaagcaaggagccagaaaaaataattcatactaaaaacaaactctgtcatgagtcatttgactttgctttcccctgaacacatagtttatgtcttgggtgagctaaggctaaaggaacatctgatatgttttaggctagcagagccattatttaaggaacttcacatccaatgtgcgcccattggaccctatggtttaaatcaagtcttctgcttatggggcctgacaatttgttattcttgttgtagttgtattggagtgtgattgtgtacatgttttatcaagatgacaagaatcactctggttcatgattcaaaagttctcaggctgttgaactagcctatgcagtagttactctgagtatgtgcgctagacaggaatgtgtatatgtgcgcacatgttcagatgtgtgagcacttacagaaagagaagagaatgagagaaaggcggattccagctgagcatcttaccattcctatcagcagaagagcgacccagccctggggctgggtcagaggatttctcaatcctgggagaacagcagataaccccgagcacaaagcaagtgtttctgtctctgttgccaacttgcttttctttagatcattgaaaaatgacaggaatacacttactctgtaaaagcacgaacaatgtaggaatatatagagtaaaagcaaaaggcacaaacctctcctgatcccaaaagtaatcactattatgcgttttgtatgtctgtcttacattttttatgtattcacagacatatatatacacatatatatcatatagtagagattgtataatagaatactatactgtttaaatagtagaggatgaaaaagagataactttttttatctacaagatactttggaatatattaatacatataaagctgccccatgtctattacatgctgacagtaattccagaatctgcatatataaaaaactgtttaaccaatgtgttgatagacctttaggtagtttctagtgtttagctgttacagagacacaaagattattgttggtgtagttctttatatacaaatatgaggacttcttttagagaaatacaaaaaaaaagtggaatttctagtggaaggatttgtgcatttaaaattttgttagctgtggccaaaatgtcctccaaaaaagctgtcccaattcgtattcctgccaatgatgtccctgtgcctttgccaatgctggatattgtcagttgtttaatattttttgccaattttcgggcagaaaatgactgctcattgttcttttcctttgcctttccccattactagtaagaatgaacattctctttatacccatcaagtacttttctgttaatggcctattaatatcttttcttcattttcctatagggttgtttgtcctttcctcattgatttagaggagttctttatctgctctacataccaattctttatctatcattacatactgaagacattcttatagtatgtcccttcttatctacctttgcttacaatatctggtaccggagttttaaaacttcataaacttttatctgtgaatctctttatgacatcagaatttcttggaaatgttccctttaaactatttctttacttgaagctgtgtttttcagactgataatgttttagacttttatgtgcccaagagtaaacttttatgtgcccaagagttttagacttttatgtgcgcagtaaggactgaggaggtgagtgttttaccaagggcaaagctgagatcagaacataccaggctggcaggtccctgtgtttgttaaagacattcttagtaattttatcattaattatggggaaattctaaaactccattgggatcagccacaggcaaatgagatgctgcaagaagctggatactgagcatgcagcctgaagtcatctgagcgttggatcataaccagcttcctctacttaccacttgactttgagacataactttgcttctctgagccttagtttatttctctgtagaatggagctaatcacaacttcaaatgactattgtgaggtttcacatttcccatgtttcagcacttggtatctgctcaatacatgtttgcttttgccttttctggttaaagaccttttttcccctggacctttgaatgcaactggtcatctaaaactattgacttccatctcttctgaggatttttgtagccaaatggtggaggcatatctagcttgagagtctgaggcaatttcctgatgatacatctcagtgggcctaaaggaaacgaaacacctacaccattgctcaatgctggaaaattctccacagtggccgacccctttaggaggagggaagccagggctctggggaacagctcctgtctacgtgggtggagagttctttcttcaagcattgtggatcgtaaactcactgagcctcctgcctgtacaggaataaatttcccctgcctttgagatcatctcctcttctcctcacctcaacctggcatccttctcttcttaaggcaacacagcactagaggctgactgcccagcctcttgagccagacttcctggaattaaaacccagctctgccactctttacttgtgaggcctggagcaagtttcttaattactctctgcctctgtttccctggctgtaagatgagagtgctaatgttatctacctcacagagttgttacatgggtcactatttataaagtacttggcacatagtacagtactcagggagctactaataaatcatatatggtatctgaatttgggcttctcatttcacagccaattgactttggataatatgcttactccaagctcagctctctaatttgtaaaatgagtatgaaaatatctacttcatggaattgctgggcaagtcaaatgggataatgtgtgtaatgattgtaggtactcaagaggtggtagctactgtggtgatgagtatcaaaaaagacaggaatgaatatacagagactatcctaattctcaaaagccaagagactggtagaatgtggcctccacactcttagccctgtgaccttagacctaacctcttcaacattcagtttcctgatctgtagaattagattgacaatggtgcctacctctaggttcatgatgaagaaggagtaataataaattgggttcatagaaagtgcttaataaaattaattattattgttacctgtatctcctgtccatttaagggaagattcctatttgtagtcaggggtccctgggcagaagtgatgacagcacaggcagagggctgcaccccctgccctctccaactctggggatatagcacaaggtaagaaagagaagcaaatctaaggaagggaaattgagatcaaagcctggtttctatggatcaggccaaaatgattgagggagagagagaaacacaactcaggatgtccatcaggatttatctgcagcagtgtgtctcattttaactcttaaaacagttttgttggataggtactattatttccagttttgcctagcgaaactgcgagctggagaggttaagtgactcgcctaaggtcagatagctaaaaagtagaaaaactgggatttgagcccaagtctgtccaactctaaatccctaatgatatgcttttaatacatgccttgcctctgctgggaatgactcagaggccaagctgtaggaggagggggagagagggatgactgtgtttctcagggtgaacagagtaggcagccacaggggcagtaggcccggagctaacaggccttcatgtaaaaatttggaaattttgcctgaaagacaagagagtgttttcagctgaggccgttttcaactgtaccctgtgtactaggctgagggtaaaccaaaacacagccataaatagttctccacagaattctcgtcacaacagcccactgtattccttctgtttggagatgaatgttgaaacaccatgcatgaaaatggctgagtctgttgctgttcatgaagtctagtcacagcccattcaaatgaagcccccttggatgtgaatagagatacgagaatcagcagatgatcagccatcatggactcttgacaaatggctttgcccaaagaatcggcatccttggacttcatacaaagcaggccttcccaaagcctctgttttgaagggacccagtctgtttgaataggtgtttacccacttgctacagaatatgtttgtatacctgttctttaatttaaaaaagtatcaaagctagaagggactttaacaagtcatctagtccaatgcatttaaaagaaggggacatttggttccagagtaggaggtaactgtcctaaggttatatagagagaatccgagatgaaatccagggcctcctgtttcttagtctaaaacatgtctgactctgcccttgtgaatgcagccaatacagggacaaaaagtctttgggcttctctaaagggagggactgcaatgtgttagaaatgggaaggaggttatgtttgcccttggtgctttctacctttcccatctattcttttcctcccatttcattttttttttcctcatctgtcagaactaaccagtctaatgtgctcaattttcattccctaagaatcagactcccagatttccagagttactgctgtttacctatttcagagcttttccctacttcaactgggctgccttttgaacaatgaaagggaccctagaccaggggaataccaggctcggcccctattaagtgggtctccttggttaagacattgcctacccaagtgtcaattctcaatctctaaggtgcaggtgagaaagaggaaagggacaaatagtaattgatcacctgatacatgctgaactctaattatataaccagacttaatctttaaaggaggttatgtgaggtgggtagatattattatcttcatttgcaaatgaggaactagatttctagaaaggtaattcacgttctcaaagccatggaatcagaaagggagagagttgggacctgtacctagatttgtctgaaaaatccaaagtacaggttgagcagcgctaatttgaaaatctaaatccaacatgctccaaaatctgaaactttttgagcactgatatgacacccaaatgtcatgctcaaaggaaatgctcattggagcatttccagttttggattttggattagggatgctcaaccagtaattatttaatacaaacattcaaaaatccaaaattaaaaatacttctgattcctagaattttggataagggctcaaccttttaaactaaacctgtttaagctgtttcaagtttgccaagtaagagaaagtgagatgaatatatgtgttcatacacacacatacacacacacgcgcgcgcgcatacacgtcctcactctgtattagtccattttcacactgctataaagatactacctgagactgggtagtttataaacaaaacaagtttaattgactcacagttccacatggctggggaggccgcaggaaacttacaatcatggtggaaggtaaaggggaagcaggcacattcttcacaagacagcaggaaaaagagtgagtgcagaggaaactgccacttttaagccatcagctggcatgagaattctctcactatcacaagaacagcatgaggaaaccacccccataatccaatcacttcctaccaggtccctccctcaatacgtggggattacaatttgagatgagatttaggtggagacacagaatgaaactatatcacacacacacacacacacacacacacacacacactggaagagtgctttccaaactatgaaatgccgcccacaggtggacaattagccacccagtccaggccaagaatgaagtggctgtcagcatgccacagccatcacacaaggaatctacttgcaagtgagaggagcggaggaaacatttagaggcaagcacctatcagttaggtcagtagttctcaaatgtcactggagggccactgcaggcagggctggctacaatttgtatatcccccaatttgtgggacccagtgcaaaatgaaaatgtaggtccctgaccagggacaggaaagtcactccttccaacaggccttctgtctcaacctatggctgacaggtgacttccaaggctttccaaattctacatggaacccctctgtgtgttgtcagcctgacactccatggcagtggtagccagctggggtcactgccttgacccaccctgagacacagggggcccaatgtctggcctgactctttccacacctatgctcatctttatgaggagaagagcaagagcaaaacatgcccccacccctagccatgtaaccctgccaccaactcacagatgtgtggtcagcagtgggatggggcagcagaagacagggagtggatggccaagaactggccctggagactagccccattgttccatcaatttttcacctataaaacacagattcaaagataaaataggattccttatttaataaatggtgttgggaaaactggctagccgtatgcagaaaactgaaactggaccccttccttacatcttatacaaaaattaactcaagatggattaaagatttaaatgtaagacttaaaaccagaaaaaccctagaagaaaacctaggcaataccattcaggacataggcatgggcaaagacttcatgactaaaacaccgaaagcaatggcaacaaaagccaaaattgacaaatgggatctaattaaactaaagagcttctgcacagcaaaagaaactatcatcagagtgaacaggcaacctacagaaggggagaaaatttttgcaatctatccatctgaaaaatggctaatatccagaatttacaaagaacttaaacaaatttacaagaaaaaagcaaccccatcaaaaagtgggcaaagaatatgaacagacacttttcaaaagaagacatttatgtggcctacaaacatatgaaaaaaagttcatcatcactgctcattagagaaatgcaaatcaaaaccacagagataccgtctcaacaccagttggaatggtgatcactaaagtcaggaaacaacagatgctggagaggatatggagaaataggaacacttttacactgtttttgggaatataaattagttcaacctttgtggaagacagtgtggcgattcctcaaggatctagaactagaaataccatttgacccagcaatcccattactagatatatacccaaatgattataaatcattctactacaaagacaaatgcacatgtatttttattgcagtactattgacaatagcaaagacttggagccaacccaaatgcccatcaatgttagactggataaagaaaatgtggcacatatacacaatggaatactatgcagccataaaaaagaatgagttcatgtccttcgcagagacatggatgaaactgaaaaccatcattctcagcaaactaacacaggaacagaaaaccaaacaccacatgttctcactcataagtggtagttgaacaatgagaacatatgggcacagggaggggaacatcacagactggggcctgtcaagcagtcgggggaaggggagggatagcattaggagaaatacctaatgtagacaacgggtcggtgggtacagcaaaccaccatgacacatatatacctatgtaacaaacctggatgttcttcacatgtatcccagaacttaaagtataatttaaaaaacaacaacaaagaaagaattgaaagaaattgactgcaaacaattaatgcccagcttgggctctttctggatagagctctgtgcattgcacgggtgtattagtacattttcatgctgctaataaagacatacccgagattgggcaatttacaaaagaaagaggttccatgtggctggagaggcctcacaatcatggcacaaggcaaggaggagcaagtcacatcttacatgaatgacggcaagcaaagatagagcttgtgcagagaaactcccatttttaaaaccatcagatcttgcgagacccattcactatcatgagaagagcacaggaaagacccacccccatgaatcaatcatctccctccaggtccctcccacagcatgggggaattcaagatgagatttggatgcggacacagccaaaccatatcattccaccctggcccctcccaaatctcatgtcctcacatttcaaaactactcatgccttcccaacaatcccccaaagtctgaactcatttcagcattaactcaaaagtccccagtccaaagtctcatctgagacaaggcaagtcccttctgcctatgagcatgtaaaatcaaaagcaagttagttacttcctagatacaatggggatacaggcattgggtaaatacagccattccaaatgggagaaattggccaaaacaaagggtctacaggccccatgcaagtccaaaatccagcaaggcagtcaaatcttaaagctacaaaatgatctcctttgactgtgtctcacatccaggtcacactcatgcaagatgtaggttcccatcatcttgggcagctctgcccctgtggttttgcacggtacgacctctctcccagctgccctcacaagctggcattgagtgtttgcagcttttccaggcgtgcagtgcaagccatcagtggatctaccattctggaatctggaggtcggtggccctcttctctcagctccactaggcggtaccccagtagagactctgtgttaaggctctgacaccacatttccctttgcactgccctagcagaggttctccaagaggacctcacccctatagcaaacttctgcctgggcatccaggtttttccatacatcttctgaaatctaggcagaggttcccaaacctcaattcttgacttctgtgcactggcaggttcagcactacatggaagctgccaaggcttgaggcttgcaccctctgaagccacaggccaagctatagggacgcagggcaccaagtcctaggctgcacacatcatggggatcctgggcccggcccacaacatcactttttcctcttaggcctccaggcttgtgatgggaggggctgccatgaagacctgtgacatgccctagagacattttcctcattgtcttggggattaatatttggctcctcgttacttatgcaaatttctgcagccggcttgaatttctcctcagaaaatgggattttcttttctattgcattgtcaggctgcaaattttgcaaactttcatgctctgttttccttttgaaactgaatgcctttagtagcacccaagtcgcctcttgaatgctttgctgcttaggaatttcttatgccagataccctaaatcatctctctcaagttcaaggttttacaaatctctagggcaggggcaaaatgccaccattctctttgctaaaacataacaagagtcacctttgctcccattcccacaagttcttcatctccgtctgataccacctcagcctagactttattgttcatatcactatcagcatttttgtcaaagccattcaacaagtctctaggaagttcgaaactttcccacatcttcctgtcttcttctgagtcttccaaaccgttctaccctctgcctgttacccagttccaaagccgcttccacatttttgggtatcttttcagcaacaccccactctactggcaccaatttaatgggtgacacactcgtgcagctggtccccactgcaggtccttcacaaagcttcactagtccatgagaaatgaaacaataaggacagggtattgagattttaacaaaattaaatgtagactatttaaatgattctcctttattctgatatcatgataaccacttttttggtattaaaatctccttttggttatgaaataatggtgagagtaaatatggagcagttgctttgtttaaagtccttatataatcaaataaaaagctgacaattatgttgtagatctccaaaaagtttgaatattttattggtccaaagtttgagaactcctactctaagactttcaagaagatggcccttcccacatgtggggctggaacctcttcccctttcactatcatcagaaaggcttccgccctggatacaattagtatttgttgcatacttcagtattttctaggtatatctttgctttttggaagtctaaaacatctggtagaatctttcagaagaagcaacacagaatagaggcattaaaatcaaaatttgaagtctgaaacttctgtttcttaccatcattaagagagaagtgcccaatgacaatcatttctccaaaccatcagcagctccttggaaatgaagtggaagggtgataatatatccaggacagacctagctaatgtcttaatcttggcataattattaataataacattccctttccttccaaaaagtgtctaggactcaaaggtgagttcattgggataataaactatggccaccttaaatgaaggccccttcagctctcctgagctagaaagtcccaaagagcctgctctttccctgggcaggaagccatggtgaccagtggaaggattatgtctgtcttaccagaggcctgggttgggtgccagcatgaagcctgtaggatctacttagatctgggacttcaaagacctagtggtgggtgaatctttgtggcttccatcattgctttgtctctgggagcatcaagttgaaggccaagctagtttctttcctttgatgagggaaaatatgtcaacacaatggtccactgaactctgggaatagacagacatgtggtgtctttgggggattatagcctaaatggttttactctggcacatgtggaattaaatataaaacaaacagctgattgctgttaaattcacatgcataaaaacaaccattactatgtcttctcagctacagtaccagagagtccccctagaatcaagcagttattagatgggactttggagtgagtgtagaaaagaaaaggaggaggagaaggaagaaaatgaggaaaagaggaagaggagagagaaataacaagtcaaataggtggagagttttgaaagttacaaagtctgtgccatttagcatgagttatttttcctttttattccttgtatttgacatatgaaaagaaatctttgctgatactggcttcagattctcaggtttaagtatgctatccttgacccaggaaagagttacatgcatcatacttccgaggccttcaaagaacaacttggagcaagcttgagagtttgcagggcattttggtgacatttctggatgccctttgtttccccctttcaagaaaagccctttctttcgttgccttctcacataacagcttgggattcttgtccctcccagaaatgcatttgaacttgctgggtttgttaagagtcagggcatgaagcatttttccatggtagaaaagttctggcattccaaagcagaactaatgtgggatttgggaagcttgccctatttgtgcacttaattagagctcaccaaaagcagctgatccattggtaccataaaaaaccaatgctgagaccaaggaaggctaagactgtgagtacccttagagggtggtgaacatgaattccacacctgttccctactgactggaatcaggattcaaaggcaaaaagttgtgtgctttccagcaacattcattgggatccgcagcccaatttaatcaattgataggttgccagtgtctaagtcaagtcccgaaacacttggttccccttgggtcaatgaaatttggtcttggttctaatacaaactttaagttggctaaaaatggctgagaaaactactggttttagagtcagtcaagcctgtgctctaagtctgactctgccactatgagatgtcagatcttggagaaactgttcagttacttctgagctttagtttgcttcccggtaaagggacatactaacacctattccatgggtccattatatacacaacagccaacatttgttgagtaattactatgtgcagagcactgtgctaagagcacagtctatgttaactttttaatcctcatacagacctaaggaaatagattctatattggagattggcaaactactccccacaggccaaattttgcctactgactgtttttgaaaataaagttatattgagacacaatcacatccattcattcacatagaccctatggctgctactgtgctacaactgcagagttaaataattgtgacagcgaccaaatggcccataaaacctaaaatacttactatctggcccttcatagaaaaaagtttgcctctgctttaaattatctcaacttaaagatgaaggaaataagccaaaggtattaaaacctattttaagtaggttagctggggccacaaagctggtaacaggtaggactaggatttgaatcaaacagcctgactccagaacttgtgttagtcaccagtatcttatatataatatatatgaaatgcctagcatagtacctagcacacaggagatacttaatacatctgttttattagcatggtattccctttctttttacctcctttcccagtttcctatcaattccagttaccttttgcttttcttctgcaagataattcagttaagcatatttctggccaattctatgcccatgatctcagtctatccaacaactctatgaggttggtatcattattttcatttaaaagatgaagaaactacatcttgatctctgagctcccaggaatctttgcactccatttggggaccctcagaggaaacgttgctaggaacttttggaacatttgttttatgcggcaaactagcatcaaagaaaaaagaatctcagtggctgcttgagaaaggattacaatctaattagggagacaaaaccaaaatactgagacaacagcaggcattttaaagtaagttatttagtacagacagtaagtgagtgtgaattcagagagctgggaacaagagagcggacaggggaggggagggctctcaagtttcctggtcaaatgtgaactgtgccttgaatgacagactgaatttaaaaaggagaggctcagattcaggcatgatggaagcgggaaaaggaaccacagatttcctgcagaaatggaagtgagagctctcagacggacagaatcagcaaatccctgggaactgtagaaaatcagaatgagtaaataatgtggtgacagattctacaggattttgaaggccagagagaggtacctgggtttcagaataacaatagtgatcatcataacacttagttgcaggattgctgaccacacacatttcacatatgctcgcccttaaccctccttgtccattctgtgatgtaggtatcatcctgttttacagatatgaaaattgaggcttagattatagcaatcaaaggttgatgggaaaattagaaatattctgcttacttagttcaacagtgcagagcttttgtgttgttacgttcttccttggatacatgtgcttgtcgttgagattttatagggtaatctatataccctataaacccatttaatataatcataggttctgcttgttctaatactgttacctataaacaattccccatggactcagatggaaagtgccatgaattaaagaccttacactacctggaccactctgatactgcccaccacaggcaatgggcagctatggcatggtttagagcataggataccataatgaaaaggatcagttctttcaacaaaggccggatgggaaagacaggaaggaggaaatcgtgtgaacccagaagtgtgatattcgatggagaggcaatcctgggatgaacacccagagcttgggtttgggatggctgaagaacttatgccaagaagagaaggcacacatgtagattgagaaggccatgaccagcactgcttaagtcttaccacttagtcatagttgagggacataagacttgaagtatggagatttaggctcaagtcctagtctcacggctactggcactatgtgaagaaggacggaaaaggcaagaattatatgctgattgagttatgcaatatattgtgtcttcccatcaatagcacttaagtatttctgtgtgccagcactttctaatttctcttctaatcgcttaacatatattaacttatttagtcttcagagaaaccctattagattgggggtattatcatcttctttgtatagctggggagactgaggcacagaaaaggttaagtaacacacctatggtcacacagctggtatgtagagaaactacactttgaacccatgcagtttggcccctgagtccatgctcttacttactgtcacattacctctcaggagaaaacaggataggtgttacgagcccagttttacagatgatgagactgtgggtccaagaccataagggatttgactaaagatcaaacaactaaacaaactgttacgctggcatttgaactaggtcttcctaattctgatccagacattctttctatcagatcacactgcctcctgttggtgtgaaagcattttacaaccataaacctcctcctgtttattaacacattattatgatagatataaggcttctctgattcagtaggaaaactaaggaggtagatcagccaagctcgtggttggtagtaataaagggcttgccttctagacggtgactccctccaggagagccaccaaccagttcctaacctctgtttcttgcagttcctacagagcctggcatggggcagagggtggctctctacaaatgtttgttaaacacaacttgttccagatagaagcatgtgaggctctccactaccaccagtggcatagcaggcacacccatgcattagcgacttgccctctgccaactcctgggatggtgatatgatgatggttctttgtaagcttgtcacttgtccctcttccaaagtgagtttacccagaggagcattctgaggttgaatttgtcccataccaccccttcacctacacattgacactccccgctgtataccatggggtcagagaccttgcactacaaaggccccttgccaagcgtggtattgcttgcagcctgtctgaggctttcactactttcccccagactctcagcccctggcctcctggctcatggccactcccagtgcccttagctttagcttcctgacccccctataactggcacccaggaccacttcaccagcttccttctcagaacaattgacttttgcccctggggtacttatacctcttttgttcaaggtcacaccccagctcaacacccaggatccaccctgccagcctgtgtgagagccatccccactagactttgaaagggactggacagtgtgttcagccaccttctcaagggcctgtccctggcagctttactggtcccacctgttcctagcctaggagctgccaatccaacaagatgaggctattctgggaagaagcaggaagacctcttcaccctaattgagtctttcttaacaaagaagtcaacagaacttttttttttaagtgttttaaatactgcacaggatgctacagcagttaagagcatggcctctggaatcagaaggatatgagttaaaaatccagttctgccacttgctagccatgtcatcctagggaaattacttaacctttctcaacctcggtttctcatttgtaaaatggagctaaaaaaggcccacattactaggtaatcatgagaattctgtgaaatgatatatgtgagcatatgtcacagcatgtgacaagcagtagatgctcaataaatgatagttattatcagcattatattaaatattattaaagtatcttttaagactttctggagacatttcattcagacagttatttattcaacaaacatttatcgagagcctgcatttctccagatccatgctgagtgcaaatatgggatgtataattatgtttataaaaaagagcggtgcatgttaatcacttactataggccagacactgttctaggcattttaggaacattctttcatttaatattgataagggccttgcaagttggcagaaattataattgtcattttagagatgaaaaaactgaggttcagagaggttatccccaaaaagacatgacctgtgattgagtgtggcatgcatcacccttaaataaaccaaaatattttaagttcaagtccccactattgagagatcgacaatttactcccatgtagtagaatgcctttatataactttcttgttaaagtcaaggtcagagcaaagtggtgtgatttcctcctcattggtaaaaatctctgtaagaggtgagtgttctcgtgcctttgttagcatgccagcaatgagcctggggtctctcctctgattactggggatttcatcatcattcaggataccttctctcattatgtgggactgaaaatagagatagaaaaggcaacaggtaaggggctcatagtgaactcacccaatgcatgctttgcaagttattttgttttttaagcaagtcccagtcatgatcttgctttcggattcatgccttatgcctgtagccattgaaagccaagtatgtcagggggaaaaaaaggtccttcagttagctgaggttttattctgtttctactttggtggtttgaaactaattacagactcggttgtgcctacatgtgcaaaatgaaatgagaggttgagccaattactttaataatgaagagaggaaaatccacttttctttccattatctaaagatttcaggcatatgtgagttttatatatgtatatattaaattatgtgaaaaattggcctcaagccttcatttcactttgcctgtctagaaacagactcaaattttgtttcggaaaggagatgacatgccttaggcatcttccaggagactagagggtcttgttgtaacaattgcagctaagattgattttcttattgttatgatgaatacttgtgcctgcctgggggagggaggtatattatgaaggatgacttttaaaaaaaggctggaatacctagaataaactttaggaggaagtttccactcatattatttattcattcatttatttagttcttttcaggacctgcaaagccctcctggcctggtgctcactccctttctaatttcatctccttctgccacttgcccaaactgccccagcaggtctggcttcgttgctctctttccattcactgagcacacttccaactcagggctttcaagcttacagttccctccgtgtggaatcatctttccgttgattttttcattgttcactccctcattcccttggatctctgctcaaatgtcattttatcagagagatgccattcctagtcaccctatacaaactgcctgctccacgcctaccattctctgtcccccttgccctacttgatgtttttttctccctagtacttaccaccatctgtgtgatatatgtgcatgaacttatgtgttattttgataaacatgaccatatattttattttaataaactttatttttagaagagttttatatttacagaaaaattgtgaagatgatacagagagtttttcttttctttcctttgtttttttttttttttttttgagacggagtcttgctctgttgcctaggctggattgcagtggcacagtcttggctcactgcagcctccacctcctaggttcaagcaattctcctgcctccgcctcccaagcaactgggagtacaggcgtgcaccaccacacccggctaattttgtatttttcgtagagacagggtttcaccatgttggtcaggctggtctcgaactcctgacctcaagtgatccacctgccttggcttcccaaagtgctgggattacaggcataagccaccacacccagcagatacagagagtttttctaaaccacatacttagttacctttattattaacatcttacattagtatggtgcgttcgttacaattaatgaaccagtattgatacattattattattttattttatttgttcaccagtttggaatgcaatgtatttttaaacagagtgaaagacacctgacaggtaactgaacaagttagcattagctgggcccaagattaaccaacttgtatcaacattcacagacttctgcagattccctgaggacagcaatatccaatagtgtttacttgttttgtgagcacagtaatagaagcaaagcgagacctttgttaattaaagcacatattttatgcagatttccttagattttacctaacatcccttttctattctagcatcccttccaggacaccacgttacatttagtcatcatgtctccttaagcttttctggcttttgatgaccttgacatttttgaggagtactggtcagatactttgtagtatgtccttcagttgagatttgtctaatttttttttttttcatgattggagttttggtcttttgggagaaaacagaagactgacaaagtaccattctcatcatatcatatcaaggatacttactatcagtgtaacttatcgctattgatgttggccttggtcacctaaggtagtgtttgtcaggcttctccactataaaattactctttctccttcctttttacactgtactctttggaaagaagtcactaaacacatctcaaacttaaggagtgagtgagaagtaagttacgatctacctcctcgtgggaggaatatctacataaatttggaattatgctgtttgggagatttgtctcttctcatttatttattcactcattcatctgataactcatacatatttatatttttggttataatccagtactactttgttttgttactcagttgttccagttgtagccattggcaactcctcagttggctcctatgaccctttgacataatcccgtaattgtgtgtcttgtgaggttttaaaaaattattatattcttactttctggcactacaaggcactttaggctaattgtgcatatttcctgctccagttctggaatcagccatttctccaaagagtctgattcttttttttgttttgttttgttttgtctgtgtgacggagtcttgctctcacccaggctagagtgcagtggcacgatcttggctcactgcaagctccacctcccaggttcatgccattctcctgcctcagcctcccgagtagctgggactacaggcacccgccaccatgcccggctaatttttttgtatttttagtagagacggggtttcaccatgttagccaggatggtctcaatctcctgacctcgtgatccacccacctcggcctcccaaagtgctgggattacagacatgagccactgtgcctggccagagtctgcttcttgttactggagactggtggttagacaccaagatttgggcactaagtgtgctcattgctcttgggctattgtcaatgcttcttggccctcccagctgaaagagcaaggaaatgtgtatgtaccctaacccatgtatatacccatatctataaatatttctgtatgtaatcatctttttgatattaagctaaacatgaattcacactggtttcctactgtaatctattgccacatggatcattctaactcgctctccttgcttatatttaaattccccctcaaataatgagaaatctggctcccaccatctgccatccatttacttaattattcaatttcagtatacatgtatagaaataccagaattgttaactcataccattgcagaatacaactttattaactggaagacagtacttatatacagttttcttggcattttcttgtttttttttgggggggggtggttgggggtttttttatctttagtttttcagactctactaatttctgaagttacttaggtcagcaccttaatcacccaccacacagagtgagatcgttttatacactagtaacacagttacattgtttttgacatactacattccatcatgggatcccccacctcctgaatttttaaaatttacgtacattaaggtttactttttgtactctaacattcagtggttttgataaatgcataatgtcatgcatattcaattacaatatcatatagaatagtttcagcaccctaaaagttaaaaatcccatctgggcatggtagttcacacctgtaatcccagcactttgggaggcctaggcaggcagatcacatgaggtcaggagttcaagaccagcctggccagcatggcaaaaccccgtctctactagaaatgcaaaaattagccaggcatggtggcaggggcctgtaatcccagctactcaggaagctgaggcaggagaatcgcttgaacttgggtggtggagtttgcagtgagccaagattgtgccactgaactccagcctggacaacagagcaagactccgtctcaattaaaaaattaaagttaaaaatcccccgtgttggccaggcatggtggctcatgcctgtaatcccagcactttgggaggccgaggcaggcagatcacgaggtcaggagatcaagaccatcctggctaacacagtgtaaccttgtctactaaaaatacaaaaaaaaaaaaaattagccaggcatggtggcaggtgcctgtagtcccagctactcaggaggctgaggcaggagaatggcgtgaacatgggaggtggagcttgccatgagcagagattgcactgctgcactccagcctgggcaacagagcgagactccatctcaaaaaaaaaaaaaaattcccctgtgttttacctctttaactttccctccttttttcccaactccttgacgatcactgatctttttattgcctctatagttctaccttttctaaaatgtcacataattggaatcttgctccacatacttttttagcatttggcattgttcgtttttttattttagctattctaataggtttatagatgaatgtcactgctgttttaatatgcaatttttaatggcaaatgatgttgagtgtctttatatatattatgtgccatctatatatcttctttggtgaatcacatgttcatatattttgcttactttttcactacattgcttgtttacttattgttgaattttaagagttctttgtatattcagatacaagtttctttatcagatatgtgttttcttctagtttgtggcttgtctttccattctgttaaaaatgtctgttgcagagcagttttagaattttagtgatccagcttatcaatttttttcatggattatgcttttggttttgtatctaaacttatcacctaacccaaggtcacctaaattttttcctgttatcttctagatgttttatagttttgtgttttacaattacatatgtgatccactttgagttaatttttgcagaatgtctaatgtcactgtctaaattcattgttttgcatgtggacatacaatatttcaaacatgacttgttgaaaatattacactatatcctttgaattacctttactcctttgtcaaaggagttggaaaaggaataaatcagttgactctatttgtgtctatttctggattctctccttggttccattgatctatttgtcttttctttccccaaccttacactgtcttaattattgtagctttacagtaagtcatgaagttgggtagtgtcagttcactgactttgttctttttctttagtattatgttgactaatgtagatcttttgcctttccatataaattttagaatcattttatggatacttaaaaatagttcgctgaaaattcaatttatttatttcatcagagttttgtaattttccacatatagattctgtgtacttttgttagatttatacctaagtgtttttgtgggggttttttttgttttttgttttttgttttttttgcagcatgctattttaagtgttatttcttaatcaaattccattttttcctcaatggtaattgctagaaagaaattgactcttgaatattaaccctgtatcctatacccttacttgtttgcttattagttccaggatttggtggtgttctcattgggtgggttggttgatttgttcattctttgtgattttccacatagacattcatgtcatctgagaataaagacagttttctttctttctttccagtatgtatgccttctcatttctttgtctttttgcactagctaagacttccagtacagtcttgaataggagtggtgagaaaggacattcttgctttgttcctgatcttagtgggaaagcatccagttttccatcaagtatgataatagctgtagagtttttttgtacatgttctttatcgaggtgaggaaaatcccctatattcatagtttgctgtgaatttttaatttttaatcacaataaaaaatgattgttagatttttttgaaatatttctccttcatttatcaacatgattatataattgtttttatttaatctgttgatgtaatggattacattgactgatttttgaatgttgaaccaaccttgtacacctggagtaaatcgtatttggttgtggtatataattccttttacacgttgttggattgatttgctaatattatattaagaatattttgcatctatattcatgagagagagtggattttggctttctttttttaatgtctttgtctggttttggtaatagggtaatgctgacctcatagaatgagccagtaagtttttcttctgcttattttcctggaggacatggtaaagaactggtataatttcttccttaaatgtttgctaaaattcactagtaaaaaccatttgggcctggcactttggtttttggaaggtaattaattattgattcagtttcattagtggatacagctctattcagatgatttatttcttgtgtaaattttgatagtttttgtctttcaaagaagtagtccatttcatctaaattatttttagttgccaatgttagtaatttgtaacttctctctttttatcttgattaccctggctaaaggtttgtcagttttattgctctttctaaagaaccagctttggtttcattgatttttctctattgctttcctgtgtttaaattcattgatttatgctctaatttttattatttcttctgcttttttaaaattttaatttcaacttttattttagatacaaagagtacatgtataggtttgttacataggtatattgtgtgatgctaaggtttgggtacagatcctttctcccaggtagtgagcatagtacacaataggtagtttttcaacccatgtctcccctccctcctgtccccctctagacatcccagtgtctcttgttcccatgtttatgtccatgtctgctcagtgtttagttcccactgacaagtgagaatatgtggtatttggttttctgttcctacattaatttgcataggataatggcctccagctacctccacgttgttgaaaaggacgtgatttttttcttttttatggctgcatagtaatctgtgatgtacatgttccacattttctttatccagtccaccattgatgaacacctaggttgattatatgtcttcactattatgaatagcatggcaatgaacatgcgagtgcatgtgtctttttggtgaaatgatttcttttcctttggatgtatacccagtaatgggattgttacattgaatggtagctctgttttaagttctttgaaaatattcacagttaaaatgaattacctaggaatatactaaccaaggaggtgaaagatctctacaagaactataaaacactgctgaaagaaattggagatgatacaaataaatgccaaaacatttcatgctcatggatcagagcaatcaatattgttaaaatggccatacttcccatacagattcaatgctattcctatcaaactaccaaaatgatttttcacagaattagaaaagcctattctaaagttcatatggagccagaaaagagcctgaatagccaaagcagttctaagcaaaaagaacaaggccagaggtatcacaatacctgtcttctgctttctttagatttaaattactatttttcccctccttgtctccaatgtctcttttgcctgaaattaatgtaactactacaactttattttgattagtgttagcattgtgtagctttctgcatccctttacttataacctgtctaagttaaaagtgggtttctttgtaggccttattcttttaatcatctctggcaatttctttcttttaatcagtgtatttagacaattcacatttaaagtgattattgatatagttgggttattatctaccatgtttgtaactattttatatttgtaacatttattctttgtttacctttttttcctcttggcctttcactggtattcatcaggcattttatgtgatttcattttctctcctctcttagcatatcaattatacttctttttttaaaaggtagtaatgtccctaatgtttgtagtatacatgtttaatctaagtctggcttcagataacgctataccacttacatgtagtgcaggtaccttataaggaagtactttcaattcctccttcctatccattataacattgctgtaatttatttcatttatccatttgctataattactcaatatattgttactattgttactttaaacatataattatagatcaattaagagtaaaaagatgaaatattatcatttaccttcatttatttcttctctgatgcttttcttttatgtaggtccaagtttttgacctatatcattttccttctctctgaataactttttttcaacattttttataatgtagatctcctttcaataaatttttatttgagaatatctttctttctctttcatgtttgaaggatagtttcattgggcatagaattctaggttagtgaggtttttcttttaatactttaaatattttactccattctagttttatttacacggttttctgagaagtccattgtaattcctatgtttgtttctctatagattaggtggatttcttgccccctttggcttctttcaaaattccctctttgtctttggttttaattttgattatgatttgctcagctttcgatattttcatatttattctactttgtgttctctgaacttctggatctattgtttggtgtttcttctttattttgggaaattcttagccattattacttcagatatttcttctgctccattctcactttgttatcttcatattctaaccatgcatatgttatacgttttgaaatttttcttgggtgtcctgggtgtttccctccattcttttttctttttgcatatcagtttgggaagtttttaactgatgtatcttcaaattcactgattctttccttgtccttgttaaggccatcaaaggccttctttgtttctgttggtctttttattattattatcattattattattattaggatttcttttagatacttttttagcattttcgtctctcgttacattgtccgtttgtgcatagtgtttactttttctattagaacacttattaatcatagttgcattaaattatctgataattctaacatttgtgttatatctgagttgggttctgattcttgctttctctctttggactgtgtttttcttgccttttagcatgccttttaatattttgttgaaacatggatatgatgtatctggtaataggaactgagacaaataggtctatatgtgacattttgtgttagaaattgaactgtgtttaatgtttgttatagttgtacatgccagaggcctcacattcttctattgtccttattttttcatccccactattgtctttggcgtccctaagatctcctccttagatagagtctatgtcttgctgctctttgagctgtaattcactaatattatactggggtcatgtcgatgtggttttaaggtatggggaaggaaaagcattctataatcttttgattatatctgtcttttagtgggactatgtccctgagctatgaccttcatagatgttcttaggcccctactcctttaggtgagacagaaggcttgcaggcactagagttgaagagatgtccttcccctgtgtgcaataggcttttgtaaagtctcttcctcttaaaaggtctttattatggagaactctgtgttatggaaaaacactgtaaaaaatattttacagtgtttacgctttccctccccctgccagagccaagaggggatcattcttgactctttggattcctggaggtaaaaccgatgaaagtgtgggcccccttccactaagactgttaccctcaggagttgctcgctttcctattagtccacactcagcccccaacacttcaaattaccactgaagtgtccctaccagtttatgactccagcagctgctcctccaagtaagatctcagctgtgactgtctgggttgtcctttctcttcagatttcagggtgatagtttgtcctgtaacctcagttctcttatggatccaacaaaaatcactgatttgcagtttcttagcttttttttttttttttggagtaaggatgggataaatgacttagacagtttttacatgttggagctataaccacaagtctctacatgtctttaatgtacttgctgactttccctactggaatgtaagcttatgaaagcaggggccatgtctgttttattcatagctacagcttcagtagccagaatagcacctgactcaaagtaagcgggccaataaatagttgctaatagactaattaatctcttggcagtcattgagcatattgttataccaggcactgtgcttagtgtggaaagacatcaggtgcctacattattacagtggtgtgggggcagggcatggtggacatacaactaaaataacaataaaccacagatcagagaatagggaagttttaaagcactgaggacacatacctcatctagcccaagcaagagggaggtagaggtaaagcattgccagagaagaaaaccatcacctgagttgagttgtaaacaatgagtagctgttagcctgtatagtggagagggacccagccaaggagacagcacagacctgtcaaagtccatgtcggacaacatgcaaagtgatttacttaacccacctcatgaacgtttagtagcccacgcaaggcaggcccctgttaactcacaggtcaggaaactgagcctcagacagtttaagtgactcgacaaaatgtcaccaatgctgagtgatggagcaagtcggcttgaggccaaggtccattttctccctgctacaaagatgactaagcacgactcagagtctggtggaggagcagaacacataaacagtctttgatgatacccatgctcttttgaatttgctctattgttgttcattttctttaagatttcagccctagaagtagcaagctgaaaatcagggctgctttgcaaatgcccacaaaccactgaggggagttttgtcaaagaaggcgggaaagaaaaataaatgtgggcttctgctctttaaacctcagcccagtgaggcagactttcccggaatacttcaggcctcttcaaaggcctattgtggaaagtgtccagatgtgcgtggaaaacctcactgggaagcttcccggtgaagaggccttttaagcatgaaccgagatgaaggaagctgacgccatgagtcctatcaggtggccttttttctgaaggagcccagattttcccctaaccttaagaaggttgtagggggttgggtgattagccagttcgtattcctttgattacaggaagcagtggggttagttgttttttgttgttgtctttcctttttttgctgaagtgagaagaggagatgggggtggggggcattctccatatgatttatctacctgtaagttgttagtgacagtctggtcattcctccagcataccttgtgagggccaggagggatttctggattggataaagttgaggcactgagtaagtcctgctagtttctatgatgatgcctctgagtgttctaagagtcagaatcccctggaatctggctctgatcccctgctccgaatccctgtttaagctctcttcccaatgccctgtttatcctaggtttgaggccccatcttcctcttgctagatacagttaagccagagagacccagatttaaatcctgctctctcattagctgtgtcatcttgcacagagtagcatcagcctcaccgagcctcagtttcctcatctgtaaaatggaggtaataccagtcccgtcatcatccagttgctgtgaggattaaatgaattgctgagttgccgcacacaaagcatctggtccagttcctggcacagagtgagggttcagtttattttcattccttttctctttaatccagttgtacaaagaggcagagctgtcccatttgaccagagaattttacttctgtagctctttaaattctctccccgccatgtacatatgggcttagctaagtattttgagatcacagtgtatttaggggaaagtccttttggctacagctaaaattaggcctctcttgtgctcctctgtttaccaccccccttcctattttaactaattagaggcattgacactaagaaacacttaagaaaagttggaagaacagctgggagttgttctagatacaagcagctgctccctgtcagcatgcaggcacagaaaaggatgatcctgaatggggaagtgcagggagggcacctcagagatgaagatgaggaatggcaaagtctgtctatgttgtggcaaactgagcagggtggagttcttatcactctgtcctctaccttctgctgagagaaaaggggggtcagagataccaaagcagatagaggaaaggggggcaagaaaggggaagggaaggaaggtattcaggagcttagctagttggttagttgattactttatgcagaccactgtcgcccccacctagaccactgcggtatctcctaactggtctcatgctgccggctgctttcctgctggaaccagagacgtcacaggaacatgcaattcttgcaccctgaaatccccgcgacgagcttccaccatggaatttagacagaattccaaaacccatcacatggcccccgagtacctggatgcaccttccccctgttccccgtaattgttactgctcagtcctgctggcttctgttcattcgctctgcttcaaaggactttctctcctggagccagattgcctgagtttaatccaggtttccctactcgctactactacttacaggcctctccatctcccttccagccttaaacacctactgagctcccctggaattccctgtccacgtcctacacactctcctcatggagtccccgggcctgtgcacccccaaataaaagtttctgtgtttccagatggccatggtgactgtgcataaagcctagcaaatgtgcatcaagccagaagacacgagacctttccaaagggctcatgtcttctggcctgatgcacatttttgtgtcccctgccccatctcctcctcactaccctcgggaaactgggtgatgtctctgtgggaagggctgagcctcaggctctgtattgattgtccagtgctgcatttaaacttcctgactggatattcagaacttatgctgttgttttgttttgttttgttttgtttttttgttttgttttgttttttaaagcaagcaccttcacatctcaggtgtaaatgccagatcttctaacacttacaaggacaaattcatttcttactaaatagtcaagcttaaaacccacatgactggctgatgtaagctttggccttgtctgtgaggaatttttgcaacattatttctcttgatttctttctttgttgctgctgttctcagaacaaggcaaggctgaggttctccttctcagttactccatgtccctgaattaagccctgtgagatctaaaaacaggagctctgtgcacacagccgtaaggacaaaccctcactctgcatccccctaagtgggccacatgcctaagcccagaaatctaagagttacttctaacaactttctctccctaacaccctcatctggtctgtcactgaagcatgttttctgcctcctgagcatctctcatatctgggtgataagagagccaccttgatgtcccctggcccttgctgacctcagcagagcctttgggtgacagtagctctggcttcccagggcccttggaaaggagactgtggggtccgcgtggtatggccctgcctgcctcttggttctgtttcacccacacttcccttcactcttatctgctccaacaacacagcctttctcattcctcaagtatcagttttcttttctttttctttttatttatttcagtagggttttggggaacaggtgttgtatggttacatgaataagttcttttctgagacagggtcttgctctggtgaccagactggagtgcagtggtaccataacagctcactgcagccttgacctcctgggctcacgtgatcctcccatctcacctcccaggtagctgggaccgcaggcgtgcaccgccacacccagctaattttttgtgtttttttgtagagacggggttttgccacattggccagactgatctagaactcctggctcaagcaatccacccaccttggcctcccagagttctgggattacaggcgtgagtcaagtgtcatttttcgtccttccgtatggccctctcctctgctagacacatgcttccccctccttcagccattaatacctgtgcatcccttgaatctcagctaagctatgacatacatgaagcatacatgcatatagacacagacatacataccattcaacctaacatgaggtgattgaggaatgccgagaccctcctctcccctctcagtgccctgaagcagcccctgggggaggggatggccctggtccctctgactctgacagggactgccctcccacagagagaggaaggcctcgggagctggttgtgggctcacctctgtggtactgctcttcctcctgcttctgagcagagaaggcctgggggccaaggtgcccaggggctgtggacaagatccttttatgctctgtccttgcctctaatgtgacagattattttgtaattacctggcagagataagtttggtttctgcaaataaactagcaaagattccaaggttattaaacacaaccttgcctcatctatctggtcatatccaaaaaccttaaaagaatttttgttcttctgaatttcactctccaaggcacaaagaccaggtgatggtggggcaggggtagagagagggatgggaagacttctcacagtgattcgagaacgttcacacacacatacgcacacaaaaaccttcactctccccctctccaaccccaccccactgactgcacacatgtcttggcccccttgagaatcccttttccatagacaagccctctgaggtaagaggtttaggcctccttcctgctttagttaacatcttgtctccacagaaccacatccaaccttccatttttctccaacctctttagctcatgaggaagatttacagcctgggagtcaggaggcccaagttctagtccttgctttgacaccaggtgatattgtggtcttctctgagtattgttggttcactcttatgagagcattctcagacctgtggcattttcaccattgaatccactgtgcacagaggtaaccaacatttgtgacacctgctgtttgcaaaacactgagctaagaattagtgattacttctcaacccaccatctctacaaggcagctatgactcctgttttatctatttatgaaggaagacagagcttagcaaaattaagaatgctgctcagacccacaaacaggtaagattagaggcaggtttcaaaacgaggtctctgtctccagagtttctgccatcacagtaagctgagtctcaactgtactatagaaaaataaatcaaaatgacattttaagtatcatctcttttatttatgcattatgcaggagatggaactcctttcttagatttttttcccccaaatatgctgtgctcaggagctgggaaaagggaaaacacacaccctgggaccttacaccctgatatggtttggctgtgtccccacccaaatctcattttgaattcccccatgttgtgggagagacccagtgggaggtaactgaatcatgggggcaggtctttcccatgctgttctcatgatagctgataactctcacaagatctgacagtattataagggggaatttccctgcacaagctctctctcttttttttgcctgctgccatccatgtaaggtgtgacttgctcctccttgccttctgccatgattgtgaggcctcccagccatatggaactgtgagtccaattaaacctctttcttttgtaaaatgcccagtttgggatatgtctttatcagcagcgtgaaaatagactaatatagtaaattggcaccgggagtggggcactgctgaaacgatacccaaaaatgtggaattgactttggaacttggtaacaggcagaggttggaacagtttggagggctcagaagataggaaaatgtgggaaaatttggaactccctagagacttgttgaatggctttgcccaaaatcctgatagtgatatgaacaataaagtccaagctgaagtggtctcagatagaaatgaggaacttgttgggaactggagcaaaggtgactcttgttacgtttcagcaaagagactagcggcattttgcccaagccctagatatttatggaactttgaacttgagagagatgatttagggtatctggcggaagaaatttctaagcagcaaagcattgaggaggtgacttgggtgctgttgacggcattcagtttcaaaaggaaaacggagcatgaaagtttgcaaaatttgcagcctgacaatgcaatagaaaagaaaacctcgttttctgaggaggaagtcaagccagctgcagaaatgtgtataagtaacaaggagccgaacgttaatccccaagacaatggggaaaatgtctccaggccatgtcagaggtcttcatggcagctcctcccatcacaggcctggaggcttaggaggaaaaagtggttttgtaggcagggcccagggtacccctgctgtgtgcagcctcaagacttggtgccctgaatcccagctgctccagccatggctgaaaggggccaacatagagctcaggccatggcttctaaaggcgcaagcctcaagccttggcagcttccacatgatgttgagctggcaagtgcacagaagtcaagaactggggtttaagaacctctacctagatttcagaggatgtatggaaatgcctggatgtccaggcagaagtttgctgcagggacagggtcctcttggagaacctctgctagggcagtgtggaagggaaatgtggggttggagtcccagcccagagtccctactggggcaccgtctagtggagctgtgagaagagggcactgacctccagaccccagaatggtagatccactgacagcttacaccatgtgcctgaaaaagctgtaaacactcaacaccagcccatgaaagcatctgggagggaggttgtaccctgcagatccaaagcggcagagctgcccaagaccatgggagcccacctcttgtatcagtgtgacctggatgtgagacatggagtcaaaggagatcattttgtagttttaagatttgactgcctcactggattttggactagcatggggcctgtagcccctttgttttggccaatttctcccatttggaatggctgtatttacccaatgcctgtacccccattgtatctgggaagtaactaacttgctttcgattttgcaggctcataggcagaagggacttacctttgtctcagaggtgacgctggactgtggacttttgagttaatgccaaaacgagttaagactttgagggacttttgggaaggcatgattagttttgaaatgtgaggacatgtgatttgggaggggccaggggcagaatgatatggtttgactgtgttcccacccacatctcaccttgaattcctccatgtcgtgggagggacccagtgggaagtaattgaatcatgggggcgagagcaaactgaggaccagagtggttataaaacttgtctgaattcataccatttacaaagtaaaagaagagtctagagcccaggtctcctgagtcctcagaatcaaccaagtcaaataagctcccctattcaaaaagaagaaccttcaagaatattaattttgtgcccatctaaaagcctcactgagctgtgctaaaggtaataggcattgaagaaaacgttctcacagaaactcccagctgcaaacacaaagaagcagctctccagggaacagggtaaggattgtctgaagagatctatgctggtgagattacaaaaatcataatatatgaataaatgaacatatggaaggaatcagcaaagccctctcattcttcccgtatgtaaactcggcctttgcctaaagtcattaagtaaacacagatgcagccaaaccaggcaccagatggcaaacaagaattggaataaaaggtaaagaaagcttttggtgtttactcaaagatggggaaaaaaaccatgatccaaaatgctgtggtttccccagaatggccacctggagtcaccagggcccaaaagtgaccaaataaaacaaaacaaaactagaataatcatgattgggaagttgtaggaaaaccgctgctatcttctgtgaatggaatcccatgtcagaagaaactggttattctgggaaatgaaataaatggttaaatcaaagtactaggaccagagagcaacaggaatgtggcaagaatccacttttgctgggcactcacatctgtccagagctttgtattcttggccttatataatcctcacaattacccattaggtattggccaaattttataaatgaggaaattccataaatgggttgagagagattaggccccaaggtcacaccacaggaatgccatcctagctgtggccagtgcttctttgtccattcccagcttcgtagctctgatttcagtaccagatacaggggaatccaggcacattctctctgcctttcctgcccaaaccactggacctaagtaagaaggtcacctggtcaggtactgccttgaagggagaccagaacagacatggagtggggaacagagcattcctgaaaacttaacttcacctttatttcacaaaagacacccttgcacatgcctcatccacctcttagcttgtacatttgccatgagcaccagtaatgaaggcagtccttgtgaatatttgcttttcagtatgcatgagtttatatattgggggtagaaaattccaataatgtttcagcttcaactaaaagctgtatcttgttctgtccttgcctctaacctgacagattattttttaattgcttggtagagataagtttggcttctgcaaataaactagcaaacatttcctgcccaggctaccaaacacagcctcacctcacctatctggccatatgtaaaaacgttcattcaaataagttttgttcttttgagttttactctcccaagcgcagaaactgggtagtgaggggtgcaggggtatggggagaatggtttcaaccaaaccattcattgcttgcaggtgggaaggtaaggtggaaaatgctttccagctaaacagacctgtctgataaccctaccactaactaaacttgctctcttgggcaggccacattatgctttgagttttagtttctttctctctaaaatgtacgtggaagggctgttttcagaatttttttttcactttcctcttacccatcttctctttttctacatggtcaatctccacgtggctgttttattttttccccattgttctttagcaaagcttaatccaggatgaattcagctttgtggacactataaatcaaagccatacaaccataaggcaggcttctaccactctatactaattgttaccagtctcttagccctggtttctggttgggtttggccaatgggcagccccagcaggaacctggagaataatgaagttgtttattcccccagcgctctccttgctgggttgacgcaggttagctacatccatctaccatccttctacaatggaccacagttcctgtgtgtggccctttccctacaattttgtgcatgatgggaacctctcctccctccctgtcctccttcaggctaagaggttgtaatggctccttactgttggtaatcattaggtacttgtttctttacctaaacctttttaaacaactcttcttgaagcttacttcagttacccaatgtgagtgtcaatctctttcctaataggaacctgaataaatatatcacttcagctcaatttcccattttctacaatgactattatcaaactttgccaatttccatccctgtctttcctctcatgttcagagagatgacctcctgtttattcttagccaccaactacctctaagagaaaagccattagaaagacaactgccattaaatctcccagctttcttagatccggtagtgagctggggctagctcagccctgctcgcaagagcatattgtgcacatctcttcccagcttcacatccattccatcacattcagagcttgaaactggccaagatggaagtatttacaacacagaaattggcaattgataaaattagggctttctattgattatttatcagtattatttatcaacacaccactgcttatatccagatacagtctttttctccttcacatttgttacgatgaaagagatggcccacttattatcagagactctttcatctcctactgcctctaacagcccacttaattcattatccattcactctatgtttagcttcttcaatactatctccttctcatcaacatttaaacatgctctagacctgtgctatccaacagtagccattagttaaacgtatttattgaacccgcgagatgtggctagtccaaattgcaatatgtaagatacacaccagatttcaaacattttgcatgaataaaagaatgtaaaatatctcataaataatttttgtattgattacttgaaatgatatttggggtataataggttaaataaaaacatattaaaattaaattcaccagttcacttacacttttttaagtgggtactagaaaatttaaaattacttgtgtaaatcatattatttctgttggacagtgctgctgtaaacctttcatcttaaaaataaaatccctggctgggcacagtggctcacacctgtaatcccagcactttgggaggtttggatctgtgtccctggctaaatctcatgttgaattgtaatccccagtgaggagggccctggtgggaggtgattggattttgggggtggagctcatgaatggtttagcaccatccccccattggtaccacatagtgagttctcaggagatctggttgtttaaaggtgtgtagtacctccctccacttcctcccgctccagccatgtaagacgtgcttgccttctgtcatgattgtaagtttcctgaggtcttctcagaagcagaggccactatgcttcctgtatagcctgcagaaccatgggccaattaaacctcttttcttcataaattacccagtctcaggtatttctttatagcagtgcgagaacaagctaaagcaggaagattgcttgaggccagaaattcaagaccaacctgggtaacatagtgagacactttctctaataataattttttaaaaattgccaggcgggcgaggcgcggtggctgacacactttgggaggccgaggcaggtggatcacaaggtcaggagatcaagaccgtcctggctaacatggtgaaaccccatctctactaaaaaaatacaaaaaaattagccaggcatcatggcaggcacctgtagtcccagctacttgggaggctgaggcaggagaatggcttgaacccggaaggcagagcttgcagtgagccaagatcgtagcactgcactccagcctgggtgacagagtgagactccatctcaaaaaaaaaaaaaaaaaaagccagtcaccgtggtgcatacatgtagtcccagctgctcaggaggctgaggccagagaatcagtttaacccagaagttcgagctgcagtgagctatgatcatgccactgcactccagcctcggtgacagagcaaaaccctgtctcaaaaagtaaagtaaaatcccttcttctgcctatcagctcccctagctgttgcctctcatggtcaaggatgctttaaaaggtatctatcctcactaccatgatttttctcaccaccacccctgcctccttaactaaggcagatcttccttccgctacagaaattccaccaaaatcatgctgcctcagtcattagtgctgacccaaggcattgctgagcccaaagggcttttcaacccctactcagctttagccttggcaacattttgcaaagtggagcactcccttcattgaaacacgcttccactgacaacatattttcttgatttccctcccgctgttctgaatgtttctgcacaaattccttttctagttttcctttctcctctccccaatattatatggtagtcttatacaggaatctgtccatctcatctacttctaaggattcatttactatttatatgccagcaggtttacacctatctatataacatcttcacttaaagggcttacagccatctcaatctaagcatattaaaatctgaacccaccatctccacctctgcctgaaaaattggcactgttcccatacgtggcactatcaataaatggcaccacgtgtccttactcactcctggcagaacctcaaggacattctgagcccactctgtctttctgctccacatcagtctctcatggtgtctttctaaattacatttcatgtctcttgaattcttccactttgctttaattctaccatcaccatccttttgtctcacctggactgctccaaagaacttttgaatggtttccttgcctccacttttaccattctttagtttattctctacaaaactaccagagtgatctttaacaaacatgaataagatcactcttgcttaaaactctccagtggcttctccttgactttggcataactcaaaaccttttaacatgatttacaggaccatccaaaatctgacccctgccttcatctatagcttcatctcctatatgctttcccttcattttatccagtcatcttggacttctttaggtcctttaaatgtatcatgttgtctttacttaaggccttcagatatgcatttccttcagtctggaaccttcctcatcaactttctttacccagccaactccttgtcaaccttcagctagttccataagtttccatagtagttttgtcttcctcttcctgtctcccatgatcaccgatgtttctccagcaggctttaaacttcatgaggtcagggatcagagctgtctggttgcctcctctatccatattgtgtagcacaatgccttgcacacaataagtactcaataagtatttggttgcacaataaaaatgacattatctggctcaaacttcccattttgagaaagaggaaactgggatccaaagaaaggaagcaacttattcaaaacaacagagcccaggctaagattaatacagggctggagcctcctaatttccagatcttttttttttttttccagcacatcatgtgcctatctataatatggtaaccagaaggaagcagactggattccctgtgtcttgtaaaagccggagcaagttcttatttgtaaacacagctgacatagttgttttctttgtttgttttaagtaaaaggactggaagtacaacccaaaaataaactttgtgtttccaaaccaagaagcttctacaacttttatcccctgcagcctcctttctgtccattgttcatcttccttcccttcattaaccacaggcatcagctgatattcaatgttgaatggtccctgcattctgtgttctttatcactcccctgcccaggcagcatgtcacatgcagcagcagattaggaagtgctgtctttaaatagtatcactcaagagaacattacaagatcctgtgtagcgctggggtggagattgatgtaataatttttagaataaaaataactcacatttttgaaactattagtttgtgactggcactaatttcagtggtttgtatgcattttcttttttaactttatgagtaattatttctattacttctattttacagatgagtaaactgagggacaaagaggttagttaaggcccaagccattctgttttgtttgagacagagtctccctctgtcatccaggctggagtgcagtggcacgatctcggctcactgcaacctccgccttctggattcaagcgattctcctgcctcagcctcccaagtagctgggattacaggcacctgccaccacacccagctaatttgtgtattttcagtagagacagggtttcaccatgttggccaggctggtctcgaacccctgaccttagatgatccacccgcctcagccttccaaagtgctgggattacaggcgtgagccactgcgcccggcccacccaagccattctgttagctagtgaaagagtcaaagttctaatctagccagtctagagcctgtgatcctaactgtctgacatcggacaatgaagaatgtgttgacctggcaggaaataccaaaaagtacaactgagggagatcctaaacttgctttatacagatatcctggatcctacccctgattcattcattaattcattaatccatttactcattcatttaattctttcaacatgtatttattacatttttgcattatttatatcaattttggggaatacagagaaagttaatggcttctaccctttgacatctcacagtccagtggggagacgtaagaaaacagacatttatcctactgtgtgctgaatgataagacagaggaaaatcagtgagctttgggaacatggaagagattataaacacataataaagagagtttaaaagggcactacagtgatttgctttggacctgcattccacacctgtcactctatctgtctgacctctgctctctctatgctcctggcttctagcccttctcttactttggtaccatccttagcctctcaactcctggcttcagattcgatgtctttgcttgtctttttcctctggaagttggtttggaatggattctggcttggctagagggtttctgtatcgtaaacagtctaaggccagctccaaagtctaggccagaatatctaggccccactaccaaaatggctctcgcttagaagaattggagatccaaaagcagggaacttgaaagagcatggagggatagatggatggatagattccttgcctcttagcttcgattattcacctgcctaaacccagagcagttggcctagtgactaaccaacatcccttgcagctcaatcattattcattatgttaatattatcacacattttgattctttgctgtcgatttggttgctgatctgctggccaaaggatcatcatgggaaggaattactattgaagcaggcagtgcaaatttcaaaagtgttcagaccctgcggcctttcatgatatttcactttcttgagttgcagtctcccattggcctgctccttccgaagcagattttgtcccttgtagccataagtgaagcatatcctggctaaatgtttctgtggactgaaggtagctattgaattgggcagttaagagaatattgcagattcttgtcggtaaatgacacaaaagatgatggactctaagctagctatggaagaaattagagccagacagggcacatgaattgaaagaaaatgaagtgatggagattctggaagttgctttaaagtggagaaggacatttgctaagaatgatagagtacatgagagaattggactgaagggcaatggaattcagaaagtggctgttggtatattgtaatattcataagtatagcagtctcaaggggggctgtgggagtattgaagtgaaatggagatgaaggtcccggaggtggaaacattttgaaaccgtctaacagtggaacattggatgggtcttatgagcagatgctgaagttgtccaggacaatgataaacctccaggtagatagggaggcttgtgatctaggagccttagcctcatttaacatagggacagaaacaagaggctgacagtgacagcagtgagatgcaggggagacatgtgtcattgtatctccatcattaggtggcataaacctcagaggaacaggcttttttgcctgcaactgcaggaatacttgtctggaaatgataatgaggaggcctgagaataatgactgttatcaccttccccaacccacctgaaacatacacacatggcaacacttacctttcaataaagtttctgggaaaataaagtttatttcagttgataggtacatagtaataataacaatatctgcacttttaagcatttagtccatccaataggcctataaaataggtattaaaacttccctttttttgagacagcatcttactgtgtcgcccaggctggagagcagtggcacaatcgaggttcacttcagcctcaacctcccagactcaagggatcctcctatctcagtcagccttctgagtagctgggcctacaaacacgtaccatcacacctggctaatttttattttatgtttttgttgagatagggtttccctatcttgcccaggctggtttcaaactcgtttcaagcgatcctcccacctcagcctcccaaagtgctgggattacaggtgtgaatcactgcatccagcctaaaatttccatttttaaaatgaggaaattgagactcaggatgttcatggcagaactagggtttggattatgatctaaatatcactgaagtctttgtttcacagcaaatgtttaaaagtataggttccaaagccatatgttttcttgtctttgaactgggaatacaaactaggtaacgtatttaataatatagtgctaggccatagtaagtactcaacaaatatcagttgccattataattattgttattgagttactattatttaattacagctcacggcagtactatataccttctcagcctcacatatcagcaagatcatatttttttccagtcaacaatagattattagatgagtgacagcttgcagttttggaacctatcatctgtctgatgcttttagcaagaagcttcctatttttactttgagaaatccataagaagtaagtcaaactcatgtagatgggatgaatacttgctccctattcatgtttggatccaactcttttgcagccaggccatatattaggaccccatctcagagtatcacaacagaggttgatggccttacctagtataaaaccactcccctgtgccgtatttgcccatgactgaatcggaatgaaactttcccttgctaggaaaacactgtgggtatattctctgtcggagtgtgctgagcaaaaccctaatagaatgtaccgtgaggaataaggagtaacttgtcaactgagagttaatcagaaaaccacatgtgcacaaaaccaacagattgcagagctggcaaagacttcagagataatttactccaaccccctcattctactgataaagaaagtgagtcccagggaggggaagggtcttgctcagggtcatacagctggcagtaattttgtttgtttcaataattaatatgaacagtcattctatacatcagtgaatccaccttcctgcctttgtaagcacaatataatgaccataattgaatttgtctttgacagtgaagaaagcaggcttttagggctttacagggccccaaagtcatcagaagaaaataaattgtcatgaactaaagctggagatctgcctgttgactgtgagcttcttaaggaatgggcctggtcttattcatgagctaaagcaagtttcaaatcctggcttagccctttactagcttaagcaagtacttaacctctctgagcctttatttcctcattgtaaatttaaataataagaccttcctcagagactgttagtgaggatcaagggaggcaagatctgtataccagtaccttgcgtaaaataggcattcaataaacttgcactttcaccttacatttaacaaatgtcctgctaaaagctagggatacttcaaagaaaggaaagccaacgactccactttcatggagcttagattcaggagggaggagagcagaggtgaggaccacagagaagcaggcagacaataaacaattaaaaatataatttcagatgatgatgtgctatcaagggttatgaggaaaagaaaatgagatgatgtcatagatgtttaggagagtgcactgcttctgctaagagtggccaagggcagtcttttcaatattatgtttgaagagaacctaaatcatatggaaaaagccagacagtcaaagatcctggagaagaccattcctgagagattcagaaaggccttaggcaggaggaaggttggcatgttcagccagcagcaagatggccagtgtgttcccagcatggccagcccagtaagcagggcatgagatgagactggagacatctgcataaactccatcctgaagttctagtccaccctatgacatttgagttttattcaaaaagcgatggaacactgttgcaaggacgtgttaaaaaataaatattggtctttgtccctagttcctggcacacagcttctaaaattcttggaatccctgctaaaagctagggatacttcaaagaaaggaaagccaaggacttcacttttatggagcttagattaagctccatgtgtatggtaatgagatgactgatggctgagaacccctccgtagcatcaggatgggggctggtcaccagaaagaccaaggcatgattagagggttgaactttcagcccctcccctgaccttccagaatgagaaaggggctagagattgagtcaatcaccgatggccaatgatttactcaattatacctaagtaatgaaaccttcataaaaacccctaaatgatggggtttagacagcttctggattggtgaacacagggaggtattgagaggatggcatgcctggaggaggcatggaagctcactgcaccactgcacctccctcccctcataccttgctctatgtatctcttccatttggctgttcctgaattttatcctttataataaactggtaatagtaagtcaaccgttgtcttgaactccataagccgattctagcaaattatcaagccttggggggtggagtttgtggaaacctccaatttgcggtcagttggtcagaaatacaggagacccaggacttgtgattggcatctgaagtgtgggcagtcttgctggactgagccctgaagctgtggggtctgacactaactaactggggtcagtgtcagaattgaatcaaatttaattataagtcatgcaattggtggcaggagagttggagaattggtgagtgtgaggaaaaaacccatacatttggtgtcaggagtgttgtaggtaaaaacagcccagagaggtaaaatcattcattgattcatttaacaaatccttatagattaactattctggccaggcacagttcttggtgtggtgcatgaatccaatacacacccctggccacatggagcttgcatgctaaagggataataaatatctaaagtttatgtagcatttactatatgctggcattgttgtgttttacctcaaataactcacgtgcttctcatagcagtcctatgaaaggcatatttttatccccattttctgatgaggcaacaggcatgaagaaattaagtaattattccgtgattatacagctagtaaatgtaaaaatccagtttcaaattctggcagtctgttatagtcagtctgtattttaatcactgccctttattttctctgcttctgaaaaatcacctagactggtcctgactgctataaggggaaccaaagtggaagtcaagagaccagttaggcagtagtggtcagagaatgggatactggaattttcaacaacactgagtagatattattattcccacttaataaatgggaaaactgagctttgattcacacatctgataagtagcagagcctggatccaaccccaagcccatttatctctaaaacccagtatctttctgctaatgcctccatttcctacagaattataaagcttccactcctcccctcctttatgaccaagagaccaatttgaggtatgttttagagtcaaaattagaggactgggcgtctaaaaatttttttttctcttggtaggcatttttataattgaaaataaaataaaatataaatatactgacatgcagttctgttttctcattttcttttgcaaactttaaattgagatatagtacacataaggtgaaatacaaagatattaatgtacagcttgatgaattttgatgaagtatacacccatatagtcaacactctaaagatatgtaaatgtgtgcacatagtgtacttaaaattataaatgaggtgccagttttcatatcatgagtaatgataaagacctctcccactctctttttctctcatcccttcctgcttctcaattgatatttttgtctccaattcatgggggttacacagaataccaggtgcaggtcaaaagatgactgtgtcaaaaggaaaagaaagcaaaataaataagagaacaactagccatttcttaatgcgtgttgaaggaaagtcacattgatatattttctgtttttctatggaggggtcacgtgcctcagcccacacattagcatgtgaacttgttgttccagtcaaatgagtcagagttcctcaggaaggcagattcctgtattttagagctatgtgtcagcatctgtaaaaaaaaaaaaggtacagtgtcctgtattgatgcatctcactgatacacacgtgctcgtctcactccaggtaatcacacctgctaataagcagcagaagtaggatttgaactccagcctagggcactcaagaatcaggctgttttcatgacagggagaatggtaccactgagtccgaatgtagggtttgcaatggcctggagtcagaagtgggcttgaattctggttttactacataatggctttatgaccttgggaaaattacttatattctctctattttcagttcctttattcacaaagtggtgatagatgatctgtgtcctaatgtccttttgagggttaaaaagatcatgtacttaaaataatcagcacagcacagagtacaaagcttaaaccagtaaaatggcaatggcagtggtagtcggcccctaagtcaacagacaccacagtgttttttaaccatatacccccatcagttaaaataaattttgagtatgcatcctcagtacatgaaaacctatttatgaaaaagcatgatgtgctatactgtgttcatagattatttactctataaaacaagtgaaatatagctgaaccaaagtatttccaatgtgtttacctgtcatgatggcttcatgctaatattagcaacatgtaaaagtacactatatgtctatggccaggtgtgtttttaataattttaaaatgatttttgatgatttttaaatgattttgtatgtgcctatgtatcgaaatctaaggcaatcttcttgataattttgattattttcccaatccttgtcttatttgactaggtcttcattgtttttaccttacaatatgaggagctagtactgagtaaatacatcaccattttcttgtttacttgaatctgaatggtgaactggtgataattatctccatcacgtgcaaatccattgactgaatcttttttagctgcttgtccattttgtgagggttagtttaaactagttaatacctattaatcactaacctggaacatgcaaacgacaacatgtagcaattctggaagctgaggacatataagggagtgccatagggccatccctggagttggagagctcccactctcctcacaagaacctcacacatcttatgtgactcatgactgactgatgtgtggccaaactgataaattgtctagtaacaatccatatattaaatgctggtaaagtgtaattaatttcttaagaccaaaaaaagtcatataaatggcacttccagtattttcttctggaatcttaatgagaattccctggagtttatggatgccacttaagaaacactgccatcactttttcctttggcaactctgcaaacactaaccaagcacctgtaagtgctaggactgtgctagacattaggcctacagtgatgtgatttctgccttctgggagttcatatatagcttgtttccaccacactaagttctgctatattctcccctatagatggtgactctggaattgcccagcttgcagtgccctgtagtaccttgggctagactactgacagtcttccccaaaaggcttaagcccattattccccttcctcagggtaggggagaaggtactagatcttctgctcccaaaattgccaacatcagtaagtctaccactcatggaatccacatcttttccaagggtactgaagaacccatggcttcctttaacctcatttccctggtaactcactccaacatggcctacagccctttggtagctcccaggccaggtcattacagtgagaattgggtgtttcccctggccacatgcaggcctggctgttgccagtgctgccacaagagaagtggtgagcagtgtgtgctgattagtatctcagcctcgacacaccagggaagggtcaaacccatgaatgcagtctttcatggccgtggtacagggcccctattttttcctccagaaacccttcacttgctttcagaagtgatgatcaaatgtgaactttcatggtttatttatagctctgccttatagagagaaagaaaagaagtgattaaaatgctattttacaaaatattttgtttttaaaaagctttcattgtgtgggcaaaaggaaaaagaaaagtcactgtattaattgtgctgtctagactctcaaacaaagagggtagcgtgctgcaaattaagattgtccggctcctgcctgctgacaaaaagtatgaatttggaggccaacttcaaataaaccctttggaacagaaatatattgtgggggtgactatatttagcatgtgtcagcatttccatactaaattcatattgttatgttgtggtaatttcagatttcctgcagccaagtgggatcatgagatttcagttttatgttaattatttggagaaattgaaaaactcagcagtgctgtttctgatgacagcactgattctcagggtattctccacgttgtgtcagggacccataatgagccctgcctttcaggaaaggggaaggtgagcccgagtcattttgactgtctttataagcataactttaaatatatatatatatatatatatatatatatatatatatatatatatggcattacatgttttccctacaaatacaaaattaatatatgccactgtagaaaatttagaaaacacaataagcaacttgacaagaaaaaaaaattgttacccatgctatccaacctgttaacattttaatatatattgatccgatctttattatgcatatataacttgtttttatatgcatatcttgtttttaacttgtttttaacaagttatatggagcaaacaaaaaattatgtagcacaaacatgattattgagatagaatacaaaattataactttattttctattctcattatccctttgcatttgtgcagtagagctagtttttccctgctctggttaaaaatcctggtggttccattacttttttagataaatataaagtcacttagataatataacctttatggtcctttaagttgtgagatgtagccaaaattcagaaattcaaatatcaaagaatatgtaaaggtaaaggtaagatgttttccagttcttccagctggagtctgccagaaacgagacatagccctaatcagattcttctttcttcctcattcactttctctccaacatattagcttttttcttgttcctctgaaatggttagaaagtataagggaagaaaagttagtggtgtaggaaatttcttatctgatcagtactgtcataatgggcttcatgctctcttagccttataggtgtttacagctagctctgattctcataaggcacatcatagatttttggggagaccccctgcctctgaaaacctctcgcctgaaatattgttgtcttggttaacacctgtctattctcatagattgctcactactcttctcttaattcctcaggaatcctttccttttttttttgttgtttgtttgttttggtctcttttttgtttggttttgttttgagatagagtcttgctctgtctcccaggctggagtgctggagtgcagtggtgcaatctcgattcactgcaacctctgcctcccaggttcaagcaattcttgtgcctcaccctccccgtgggaccacaggcacatgccaccatacttggctaattttgtatttttagtagagacggggtttcactatgttggccaggctggtcttgaattcctgccctcaagtgatccacccaccttggcctcccaaagtgccaggattaaaagcatgaaccactgctcccggcccaacctcatgcttctttatggtgactgctccacctcgttaggtggccatgttggacaggatctgagaacccctggcagctctctcatacatgggccacttggggtctatgggaaacctttgtcttttggatctggacagactctggcagtgctggttgatcccagggtaacctctacttcacttttacactgcagctgtcagccagcctgtctcttccagacaggagtcacatacaagccaccatgtgccacaacctcagggacatgcagcagattctctgctggtctgtgtcttcctgactcctgaagggagaggatctcttcatacttcaccctggaaggaggcctgatgtgcagtaaaccaacagctctttcctaaaaatccatctctgtctgaccttccacatcaatgaaaggtttaagagttgattaatgggtcctcaggcacccttcttgcacattcttcagggtggtctgtttccagttcactttggtatcttatatctgtcatctttagatctcagccaaaacttccattttaacattccgtcacgtgtattatccttaagttcattcattccgtagacattccctgagtgcatacgatatgccagatgccgagtttggcagtgaaaataattataacaattcctgctttaaggcgctcacagtctagttggggaggctgatctgttaacaaaaaaatatggtgccatgtcataaacgctatgatagacggaagcagaagttgctgttggagcacataactcaatataggtgggaggcaggcagcggggatgagtcagaaaaaaatctcagtagagctgatacctgagctaagtttaacatttaaatctgtactttctgagaaacagcataacctctttttaaaccattgaaatctctcttgctgatgtttgcttctcaatttatttttaaaacaagcaaaggtaatgtggagaaaggagggaagaattccctgatgtctgccgtttatgtgcacatctgttgcagtgggaaggaaaataacatttatggagtaccttctataatagaagtttcctggatcccacccatgagggcgatcctggaatgttgtctcaagtgtggggccaaagcacagccaggaggagcattccctgagggcagtttgaagattcagagctggcaatagaaggcaaggtcctccctaaagcacagcagagcacaactcaaggaagagacgaaaaggacaaaataagaatgagtggcacggttgatgatggggattgctgagaccatctcaacaataccccggcttgctctaagggaatcaggacttcgtctttgaaggaaactgttctggggtaagcagagctcttaacatacctctgctaagtggaatggcagcatgttcactaagatgtgtttgaccatttggccctccacaaaatgactccagacagcccttttagtcttcctctttctccatggtttctttgtcaataatttttcttcattaaaaaaaatctcctccctacttaaggctgccatttctttctgttgtcattgtgctggctactcttagcatctctgatctcccaatcagcacattcacatccattgagagctgggaagctagatgtctagttcagaatgcacatgctatccttgtggaagagtccatagagcaacctagcaggagtggaaattcgtgtaagctagcagatgaaagaaccatcaggttacctaacccttgaataactactgaaagaagtttatccgcttctagcgtagtatttatcacactctattttgatcacagtaaatgtcttttccactctatagtgagctctttgatgaaaggcccatgcaatcttcctctctgtattccatgtagattgagtgttatgcttggcacgtgaaagggaggcaatatgttttatgaatagtccaggtgtcgagacttagtagtaaacagacaagtccttgccctgtgtagcttacattccggttagggcaaggagtggagaaggcagacaacgaacacataaaccagtaaatatacaaagtggcagaaggaaattagtggcatgcaaatcagtcaatcagtcacagtaaggtggcaaagatggtcaggggaaacacttggaaatgttttgaagatacccaggggctctcatattctgtatggtattcagattttttttttttttttacattttttcctcccttactagtatgtgagtttctccaggataaagagtatgtcgtatgcaaatctgtatccctagcagagtgtgtggtacatagtaagtgattaataaatgtgtagaataagaagttgtacacatgtgatcccagaatgactgcatccttagcaataggaattcaatagccgttcctaagactgagcctatgctgtagagctttgtcgtgctgttgcttgcaatcttccctggccaggtctgttggactccaaagtttactttctcatggccttaacagccttaggagactgcttaaaaaaacctaacccttctgctcatatgggagccaaaacaatccatggttaatcttgatgctgcacctaccataccatgtctacccagatgctgtaacatgtcatctgcctgagtgccccattgtaaagaaaagaatgtcctgaagtcacattccagaactcaagtcacttagactcagcccggaggtctcagtatgtactcacaacttcagagattgctggaaaaagagctgaagttgaattggagaggtcttaaatattttatcctcaagtacaggtgcgaagtgagttccattccgtgattgctatctttagggaagtagacaatgtactcagcggctggttatgttccctgcttctgccctgtgtccagatagtgaggaggggaaataattcttcccacttacccctggaggcagtcacagaactgctttgccttttgggttgtttatgccccagaggcctcaatacacaagtatttattaagcccaggaggtgtggtcataattgaaactttaaatgttcactgtgttttattcctatttttgtgttttattcttattaccaaagaaaagtaagttgaaaaaaaagaggactaaccaaatatcttaaagggaagcaaattcaaattagaatgttttgcctgtgacaagcctcgctttggatttcgctttccaactcagctgtctatgttgttttccatttaataggaagcaatggcaaaaatgagcaaagttgggaaagttgtgttcccgagactacaggataaaaagtaagtgtgtattttttatatgtacagtgctaaggaagtgagcacatacacacacacatgcaactatagatctggaataaactcaggtggtcaactaatccagtcctttaatttgtggttaagaaaactaagttccagggaggtaatgtcaccttcacttacctaaggctgcagaactatgtagggccagagctgggggtgaatgtaagcttctgaactctcagaccaatgttctttttcccaggtaattggcagcaaatctgctcttctctgttctaaagtagggatctcttatatctccatcaaaggacccagtagaatctgctcattcttttactctttgtatcacttggcatcaaaggctaaaaaatgacattggtcagtattttaatcccaattcaacaaaatattagtttactgaattcctgctatattcaaggcattatgctgggctccaggcaggtgttacaggggaataaaacacaatttaatttaggcacataagattattttagaacaacgggataagttccacaattgaagtattgccaggtgacaaagttgcccaaggaagaaagagatgggagcctgtagagatgagagaatgcttttgggaggaggttatgtccaagctaactttaagctcttgtaagaaattggtagacaggccaaggcaagaaagaacattcatagtagaaggaataacatgtacagttataaaagtgggagcagcatagtacattcaggttactataaacaactcataatccagaaacacaaagtatgagatggggaatggcaggaagtgggactagggaaggatagaattgggtagggggaggtcagctcataaataccttggaggccatgctgaagacctccaacctcatcctataggcagaacagagatgctgaattctaagcagtggtgagatctggtcagatgcagatcagaaaaatccctcttaaaggatccagtacagggggctcagggtagaaatagagggtccagataaaaggctttttcaagaatccaggctagagatgtaaaagacctctattaatttgctggtagtgattttgaagatgaaggggctgttgtggaagtgcttttataattttagggaagtattcgaggttaagacctaaaagcaaattccacttaacatgatgaacaggcaaatgtgcagatcccactgaagcaggatcagtatttaacagaattggaaatgttcatggaaaagcaatccactttcttttcatttcctttaactccacatagagtcaggctgctaaccctccgaatataaacccttctctaaaggccagggtggaaggtacaggcattgcgtaggggagctccatgcaggaaggtggagagatctgagttcccactggcagtaggagctatgggctgctgtccctgtttctgttccctggaggcagctggagcatccctctttttgtgaaattagaaagattgtctttctccatctcttccctgaccctcccaagacttttcagggaagtttttaagttttttccgtaaaccccacgtgttcagagagtcctccgctgcttgctgggagctggcagctggcagctgttctctgcgaaggaggcggcacacacggtgctttagcaccatctgcaggcaacccagagatttgcaaggagacaggagaagccagtttccttctgagccaacctcatctcattgcctaatagatcacactgttaacgatgtgggacgacatttacttaggcctctgccacacagaagcagggactgagttgaggcacattttgaagagaggggattcagctgattttaaaattcacagtcacggagagtgtaatttagtgactatagtttaataataaatgtttaggatgaccccaaattgcattattatgttcagtccaaatttatatgtggctctggaagagtcacttaaatgtgctttgagaaatttggtgcattgaaagacactatcaacagagtaaaaaggcaactcacagaatgggagaaaacatttgcttatcatacatccagtaagggattgatatccagaatatataaatgtataaagaactcctaaaactcaacaacaacaaaaaagcaaaaacaacccaattcaaaagtgggcaaaggacttgaatgaatatttccccaaagaagatttataaatgaccagtaagcacgtgatagggtattcaacagcactattaggaaaatcaaaactaccgtgaggtaccacctcacacattaggatgctactattttaaaacagaaaacaacaaatgttggcaaggatgtggagaaattggaagctctgtgcatagttggtgagaatgtaacatagtatcgctgctgcagaaaacactatggccattcttcaagaaattaagaatagaattaacatgtgattcaggaattgtatttctgagtatatacccaaaagaactgaaagtagggtatggaagagatatttctacattcatgttcacagcaacattattcatgatagcgaaaatcatgagagcaacctaagtgttcattagtagatgaacatataaatgaagaatgatatgtgcatacaatggagtattattcagccttagaaagaagcaatttctgacatgccacacatcagtgaaccttgaggatattattctaagtgaaataagataaccacaaaaagacaaatactgcatgattccacctatgtaaagaataaggccagtgcacaaagttgtggcaaagttgtcagtattaacattgtaaatcaagtgtgtgtgaaggggtgctcaccttagctcccttctagatattttgagattctaaagtcaagaaatctatctcatgtagtgaaagaattccttaccgttatattgtcacagagcatcattagtaggagcaaattgttcctaaaataattctacaactaataaatttggatgctcatagagtaggtcttagtagtacctacatatagctatattgatgatattaaaatattaattatctaaaatttagtaactagcatttatatcacttattatgagtcaggtactgttctaaatgcttttcatttatttccacatttaatctacaacagctctgctgaagtagatcccataattatccccatttacagatggagaaatttaggcagaaatagtttaagtaacatatccaaagtcacacagctaatgttaggccacattaagattccaacccaggctttggagttcgccttttaaccctgtgcttggccccgtcacaactcctacgttaccagaatgcttacagtctaataaatattgggtaggggactcctactaacatagctatgtgtgacaagtagaagtccctgtgtgtatccaaggttactcttacaacctctctctgccaatgcacaactttgcaccaaaatttcatcatgaggactccttttcagagcaccccagaattgagcaagacatgctaaactggcttcttcaccccctcaccccatgtcagcttcccaaccaagaggagtaaggacaaagttgcaaggctgcaagtataatttgtctcggttcctattattcctttcaggattatgatgccagagcagcttcagctgttctgctgtctgattcatggccaataccagttctaacaggtctaacccaaagagtcagccagataggacagggagagcaacggccactgtgagatgtctggaaggcgagcacagctctagaaaaggcattagctacatttccatggggttttgctcctggataaagcaggtcacaagggaaacctagatgtggaatctgcaaaagggcaattaaaatgttcagtctttgtccttggtcaggctgtgattttaggccagtcatcaaacctggggctagttatataggaaatacttattgaagctggcaatgtgaaagagtctccattaagtccggcctttttgtatatacagtagaagctttgaagtcagacagacatgagtttgaattccagctctgccagtttttatctatactactttgtatatgcctctcatttaggaatttttttttttttttttttgatggagtctggctctttcacccaggctggagcgaagtggtgcaactcaaccacttcacagtgaacgggggacggttcactgcaacctccgccccccgggttcaagcaattctcctgcctcagcctcctgagtagctgggattacaggcgtccaccaccatgtctggctaatttttgtatttttaagagatggggtttaaatgttcttatttctaaattggagataataaaacttcatccaggtcacatataataggtctgaaacatgctaattcattgcccaggatgctgtaagcattcagaatctaggtgtcagcatcaccaccacacatatatttccattcttctaaatgtacagggaagccctgtggcagttttgtcttgagatcattcaacatatttatatttctcccacagatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaaccagaa

SEQ ID NO: 1384 - DNA, 384633 bp, Homo sapiens
agctggacgagcggcagcagctgggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggtgagcgcgcgcgcgcagggcaccttcccgggcccccgagggcagcgccgcgccagggaccccctctccgcgccctctgcgccctccgcgccctccgcaccctgggaccccgcgtctccggactcccggctccggaccctgctgcccgggactcccggatggacagtcctgccgttgccctgtccccaccctggtcccagacgggccgccgcggggcgcctcctgccctctcctgctctcaggcgcctctagagcgcccaggggcggcgtcgcgggagcctttgctccacctgactaggagcgcgcggggtctgtgcctgccctggagggcagcgcctcgggtgctctccgacccggggttccctatctctccgcctgcttccgggcgcgaggagccctcgccccccaccccttgtttccggggggggcggcgccctgggtgtccttctctatctccctgcgggcatgggacatcctttctcactcctctgtgcctccgggcagcgccctgtgttatctcccattgcccctccccgagggcctgggttcccctttccactcctcggtcacatcactgcgggcccctttcttccccagtccctccagtagtggggcatcctttcctccttcccagtccccctcccagaggacaccaccgccgcggggtcactctcgccctccctctgaatgcgtctttatctcttctcttttcccgagggtgctcggggcatctatgggtacatctgtcgcctgccttcagcccctaccccgacggaaacgctccccactatcccgccacctggtggtcgcagcctcctctcttctgcaggagtgaaggcagatgggggttacagccgagctcccacctacccccacaaaggcggaagactcttgggcacccgcctgtggctgggagtttgcacctggggtacagaggcagggaggaaggcgggtgactctgtgggtaactagctggaggctgggccccccgggctgcctgacatacacctccttctgcttttgcaggggcttcgggaagcagggattccagtgccaaggtaggctctggggctttggggatgctatttgtgggaagagagggtgaaaaatactttatagaagaagttactgagttaggcagagagtgaaagaatcacgttggtcggagtgacctcccaggctaggaattcttcaccacaacagggtcctttcaaggggtgtgtgtgtgactggggccgatggcgcttgggagtcttacatgccaaggaagttcacctacccttcctgccttcccggctctggaagagtcaaagcggtctcctgaagcaatcctggcatggtcagttccgctgggggagaaagtgttttcccgggacgtttctgggagaacctgtcctccttagttcccctttctctgcccatgtcccttccttatctcacccagggaggttctgcctctccctgccttgcagaggtctctgcaggtggctgccgctcctctgcagatggtgcatcccctagaaaggcgactgtgtttgtcgcctgggcctcctctctctctgaaagaagtatttccagagggagtgtttctcagatcctggtttaaatcaccctatcttctgggttgaaacagaaaggtctccagggcactggttacctgagttcttgcatctggcttgagatcctggactctaaccaggggtatcaaacctgctggtggtgagttgatcacgtgtaaagtgtccccctcccccgtctttggggctcatgtctaaaagacagattgcaaattggctctccaggaccaaaagttacccgcagctctgtgtagcccttagggtgtcttacttgtgaatttgatgtgaacgttttagaactgggagatttcacatacacatcctaatttccaactttaactttgctgagaaatggtctcactttcgcttgaaaacaatcgtttggagctgagagccgtcgtcgtagatggggaacagccttaccattttgtctcagttgatcccagtggggaacacttcacccatttctggcccctgtgggcatttaagtttgcaacctctcatctggaaagtttgtgtgttatgttttctttttaatttaaattttaatttttcactcttgggcttggtaagattgagtttggtaagaaacggcacatttctggggtattgtatctttaggggcaaagtgaccaccaccctggtgagctgggtttaaatcaaaagaaagtatttgagtgtggaagagtctgacgtgatttagcactgactgacagttttgtggctgcacctccaccctccagggaaaagtaaagtgatccctagtgagtgtaggtggcatcgtcagtggtgcagaatgtttgcttgctggcagcatggcactgtgctcctctgagactcttgcatactcttctgagatcggggtcccggtgggctcagtgagccctgccaacctacccagcctgtcttaccaagatttggatcctctgcaccacaccagaggactcctcaagtctctttaagtggcaacaacttaggccctggtgcaaacaaatttggattgttttctagaactttgacccctcaaacaaaatgccaatggtgtcttggcaccggaatgtgtaatttcttctttgaggttgcctttcacttccatgaatcagtttcagtctttgtctcttgctgagatcgggggcgatttttaaacatttttaccacggatcttctatgccacctgctctgctgttattgatggatgggaaagtcactttggaatgtgcaaggcatgacacatttgaaataggagatcctttaactcaaagtctggaagataataggaattttctgatgttaagagaaaaaggcagaattaaagtttgtaatgaaatatgggcgctctagagataggagtgtcttttttttttttttgacagggtctcactcttttgccccggctggagtacagtggtatgatcagagctcactgcagcctcaaactcatgggctcaagtgatcctcctgcatcagcctcctgattaattgggactacaagtacgcaccaccatgcctggctaattttaaaacaacttttgtagagaaggggtcttgtgatgttgcaagactggtcttgaactcctggcttcaagcaaccctcccacctcagcccccaagtgttgggattataggtgtgagccactatgcccctctggagtgtctattttttaaattgcctttctttttctcttccctgcctccccaccaagaggcagcgtagagaagtgggcatttgcacaggctaccaggcaagtccctgtcggtctgaatcctagctttgagacttcccaggcatattacttagcctctctgtatttcagcctccttgtctataaaacggagtcagtaacagtaccatagtgtggctgagcagctccaactcattgcaatatccaagattcttggaccagagcttgacacagagtatgctcagaaaatatctgctcttatgattgtccccagactaccccaatggtggggcagctggcacgagagaagactggctctgcagggttgctttgctatggaactgcctgccaggtaagagtcaaaactcagccatgaacttctggtcactctgtgtagctgctttgacagcatattccatttgggcagcagtagggaggagtgaggggaggggcagattggcagtccctgaaattgagatgtttagaatgggaacatataggaaagagggaaatttatccctggtactcagcattgcctgggactaattctggaaccactgaggagttccttagtatctgattgttcttggtatcagatatttcctctgaaagtaaatccacttacgatggaatcaacagtttatacaaaacacataaggttttatgatctcacttaagtcagcaatccagagcccagggcctcaggttcctttgagttttctgctccactatccctggggagtgacaattatctcatggtccaaaaaggatgctagacgctggagtcctcacacccttctttcagctagcaggaaggaagaaaggggtaaagaagggcatatagcacatgctcggtgtcacttgtttaagttgctcaagatccttctacctacatcctcttagctagggtttaatcacatacccacaccttgctgtgagggagcatgtgggaaatgtagtgtttatttcaggcagccactatttagaggatgtttccatttcaaaaatacaagcagagagaggatgttgtctctgccactctggtaggaggtgtgtaggatgatcgcaaggcaaagaaaccattgagagtaaccttcaggctctattacattgtcatggaaattggggacactgctatgggttgggagaggaaggatggaaaactcataaaccttgggaaattatggatttctgtgtgctcaggggagcttaagaatagattttcttgctttcgtatgatgataggacgaaactctaggttgactgcctcataatttctccctttttgtttccactctgtctatttcttataaaaccactctctgggaggtaatttaagaatgtgtttgatgacagggaactggggctgaagatccctattgtaaaattgcctaaattctagagtagaagtggaactcctttgacaagcaaggcagatttctctctatggcatttttttctttgccttttatttatttatttatttattgagacagagtctcactctgttgcccaggctgcagtgcagtggcaccatttcgactcacggtaacctccatctcctggggctcaagcgattcttctgcctcagcctcccaggttgctgggattacgggggcctgccaccacgcctggctaatttttgtatttttagtagagatggggtttcatcattttggccaggctggtcttgaactcctgacctcaggtgatccacccgcctcggactcccaaagtgttcagattacaggcatgagctacagtgctggctgtttctgtggcattctttacaggaacttaggacctgcatttgagctttaattttaattaaagtcttctctaagaagatttttggtagagagaaaaaccttcttcttttattttaaattttgtttttagagacagggtctcactgtgtggcccaggctggagggcagtgacatgatcatagctcactgcagcctcaaactcctgggctcaagtgattctcctgcctcagtgtcctgagtagctgggactgcaggtgtgtgtcaccacggcccttttttttttttttttttttttttgagacggagtcttactctgtcatccaggctggagtgcagtgacgtgatcttagctcactgcaacctccacttcccaggttcaagtgattctcgtgcctcagcctcttgagtagctggaactacaggcacgtgccaccatgcccggctaatttttatatttttagtagaggtggggtttcgccacgttggttaggctggtctcgaactcctgacctcaggtgatctgcccgccttagcttcccaaagtgctaggattacaggtgtgagccactgaacctggccaaatacatattttttaattttaaaattttttgtagagatagtggatcttgctttgctgcctgtgcctggtctcaaactgccagcctcaagccaggagtctcattctgctttggcctcccaaagtgtttgttgtttttgtaaaggaagtgactttggtagaaatagagaggcaataaaatatagagattcagaattcttagcaatgagttggagtccagtagaattgggtatgtatctctgatggagccgcttactccctgtgtgaccttgggcaagtcgtcccccagcagcaactttggtctcctcatctgtaaaatggggataatagcacctaactcatagggttatggtgaagaataatgaggtggtgcatgagaaatagccacagcaagtatcaatgactctaagtgagaccatcagtattacttgattagctgtaggaaactgtgtcaaagtgggacggagttcattctggaacttgttaaatgactaggcctctttcatgtacttagatagtttctcttcttgggtatatttcttcctgggtattgggtaacaccagtgagtgctcagttcagtgtctgggcccagaaacccatgcctggttagcattgtcttttcttctgagaaagatctgaacttgccatggactctctagaaaaaccccagtgtacaaattttctatgaaaagctagaattgatgattataatgagtaagttggctcttccttttcccatgtagattagaaaacatgtttttaaatcttctaattgaaattattcttaaaaaaccccaaagtctgacatgactccaactattgttgttttcatcaatatcaatcctatcaaatcaaagtttattttagtgtgtaattaacacatgtagactagaaaagtttgcacttttttatatcacaaaaaaggttaattttattttctatggaaagctagaattgatgataatgagtaagtcagctcttctttttcccatgtagattagaaaacaggtttttaaatcttgtagttgaaattattcttaaaaaaccccaaatcatgacatgaatccaaccattcttgtttttatcaatattcaccctatcaaatataaagtttattttagtgggtaattaacatgtgtagattagcatagcatatgtgtatttatataacaaaaaatgaatcaaaagttaattttattttgggcagtgttccctagaaacttataatatggccccatgcacttcaggttgaattttcttagtaaaatcataaagaggtccattttttcaaaaaatcaccaagtcaggctgcaagtttagaggttacttctattgtttcacttctctttcttcccagaagcagaccccagagacctgtgagccaaactccactcaccttttagcttattctaaatgtgtcctgcgggcttctctgtgaataaaaggcagaggctttttgacttcgtgtttgatgatttggcttttttcttttttttaccacctgacgggggatttcaggctcaatgtcccaatcgaaataagaatctttgagtgggttaacattgagtcttaaaaaggagggctgatttgttggagaggcaacaacgaattcatttttcactgtagagcactcaggaggagtctgaagctttgtcactgggcaacagaatgcctttctaagtaaatatggaaaatatgacctttgaaaatctagctgatatgatatatagattcttaggatataatttttaaaaaatatattatttccaagcactaatgatactccagagatactgcccacaaccagatgcagcatgtttatagtgtatctaggccaaaaaaaaaaaaaaaaaaaaaaaaaaatagaagatacagaagaaggcaattggtcaaaagattaactgaaggtttgaaaataattttatacacatttgtactgttggggtctctcttctctctgtctctgcttatccttctgtctctgtctctttgtttccatcacacatgcacacacacacacgtgtatacacacacatatatgtaagtagatcaatatgttataattttcacaatacgcatcttcttttgctacttttcagatacaggtcattaaattactaagtataatttaaaatatatggtctggccttttaactctgcagttcaattaattcttgggtagatagggggatctgctgaaaagtttgtctctgacgccttcaaaggtaagtcccttatgttctggcatttgctctaataacatgaattctttgacttcattcatccaatctcttcattgaaattgtgtgaaattccatagatagaatgttagcctttttacagagaatacaacatccacagtgtttacatatggcatttggaggtgtgatggctgcttgaaaatccagtaggaaatttgtctattcaccacatacattcatttattcatccatccatccctccatttatccacccacctctctattcatcatccgtttttctgtttatctatttgtccatccatgcatccatcccttcactccattctccttctaaaagttcttttttttgagacggagtcttgctctgtcgcccaggctggagtgcagtggtgcaatctttggctaactgcaagctccacctcccaggttcacgccattctcctgcctcagcctcccgagtagctgggactacaggcgcccaccacctcgcccggctaattttttgtatttttagtagagatggggtttcaccatgttagccaggatggtatcgatctcctgacattgtgatcctcctgcctcggtctcccaaagtgctgagattataggcgtgagccaccgcgcccagtctcttttttttgtttagacaaactctcactctttcgcccaggctggagtgcagtagtacgatcttggttcactgtaacctccgcctcccaggttcaagtgattctcctgcctcagcctcccaagtagctgcgattacaggtgcccaccacctcgcccagctaatttttgtatttttagtagagacagggtttcaccatgctggccaggctggtctctaactcctgacctcaagtgatctgcccacctcaacctcccaaagtgctgggattacaggagtgagccaccacacctggcctcactgattaagttctatgtgtcaagttctatttgtcaggaactattttaggtgacagaatacaatggtgaatgaaactgagaaaatttctgttgtcatggagcttatgatgtagcggggggagataagacattctacagatcatttcactcatatttaacctcatttttattaggtactttgaagaaaatggactgggtaccgggagaatatataatgggaagctaacctatgtaatggctggggatgcagtcagtggtctgggaattaaaaaaaaaaagcccaacttctcattctcattttctgaggtaactggagaaagtctgagttgtcaaggaactagagctaaaaatctgtattgtaaaactgcccatatcctggataatatatgcaacagggctgaaggcagtggctcatgtctgtaatcacagcactccggaaggccaaggcaagaggattgcttgaggccaggagttcgagaccagcctgggcaacataacaagaccctatctcaattaaaaacaaaacaaaatatgtgcaggagacttatctttgtgacattctatggagaaaccgtaaatatttatttgtatcatggctgcaagtaagatgagtaagtatttggtagaactagcctgttaccttgagatggcttctttcccagtttgacagagaacttcatctcctcttagttaataactcagataatgagctgacttcctttttgtttagggtttacagtttgaggtggctgttctaaagaagaaaaatcagacaatttcagaggtggaggagcaagtctgggccaatagattgaaaataaataaaaagagagagcacggcatttcagtgagaggcattttgagctgaaagtcagttttcagggagcacaagattactcacattgcctgccaaataccttcctcaccctgtgtccatctctgatatattacaactcttcattcctttggcttaggcagtattttctcttgttcagaagatactttttaagtagtttaacaataaacagtgttgactcacttatagagaaaggacttttgtcaagtctgtctttctgatttcattaaggagaaagtctcagttggtgttaatatatctttaacaaccctctaacacaaatctgggcacttagtagatatctgttgaatattctttttttttaattataaaggaactacagggaattatgagaatgtaaaactatgggctgggtatggtggctcatgcctgtaatcccagcactttgggaggctgaggtgggtggatcatctgaggtcaggaattcgagaccagcctggccaacatggtgaaactccttcactactaaaaatacaaaaattagccaggtgtggtggcatgtgcttgtagtcccagcttctcgggaggctgaggcaggagaatcgcttgaacccgggaggcagaggttgcagtgagccaagattgcgccactgcactccagcctggcgacagagcgagactccgtctcaaaaaaaaaaaaaaaaaaaaaaaagttagtttctacctataaaccaacttttttttgagtcagcgagggtacacttttacctaatgttgagcctggttctgttctaccctgagcttgattctgtactggctattcctccttgtgaacagagaagggaagttcagtgtctttcctggaaatttttggtgttgtaaggatgctcagtgttcctgaaggttgagaggaacagcaaggacaggatctggtagagatgtcgcttttattcagaagtgctaagctgttaatcattaccatggttgttattaccttttaattgccatttgtcctgcttgtttgtggtctcctgggcatctccttccccctcagcccacaagcagaaagttgccctacagagtcaggaggagaactcaaacccagaccagagagctctgatccactcctatgggtcttggaactggctaagtagatggaaattaactgattcaagatatgcaacaccattagttcaaccatagctgtgttcctggggtgaattctagctttcttttttctttcatcttgctacttcccagagaccagactttgggcctctagggaaggagtatcaaattgggcttgagagttcaagctcaaaacagacctgattttaaatcttggttctgcttctccatatcttcatgacctttgggtgggtaaaatatgatcctgcctctatctatctatctatctatctatctatctatctatctatctatctatctatctatctgtccatctatctatctatccatccatccacctatccaccaatacatccatccgtctgtccatccatccatccatccatccatccatccatccatccatccacccagctattcttccattcattcatccaaacatccacccatccacccagctattcttccattcatccatccaaccatccatccatccatccatccatccgtctggctatccaaccgtttttccattcatttaatatatatttattggatgcctaccacatatcaggtactgttctaggcattggaactagaacagtgaacagaacagcatcgctggcttcatggaatttacattctagtagaataacagtaataagtgaataacatagaacgaatatattgtataatgtcaggttgccatatgggctttgaagagaagtaagacactgtcctcacccttaaagatcttcctggtcttttaaaaggagaacagcacatggccaattagttctgagacataatgtaaagtgctacaccaagaatgtaaaaacactttggatggcatccctactcctcctcggaccggtgaagattccacagaggaggtgacatttgggaacagtcttacagcaggagtgggagttcccggattgacaaggggatgagggcaggggagggtgtttcaggcacaggacaggacaacgcagttgagatagtgaggagagagaatagggcacatgcagggaacaggaagaagagggtgtgagggagggaggagcaggtgggaggtgaacgtcatatcagaggggttggcccctgtgaaggcagtgtagtgactaggaagtggttgttgtcactgttttaaagtgggatgtgtgggggtgagtgaaatggccaaatgtttgaaaaagaggagcatgagatgcctttggcaacaatacttgccatgactcaaatcctgaaattctaggcctgcagtgatggaagtcaggcaggagaaactgaaatggccatttagaagcagtgggggtgccttaccggagcacctcgtggctgttgctatttttcacaccctaaagagacatttggaatttcatgtcagtcatattgttgattgttctattttgagggtggttactagttatttttatggttctaacaatagggacatctctcttcactgtatccttagacgcggagggccgtagaaatgaattttcctctgaaaggcatcctcccactccctctccctctccactgctgtcacccagtgggtacgtgtttattgagcacatgctgcacatggtggtgaagagttggtgttttggagaaagaaaggcttcgatttaaatcttgacttcttgctgtgggaccttaagcaagttacttaacctcttcgagcttctgttttttcatagctaaaaggatataataataaaacctactttatgtgaagtgtttcttagcaccctacctgacatatatacagtaagcacttgataaatggtagctatttctgttcttcctaggactgggcactgtccttgtccttactgagtttataatcctgttggggaggcaagatgaatgctcttgaatcaaggagacgacgcaagaatggatgtgcttacatgtcgtggtcaatagcattagctgcaccttacagtggatcttagagagaaatgcttggttggggccggagaggtgatttgagtgtgagtgagcacagtgctttctgagaaaccctttcctggcctgcaacactttaatttgtgggaaacctcaggaagtagaattgcaatctgtgatcgccccatcggctgacctcacttcaaaaatgtattggtagcatttcaactttaaatagatttgtgaccatttcacccttctaaatttgggttcccttcaccctttgggtggagtgtttatatcccttttcggttgaagaagctgacagatagtgtaggtgaaggtggagggtgaagtctgaaggacggtcgcttgtctcattgggatagtcagggcagtgatttttgtgggatggccctatattgaagatcttctttccctccctaaaggtagagaccattctttagagtttagtgagtgctgcaaatgaagatttgatcgttatttggatttttttgcatgtgtatgtgtggattttttttggtagttatccagatacattttgtggcaaaatttatggctgagggtattgataattgtttctgagacaaacagtgcacttagggaaacaggattgacatatagagtagagaaggacttctttttatttcagttggatattcatcttttggtggctagctttttttaaaaaaactattaatattatttttgattgacaaatcataattgatggggtacaatgtgatgttttgatacatatatacaatgtgtcatggttaattcaaactaattaatataaccatcagcttgtttacttattttttatggtgagacatttgaaatttacttagttatttgaaatatatgatacacttattattgactatgttaccctgctgtgcaatagatctccaaacctattccccttgtctatctgaaactttgtatcctttgatcaacaactccttccctcatcccagattctggtaaccatcctcctactctctacttctatgactacgactttattagattccacatatacgtgagatcatgctgtatttgtctctgtgtttctggcttattttacttagcataatgtcctccagattcatgtatattgtcacaaatgatataatttctctcttttttttaaagtctgggtaggattctattgtgtgtatacaccatactttctttattcattcatcctctgttgaacacttaggttgattccctatctttgctattgtaagtagtactgcaacaaacatgggaatgcacatattctttgacatattgatttcagttgctttaaatatatgcccagaagtgggattacttaaaaaaaatttaatttaattttttttaatttgagactgagttttgctcttgttgcccaggctggagtacaatggtgcgatctcagctcactgcaacctccacctctcaggttcaagacattctcctgcctcggcctcccaagcagctgggattacgggcatgcaccaccacgcctggctaattttgtatttttgctagagacggggtttcactgtgttggtgaggctggtctcaaactcctgacctcaggtgatccacctgccttggccttccaaagtgctggaattacaggtgtcagccaccatgctcggtggtagttcacttttttgtttttttgagaaacttttagtactgtttttcataaggctatactaacttacattcccaccaacagtgtatgggtccccttttctctacatcttctccaacatgttattttttatctttttgataaaagccattctaacaggtgtgaggtgatatctcactgtggttttaatttgcatttccctagtgcttagtgtgctgaacattttttcaagtacctattggccatttgtgtgtcttcttttgagtaatttctgttcagatcccatttttaaatcaggttatttgtttacttgctattgagttgtttgagttctttgtatattttggatattaacttcttatcagatacagcatttgcaaatatttttcccattctgtgggctgtctcttcactttgttaattgtttcctttgctgtgaggaagctttcagtttgatgccctcccatttgtctccttttgcttttgcttaatcattgcccaaaccaatgttgtggagtttttcccttatgtttttctctagcagttttatagtttcaggttttaagtctttaatcaattttgagttgattgtgtatgtggtttgtaagataaaggtctaattgcattcttctacatgtggatatccagttttcccaacaccatttactgaagagactgtcctttccctcattgtgtgtttttggcacctttatcaaaaatcagttggctataaatgtgcaggtttatatctgggctttctatcctgttccattggttgatgcatctgtttttatgctagtaccgtgctgttttgattacaattgctttataatgtattttgaaattaagtcgtgtgattcctccagctttgttctttttgctcaatgttgtcttggctatttggggtcttttgtggtcccatatgaacttagggattgttttttctatttctgtgaaaaatgacattggaattttgataagaattgcactgaatctgtagattgctttggctagtatggacattttcacaatattaatttgtctagtccatgaacacggaatatcttttcatttatttgtgttttcctcagtttctttcatcagtgttgtatagttttcagtatacagatagtttgcttccttggatacatttacacctaagtaattttttttttgctgctattgtaaattagtttgttttcttaattttctggtctggtagtttgttattagataagctagtatataaaattagaataattagataatctaatatagaaacactactgattgtatgttggttttgcatcctgcagttttattgaatttgttgatcagttctaacagcttttttagtggattctttagggttttctgtatataaaatcaccttgtcaacaaatagagacaagttcacttcttcccttcctattaggatgccttttatttctttctctttcctaattactctggctgggacttccagtactctattgaaaagaaagggtgagagtgggcgtcctgatcttagaggaaaggctttcaacttttcagtgctgagaaggatgttagctacgggtttgtcataatagagcccatagtgtttattgtgttgagtgcatttcctttataccttattgctgagtacttttttcatgaaagaatgttaatttttttcaagtgcttttttttcctgcatctattgagatgatcatatgatttttatcctttattttgttaacatgggtatcacatttattgatttctatgtgttgaaccatccttgcatcccagggagaaatcccacttgatcatggtgaataaaattcttttaatgtgttcttcaatttggtttgctaatattttgttgaggatttttccatctatgttcatcagggatattggtttatagttttcttctcttgtgtttttgtttggctttggtatgatagtcttggataatgagtttagaaatactcccttaattttttggaagagtttaagaagaattgattgacatccagatcaagaaacagaacatgctggtaccctagaagcatcatctcacaatccctatcaaccgtatccttcaggagtaatcactatcctaacctctatcacctatgattactttcatctgttcctgaacttatgcccacttttctgttatgcaactccattgacttatgcccatttttctgttaaaaaatttaaaaagtgcagagctttaagttactgaggctgagcctgagaaatgttagctgggacttttttagttttgcatagaggaagtgaaatccgtatgggagacaggcaccttctggaatcacccattggggaatggtgccgtttgccttctttggggaacatctgcttcctgtttcaatgttgcccatcggttccagactgttcaacaaggaagccagggcattctgacagtttttccacacaataatttagctctgtaaatactaggaaaacttgagctcacaaactatttttagggcttaacatttcaaaaattctgtattagtaagaatctattaaagctgctgtaacagacaaaccttgaagtctctgtggcttgacagaagggagtttatttcttactcatgtcactaaccagtgcaggtggtcctggtcaggacatcttccacagagtcacacaggaccccagggtcctccccattgggccagtggaaggggaaagggaaattgagaaagcacactcatttcacaacaacttcagctggggaaggaagtcacatcacttctgctcacattctatttgccagaacccaggcaaagaggcaaccaacggaagggggtcctgggacatgtcgactagctctatgtccaggaggaaaagaaaacaggttttgatgaactcagtaaatctcactccagtctccaaagccataatttcctttgtctttctttgcggtgatgtatctagttttatctctcacttgactggtaaaactaagatgcaaaactctggacgtctttatcttatcaaacatagcagggaaagagtgagttctatttgtgttcctaaaagtgaaataaagaagcacttttcttgtttttagttattagaacaatctggctcttgtcagactttctagtttttcaatcagtcagaattcttgcctctctggttgcctgttgtattaatccattctcatgctgctaataaaggcataactgagactgggtaatttataaaggaaagaggtttaattgactcacaattcagcatggctggggaggcctcacaatcatggcagaaggcaaaggaaggtcaaggcacttcttacatggcagcaggcaagagagcgtgcacaggggaactgccctttataaaaccatcagatctcgtgagacttattcactatcacgagaacagcattagaaaacccacccccatgattccattaccttccgccaggtccttctcatgacacatggggattatgagagctacaattcaagatgagatttgggtggggacacagccaaaccatatcacctgtggacatcccaagcagatctctttgaggccgggttagttctcttctaagctgacttgttatatagaagaatcctttgttggttctacttccagatatttgactggacacccaacaaatcaattatctattgctggatagcacataacctcaaggcttagtggcttaaagtagccactgttttatttagttttagtttctgtgggtcagtaatttgggctgggctcagctgggtggtctgtctgatctgggcagggattggctgttcttggctgggctcatttaccttcctggggcctcagcagggatgtctaggacaactggggcctctcttcaggtctttcatcttccagtgggctatcctgagcatggtcatatgctgatgggtgcattctctgggcatgagcaagggctgcagggcttcttgaagccaaggctcagaacatgcataacatcacttctgccatattccctggtcaaagcaaatcacaagcccaccccagaagtaaaggaggaaatagagaagagaatagagatgcctcctcttgatgggagaagctgcaaataatttgtgatattttttggaacccaccacactaatttcagtgtggtcctcgcaattgcttggctgtctaaaaacatactccagtctagtgtgcatttctgaaaatgaacttgatcaaaggcaggccccaaatgagtgctcaacatttacacctgataataatactacctacctcctagggaaatggtagggccagatgagatgctgtatgcaaaggatacggccaggacttagtgcacacgcaacactgaatactaccaccatgactactgaatactgccatcaaatactaccgttactaccacttggcactccctaaaagcttgagattcagagaaaggaagacaaagcccctgtacttgaggagggagagaataaagagagccggcgggggagggggtggcaggagagagagagagagagaggcgtgtgagtgagttcttgcaacacagtgtggtcagtgtgatcacagagctgtgatggagtgcggatgaggtctgatgacttactggtcaagagcatgggttcaggcctcagttcctccccaatcacatgtggggtcttaggcatctttctttttaatcttcagtttctttgtctgtgaaatgaagataatggcacagagcctacctcccagagttctatgtggattaaatgagacaggcaaacaacaacaaaaaccacaaacaaacaaaaaacaaaaatgaaaacaaaaatcatgtgattgcttattaaatgttagttatagaaaaaaatataagttcttaaatgtgcccttgtaaaaatgtcctaaagacctcatctttatttagttcttctgcaactctggctagcatcattgataaattgtcttaaaagatgaagatttgtatgcaggtggtttattggggatgtagctcttgggaacaacatctataagggatagagggaagcagggaagaggtagttgaactgtggtgcaatagttgtaatagaggccaaagccaattccatggctggagctgagacggcccttcagaactgggacaagccaatgcatcaagtgggcattgattgtgggctgctctttggaaggcagcattaccttgggcaaagcagctcccttcttcaggggaggagtcccagggaggacacagctgtgagcaattggttttcccagcagctgggggaatgagtgccttgtccctatagatggttttgagggggctgcatttgggggaatgccttctggggttcactgcgtgcttctatgtctttcttagaggttcatttcaaactataccttggttcattcacagtactgatttagttactatccagattcatagactgtacttgctggcactggaatatcatggacagagagtcctaatctgactaggcctagggaatgacatgggaatagcttgtcctgggtcatccagctaccagagaggagagctgggattcatatccaaccaacgatactttatacctcacattacttctgttatgctacacactcctgagtcacaggagattccaacttgtatttcaagcccagactgcatgacttcaatgtcctgttgcccttaacccctgtatcagattgcagccccactctggaaagttttcttgaattcttctatgtatgttttttaaactgtgggtcatcactcattagaagttcatgaagtcaatataataggtcaagaataccatgaagaaagcagaacagaaaatatcacagtgcatcactctcaggaagggtagatattgtttcacgaaactttttttttttttgagacagggtctttgtctgtcgcacaggctggagtgcagtggtacaatcatagctgactgtatcctcaacctcccaggcccaagagatcctcccacctcattctcatgagtagctgggacttgaggcacatgccatcatgcctggctaatttctaaaactttttgtagagatagggtctccctatgttgctcgggctggtctcaaactcctgagctcaaacagtcctcctaccttggcttcccaaagtactgggattataggcatgagccactactcctggcctcatacaatttttatttgatataaacatatatagccatgagtgaactgggtcaaaatgtaaaatgtgtctcttactgcaggtaactgtcaatgtagttcgaatatcactgtgaaatatatagagaagaggctctgggggctcatgaacttggcccatggactgttgaggctttttttttaatctttagagatgatataaatgtagtgctttgaattctttataattagaagttttattcttaccccatcaccatgtcccaagataatttttattatcatctttcagctttaacatatcacagacaaaagttatttttccaaatagaattttaagtatggtataagaggtttttagaaatggaatgattggttttggcggaactgcctggcctgacctgtcactcgggtgaagtgtcagagagctgtgtcgaatgctggcggagaactgtccctctcctgcagagagaaggagctgcttatcctgggggataatgtgggttgagaaagaagtgttttatgagcagaatcagcacagagggagggaggaggaggtgtttaggggctgcagagagccgccagaagatgtgggaacagtatgccagcacggaggtgggtcagatccccatggtgggactctgctgagggttgcctccagccgagacttccaagggctgggattcagtgtgtgtttatgttctctggtgtgcctgataggtgggggcccacatgacagctggcctctctgtgtttcccttctggccgtctctgatttggggcccaagggccataggggggccagggcactccagatgggacgaaaagtcaagtccaagaaaaaaatgaaatccgggctaggcttgtccctgcttgaggatgtgagagagagagagagagtgtgtgtgtgtgtgtgggtgtgtgcgcacgtgcgtctgcagtccctagaaggatctctattcattggacagagaggccaagggaattttccatttcctggatgtcttcaaagatttcaaatgccattaacttgagctgacatttattgagtactcactcggtgactggcactgttctaagtactttacatgtattaacttatttaatcctcacaacagccctgtgtggctgctactgttattgttgccattttatgctgagaaaacagcacaaagaattgagaaatttttccaaagttacagttaggattcaaaaatagacttggttttaggattgtgtaacttcagaattgatggtgacaatgacgttgatgatgaggatgatgatgatgatgatgaaggcagctaatatttcagtgtctgcaatgagctgggcattttcacaaactttatccctttgaatctttaccttccactaagatttgctgctattcttatcccttttgtagataagaaagcaagcttagagaagataaaacatttgcttaagtaactgcagagcgtagattgaattcaggtccattcgagtcagactgtctgttcaccaaggtgaagggctccgggggtcacagaggagcaccatggtgaggaaggccccgtaagagtgtggcagaatggcaaccaggaaggatctggtatacgggatggtgataaggcccatctctcatggccaggaaagtgtgcctgccacagcaatgaatgaaactggcaacatttgacaggaaggggaaattctctagtgggaggaatacttccatcaaactgttttttttttttcccagtgggggagtttgcacatgtgtagatttttttagccatagccttgaataaggaattcagaaagtggcttctagtttgaggactttcattggccacgtgatcacagtaggctgatttcttcatgcctaagttaccaggctgggaggacaggctgagaactatgcaagctgttgagtcacttggaaggaagagggttacatacagcaggcactttcatggaataatacttccctgaagagctgcactaatttattgaggcactgagctggatgcttcacacacatgatctcattgaatgtccacagcaccctaggaggttgatctcattattaacttcatgaagtgactgaggcttagagatattaaatagcttccagcctgggaaacatagtgaaaccccatctctgcaaagaataaaaaaaaatgagctaggtgtggtggctcgtgcttatattcacagctacttaggaggctgaggtgggaggatcccttgagcttgtgagggttgaggctgtagtgagctttgatggcaccactgcactccagtctgggtgacagagtgagaccctctctctaaacaaacaaatcccaggagacattaattaacttgccactggtctctaagctaagtagttgaagagggcaacaaacccaggtggtctgactcctaggcttgaaggtccaggttcagctactccaccagtatccctggtcagtctttggccagggcacagaaggtggcatatcaagttgtggggtctgatttggaaagtgtgagatccctcctttgtatcttttccaaagtccactcagaagagagtagtgtaaaaggagtgatagcacagcgtggtctggctggcatagtcagccgccctgtgatgggcagggggaagctgctttctgtcctcaagcagcccctaaacttgtaggccagactcataaatcacacattgataactcagtgtgatgtgtgctgtaatggtggagaggggggagaaatgccaggagcagctcacctcccagggtcctggggaggctgcacagaggagcctgagttctcagttgggttttgaggcagaggaagcagtgaaagagagaggaagaatgtcagtgaggtgcggggagaagcaagagagagaagacacttggcaggaagaagtagttgaagtacccggggatgtttagcttgaagaatagaaaatttggaggaggcagagaaaaggcaggaaactttaaaagcaggagagaaagacctccaggttcccaaagggagcatggcacttctcaagggggtgaggttgacagcattaggagagagagagagagaaagagagagagagaaagagagagagcgagagagttgtcaaggaagggaaggacccatggaggggagagcacaggtgaaaatgagaagtgatgggaaaatgggtgggaaataaatgaagttttgaggccagttgagaaatcttgcttggtggtttctattttctttgtgaagcagaaaaaaagaggaattagacagacctgcattcaaatctcatgaccccaggcaaatttcttatccttagcttcttcattttgaaaaaggggtgaatgataataggacctacctaataagagttgtcaggatcaaatatgttagtgcttgtgtaagatgcagtggcaccctggcacttagtaccaaaaaaaagtactataaatgttgtcacctattgagggagtccgggtttgggtgcttgatacatagaaatatcatgaatagcagcagagaatacaagaagaagagaaagcttgggggagaagatagagaattatgcgttgggtatgttgaggatgaggtgcctgtgccatatccgggtgtaggtgcccaaaggcaactggaagtcatgagaagtcagggatagaggtaaatgtttgggagttgttaatacaggggtgcatttttaaaatatctgaagtatgttactggtggcactcaaagatttttaatgatgtaaggtattcaacaacatggaactacgtagttttaaaagaaattctcttgtaggccgcgtgtggtggctcacacctgtaatcccagcactttgagaggccaaggtgggtggatcacttgaggtcaggaattccagaccagcctggtgaacatggtgaaaccccatctctactaaaaaaaaaaagaaacaaaacaaatcaaaacaaaaaaaccgggcatggtggtgtgtgcctgtactcccagctactcgggaggctgaggcaggagaattgcttggacccggagtcagaggttgcagtgagccaagatcgcgctactgtactctagcctaggcaacagaatgagactcagtataaaaaagaaaaaaatgtttttttcttttaattcttcgggttaaggagagtgtcttagtttggtgctatcatgtcctaaacatctttctaatgcatgcaaatctcccttttaagctaaaagaatgaagcaatctcagactcagagctatgtacctgctagaatttaataatttaaattttcattgtgttcttcatactcaccttctatttatagcaagtgttactagctctccaattctggaggttgtttcagataggatgcattagttctttttttttttttgagacaaggtcttgctctgtcacccaggctggagtgcagtggcacaaacacagctcactgcagcctcaacctcccaggctcaagcaaacctcccacttcagcctcccaggtagctgggactacaggcatgtcccaccattcctagctaattattttattttttatagaaacagggtctcactgtgtttcccaggctggtcttgaatttgggctcaagcaatcctcacacctccgcctcctaaagtgctgggattacaggcatgagccaccatgcctgacctgctttggttcttaaaaacagaatatctggcgagcctaacaaggaggctggtggttccagggttggtttaatcaaagacttaacactgtcatcaagcgcctctcagttatttgctctgccatcctcaaaatgtgatcagtgtctcccttcttggtcccaggaaggctgtgatagctcccagaatcacatactcacagggcaaagcaggaaggaaggggacataggacaaaggatttgtgtttaagtatttcatgtcacatttgcatgtggtgcttggagctgtggcagctatgttttgaccatgagggacaaggttggcaagctgtaaatggcagtgtaaaaagagggagaggatctgtctccttcacaatatccttgagcccctgaattcactaatcttgatatagctctatctcttgaaattttgttttgttagataattctcttactgcttaaaacgtcttaagatgggttttctgttctttccagtagaatgcattgtatctcacacaatttgaggttattgcctcaacctactctgaatcattgctcctcccccttttttcctggttgattagcttctcttgagattgtgtcttatcttcctggttttttgtatgtcgggtaattttggattgtatcctggacactgtaagtgttgtgctgtggagactctggattcattcgtatttctctgaaaagcattgatgtttttgttttagtaggccattgacttggttggacagtagactgtctctgggacaccagctcagatgtcagttctgttttttattttatccttgagtcttctttgggactgccccatgcatgcatggttcaagagtcagccagacatttgggtggggtttagacacagaatttggggctcttctctcttggctgtctctattatggaattccttcctcactttccagaagccgtgagtgacctgaaacctgtcctctggttctgtacaccagaaagacttgaggcttcatgttgaagttttagctgacagcagcttgcgttcaggggaaaagctgtaaaatgaccattcccttcttccaagtttcaacctctctgcagaatctgctttcttttgttcactttcgagtaatttcaggaaaaaatttttttttcgttgagagtttttacttgttacctatggaaaggttgggtctagctgaagcttgcttgcccataacagaaacgagactcttttctgtctaacacatgggaaaactaacgcccagagaggtgaagtcatttccccaattgtcagaggcacttgagccagagtgactccatcttgagtaagggctaggaaaataagaccgggacttgctgggctgcattcccagaaagaaaggtattcctagcctctagatgtctacagttaagggaacagattgataatgtttactaaacagagccaggcttggcagtgtccagctatcccgatatcttgagaacaaaggcattcctaattttgctttaaggataataatattgattattgcaaaacagagtaattaagaaaattaatcctttatcacaaacccttgtagcagaacacatctctccatgatttttaaaatcatatatatatgatttatatatatgattatataatatataacatatatgatcatataatcatatatatgcatgtgtatgtgtatatatatacacatgcatatatatgtatatatgtgtatacatacatacgtatatatgtgtatatatacatacatatatatgtgtatatatatacatatatatacacatacacacacacacacacacacacacacacacgaatattttacctagggtggacgtgctccttctcttacttttaggaaccccctactctgtctatggagtaactgttctttcaccactttactttcttaataaacttgcttttgctttgcactgtggactcaccctgaattctttcttgtgcaagatccaagaaccctttcttggggtctggatcaggactcctttcctgtaatacaatgtcacagagctcttaagtggcagagcttggggccaaacttaggctgctgcacccgatgtcccagctcctctgccctatctagctgtggatttgtgcctcgaaatagaattgcattttgaatgcagtttcattttcgtatggaaagtgtctatcctgtaaatgtaactgtagcagccccaaagctgagctgggcagttttatggcagcctggagtcagtcttgtccgcttccaatcagggttcctggactggctcctatattaaaattggtattagtagacaatgttccaggcagagttttggatagaaactatccatcagcaccaagaatgtgcctgatttggtaatctttttaccaaagtaaaagtcagtagtaagttgtggttaaaagagaggaagttcagagttcagtacgttatttctctctctctctctctttgtttaaataaaagaggaagttactgctcttatttttgtaccagcccgtcagtaatgggtacagagtaaaatcttagctaagctgaggtcaaacttcaaaacttagtaataaggatctcccttgttcctttgtagggcgactaacatgaaggttctgactcttaacccatagagccacaaaaaatagtcctaggaaaatcatatgattttatttattttaggaacagaaatggtcccttccgaagtagaggcatttctacttctttcctaaacaccatctctgctcagtgagctctcccaccctcaggtactgtgtttcaggcttattgctgtattgctagaagtatcctcaccttcgagattaagaaaagatatttattgccgggcacagtggctcacgcctgcaatcccagtcttttgggaagctgagacgggaggatcacttgagcccaggatcttgagaccagccagggcagtatagtgagaactcatcttgaaaagaaaaatttattgagctcctactgtatactggggatacagcaataggcaagatagcccttgctcctcatgtaacctacagataataaacaagattacaaacaaacaaaataagaggtcgttctagattatgataagtgatggaaaagaaaaaacctgtatctacttcttatagcagagacctgcattgggagttgctgtgatcaaacaggaaacggaaggtggagtttgcttctgtatccctccatccctgagtggaggctgggtgcttctcacgaccagggcctctgagatttctttttttgttttttttaaattattttagattaagggagtacatgtgcagtttcgttacgtggttatggagcgtgatgctaaggttagggtttctattggtcgcgccactcacatagtgaacctagcatctgataggtagttttttgacccccttcccctatgccctctccctcttggggtccctagtgtcggttgtttccatctttatgcccctgtgtacccaatgtttagttcccacttcgaagtgagaacatgtggtatttggttttctgtttctgcattaatttgcttaggataatggcctccagctgcatccatgttgctgcaaaggacacaatccaaataagcacaatcagaaatgaccaagctgacattatgactgatcccacagaaacacaggagatcctcagggatgactatgaacacctctatgcacacaagttagaaaacctagaggaaatgggtaaatttcctttgcacacaacctcacaagattgaacgaggaagaaatagaaatcaagatttattttctgttttgtttgtgtgtgtgtgtgtgtgtgtgtgtgtgtggttttttgtttgtttgtttgttttttggacaggatctcattctgtcactcagactgaggtacagtagcacaatcacacctcactgcaaccctgacctcctgggctcaggtgatcctcccacctcagcctccagggcagctggaactacaggcatgtacaacaatgcccggcatatatatatatatatatatatatatatatatatatatatatatatatatatgtgtgtgtgtgtgtgtgtgtgtgtgtgtgtgtgtgtgtgtgtgtgtgtgtgtatatgtatatttaaatttttatatataaatatatatctatctttgtagaaatggggttttgccatgttgtgcaggctgaaattgagatttcctaatgtaagaaacagagccccaaggggctcttcttgggctggtcgctgtatttcatcaggtgcctctgtgttggacacttacttccctccattgcatagattggatcctttatgcttagcctagactctgccctttgggatgcaaggagctgagtgaaggttctgggagagtaggcttaagcccagaagagggaggcctctctctggatgtcatgctagagcctgccttttagtctttgtgtttccactctccatcctcctcttctggagttcagaaccccttcctggtcaaattgcccccgggctctatgggatcctgtgggattctatcctttgagtctaccccacccttcaagtacttcctgtcttttcacacctaagtgaaagaaagtaggataagaacagcagttgttaacttgattgattgtaaattgccttcattagaaaatgttaattatcgcccctgggaagggattaatcctttaggtctctaggttactagactggcaaaagccaagtgtgccttggttgactgtttctttctgagagtaaagagaaaacatcaggggaggtagaaacctcagtcatggggtaatcattatggccatgtttatccccatacacgtatcttctgctgattctggagtcagctagattttgtgacccagcatagatgatatagtgacattgtcctgctgtgttaaaaaatttaagttcataagaaatgcataagtacaatctcatcaggataaattacacaacatagataagattgaagaccttttaactcttttgacgtctcaatttagtcccctctaccttccccagaagcctattgtttgtaaatttggtgtctcttatagaactctgtagcattccaaagtctgaactttctcccatgcatatggccacttccctgttgatgaacatttagattcttttttggaggggttgtgtctattacaaacagcatggcaatgagcatctttctacacatctcatcaatatgcaagtgtttctcgtgttcctcggaagtataatggcttagccctggggtatacacgattcagcttttaataggttttgccaaatgttctccagaatagctggaccactgtatactcccaccagcagtgtgtgtttccgtctcactgcatctttcccagaccatgatattatcaggccttaacacttttgccaatctgatgggagaaaaatggcatttaattttaatgatcctttcctgtccccttctcttctcttctcttcccttcccttccccttcctttcttccttcccttccttcccttccttcccttccttcccttccttcccttccttccttccttccttccttccttccttccttccttccttccttccttccttctctctctctctctttctttctttctctttctttctttctctttctttctttcttttctttcttcatttcctttcctttctttcctttcttactttccgagtctcactctgtcgcccaggctggaatgccgtggcatgatctcagctcactgcaacctccgcctcccaggttcaagcgattctcctgccttagcctccttagtagctgggattactgccacctcacctggctgattttttttgtatttttagtagagacggggtttcgccatgttggccaggtgggtcttgaactcctgacctcaggtgatccaccggcctcggcctcccaaagtgctgggattacaggcgtgagccgctactcccagccacctcttcttactagtgagactgaacatctttttacatatttattggacaattgtatttcatcttctatgaatgtctccctccccacttttttataatttcatattgatttgtaataatttttatttcaatctactagacactgatcctttgctcgttgtttgtgtttgtgttgtctattttcatcaagtcctgggtcctgtgtcactttagtgccataagggaatgacagactcccttattattggtttagctcttgaagcctaacaaagtgtttccaaacagttcattattcccactttaaggatgtgaagactgaggctcagggtcacaacttgtgcaatcttgggtagactttgaatctctgagcagacttagaagtagaccaaactgctgtgagccacagggagattattattgctaacttttccctgttagccaaacacttctgcttggtccctctagagagaagtctttaattattcatctctttccaagtaattggcgacaagtcctgcagctgggagttggaataaacttggttgctaaaagcatccatcacacataaaacaggggagatctggctccaaagaatggtagatgtagatcttcccctacggatttgttttctgaagatctccttatacactgacctcagccttttgctgacctatccttgtgaactgaaggctgaaaaaaccaatgtagccatggtccacatccatttatcactttcagaaatggcccctgcactttatatttcttcaggtcctgcaaaaaatattgaaaatcctttacaaatagaggcaaggtcaggccatccctgtgggatttccagggagcagtgcactgacccgttttgcagaatgggaagcaaaaaataaaactcagacttagacagctggcataagcaaggacttccctattctgagtgccaaatgtcaatttgaaatacttgaacttttattctctgggacatgtactggcattagtaagaatttctatttattgagcatttatttggggcaggcagatgataagttatacacattaattatcttatttgattttcacaatgacctatcagttacataattgattgtctgcattttatggataaataacctgaggctcagttatttgacttgctcaaggtgatgtaacaagtaaatggcagagccatgatttaaataacaaaacgcatgctcttaatcaccacattaatgtcttgatatcaattaatagaaccatttcccctccattttctctttagtttcagaactggtaagagtttgtctaataagatttttataaagtggtgacatgaatggcttgtggggatggagactggggccggctgccaagggtacccatctcacacgaagcatcaggtccacttgggtttgtttttggctgattacaatcttgaatcaaacttttcagtacagctggtctcccaagaactttctaatgttgatttgagcttccctgaatgaatctcagaaaataagaaagggagagagaatgcctgtgtattgagcttgacccatttcacagatgccgaaatagaagtgaggcgacttgcccagggtccctgtggtggattgtgttgttgtctcaattatttgctcccacctcatacaaggattatacatttcacacatggctatgtgacatacatgtctacttgcagaagggacacactttccttcccactgatgtggagcattggccaatggaacgtgagcagacacaatctactctacatttaaacagaggctttgagaagctattgtgtggtttagccattgttcttcccacctctgccacaagaccaagaaagggctgttgcctcagctgcgtcctgggatggaaaagacacaggaagtagaatcacagagccacagacaactgcagtgacacgtagcacgagtaagagctaaacttcgaatattgtaagtcactagaattttggggttgcttattattgcacttacctaccaaaagctgactaatacagtcatatagccagtaacttgactaagctggagcttgagccaggtcgaactcccaatcctatccatggtctttttcttatttcagtcttccctaatattccattctaacttacatcatattttctgtgtctgtgtgctgtctgtccttttttcttttaaataaatctttttctaccaaagatatagaacaggaaataatatttttctttaaagagtctgttttttcatttcaacccatttattttgaaggaaattttatcatcgtataaatagaaaaacagtgtcatcacaaataattcataactataagcagtggctcacgcctgtaatcccagcactttgggaggctgaggtgggcggatcacctggggtcaggagtttgagaccagcctgaccaacatggtgacactccatctctactaaaaatacaaaaattagccaggcatgctggcagaggcctgtaatcccagctactcaggaggctgaagcaggagaatcgcttaaacctgggaggcggaggttgcggtgagccgagatcgcgccattgcactctagcctgggcgacagagtgagactccatctgaaaaaaaaaaaaagggtaatttaaacaatattatgaagttctagctaggtactgttggcagacaagaatctgattttgaaatatcgtctctctatgttccaaaaaggagtttggcaaatattagaatggtgttcaaaacatacaagcaccaaactgatactttctcctttgataaatcaggaagattaaaaaagaatcagaagaacaatttcttcctagtatggcttggtgtgatgagtgtcatctgtattccatataaaattctttcagatatcaccaatgagtgatatgttcattacaatggggggtgtccctttctttggttcatgtataataactggaaacatgtatatagcatgtggtatgtgccaggtactcttcaagatactttagttatttaatctattgtcagataaggaaacagaggcttggagaggctaaacaacttatcctagctagaaagaggcagaattggggcttcaagtcaggtctgtttgattccagaggcaacatcctaaagcaaagtttccttctaactgctcacttgggacttttaaacgaagccattaggtgcttcactttcttgtggcatgccagagtggtagctgcttcagggcatcagcctggggccacatcaggacctacctgcacgtaggttgatcaggaccctggcagggctgtcaggtacagccacaaagcaagctgtttctgactgtgttcccacactttctcaggcatccaccctggtgtatgaatttgcttcttctttataacaaactacctctaaactgcactctagtctacagatcagctgggcaatgctgttgatctcggctgggcttgctcgtgtgtctttggtcagctagcaggttatctggggcctgattggtctaggatggcttcacttgcacatctggcacttagatgtgtgttagctggagcaatagggggcctggaccccgtgggtctccttttccagcaggccacttgggcttgttcacagggcagatgggcccagttcaaagggtctgagaacacaacggtactgcaggatgagctttggaactgctgcaccgtctcttccactgcattctgcatacgggccctaaacaagtcccaagccttctcagattcaagacatgggggatgggctgtatctcttatggagagagtcacatagcaagggtgtggctctagggaggaatgaagagtggtcaagtgcagcctgccatgctggctccttcaccagcctgtcagttatatgagccaatgggctgaatcatagtcatctttctctccacatgcctggcccgtgaaggatttgcctgcccagcagagaccgtggaatgaatgtgtgctccaggcactctgccttctctctcttctttgacttctctaagctcgttcctgcccctgtccccctctgtctctcttccccaggatcatggcattagtcggatccttcccatcattttcattttagctccagtatcacctctttgagccttccctgactacccttccagcattctctaatcccatcaccttgttttttttatcttttctttttttttgagacggagtctcactgtgttgcccaggatgaagtgcaggggcacaatctcggctcactgcaacctgtgcctcctgggttcaggtgattctctggtttcagccacccgagtagttgtgattacaggcatgtgccaccatgcctggctaatttttgtatttttagtagagacagggtttcatcatgttggtctggctggtttcgaactcctgacctcaggcaatctgcccaactcagcctctcagcctcccaaagttatacaggttttttttttttttttttttttaaatcttttcatagcatctgtaactgtttaaaatattagtttgacttccttttctagaatgtaagctttgggagagcggggtccttgcctgtcttgttctctgttacttctccagctcccagaatggtggctggcactcagggggtgctcaacacacataattgtcaagaacatgctacatcaaggcctgagtggctttgccacggctcttcttgtgactgcaggccttggtgccagcagccaccccagttccaagaaatggtctcttgctggccaacttagcaggaagaactggcagcgttcctgttacagcacttccaggtggctgcttttccctgagtccatgtggcttctccatgtctctctgttggagtcacaagttgtggaaattcacttaggccaacttagaccaagaagtggaatagttaatagttaaatgtcagtctgggcaacatagcaagacttcgtctttacaaaaaatttttaaaaatattagctggtgcggtcgtgtgcacctgtagtcctacctactcggggggctgtggtgggaggatcgcttgagctcaggagttggaagctgcagtgaactatgattgtgccactgcactccagcctggatgacagagcaagaccctttatctaaaaaacaagaaaaaattaataaataaaagttaaatataaggtctctggaggtatcctgtttgggttcagattctggctctgccacttcctagttgggtcacttttgggaagttacttaacctctttgtgcctcagtttttcacctacaaaaatagagcaaagtgtaaaaatatgaactacctcacagggttgtcaggaaaactaaattttgtgtatggaaagcactgattgctgagcagatggtgagcatctctgagtaggagctcctgctgccattattattattattattattggaggttatcatgtgtgattgaagagcaggaacttcagctgggcttcaggagcaactggttagaaaaacggaagacttggcccggcgtggtgtctcatgcctgtaatcccagcactttgggaggtcgaggcgggcagatcatctgaggttaggagttcaagaccagcctgaccaacatggtgaaaccccgactctactaaaaataaaataaaaaataaaaaaaaaattagctgggtgtggtagcggatgcctgtaatcccagcattttgggaggtcgaggtgggtggatcaactgaggtcaggagtccaagaccaggctggccaacgtggctaaaccccgtctctactaaaaacacacacacacacacacacaaaaaaaaaaaaaaaaaaaagaaaaaaaaagttagctgagtgtggtggtgggcgcctgtaatcccagctacttgggaggagactgaggcaggagaattgcttgagcctgggaggtggaggttgcagtgagccgaaatcgtgccattgcactccagcctgggcgatggagtgaaactctgtcaaaaaaaaaaaagagagaaaaaagaaaaaaagaaaaatggaagacttatcgggaatgcaggcagctgtgcgatttcagcttctctttgtttttggaccatgggttttctggttcttctttggttcctgcaggtctgactttctcctttttctgttgatggtctttcttggcctgtgtttgcaatgggtcaaccatgtgctttctggccatacttcacacttacttcccaactgggacagatagcatttcttaagtctaattccaaacttctgggataatctgattgcccttcattgagtcagaagccagtggatagggacatggaagatgctatagctgggctccacccttgcaggtgagaggagcagtttcaggaaagtctgccaggcatgagctgagaccttaagagatgtcagctagaattagccactgtcagtatatctgcttctgggtcccactcttcatcctgcttttcaaggttttcaaatatacactcctactcagtctcatgaaaattattatttttaaaataccctttagcacatttacctctaatgatactagattcttgcctcctgcctctgtaaatcactcggtcacttcccgatcttatatttggctgtcaagaatgtggaaatctcacagaacccttgaatttcaaagttggaagggaaaattgcttgtctatgcttataaaaaatacacacctacacccacgtacacatgtatttactaaaatagtattaggctaaatattcagttgtacagctttctgatttcattaacaatgtctgtctttccgtgtcagaagagatagacatttgaaaaaacggcagcgtaggattttgttctatggatgagctaaaagttctttcacctgtccacaaacttccacctagtccgtgtgccttataaaacacaaattctgaaatcccatgtaacgtgtcagctagattctgcctatcactgagtagagatgaaccatcacatctcatgttctagatttggggttacaaattcaaattcctacaggggccaggcaactgtcttagatgtgtgaaacgtcctagatataagaaatgcctgtaaatgaaaccttaagagtttttataagcatacaaataagtatgtaatattttgaaacatacttattttttggtgtacccacacaggcctagcatcaccagattcttctctctttttttttttttttgttttgccccaagagaggcaggaaatgagtatatttatgggagctttcctaattgtgaagtgttggtaagttcattatttttaaaaaactaaaaaccaacttgcaggccaaacaaaatgtgggccaccaatgtgtaatcactgatgtagataatgcacttcaattaatctaaaatcatcaactattttggcagccctctcagactgctgactcactgagcttttcatctgatgaaatccttaagtgattcacaaatacttaatctgaaaacctcttaatctaacttgtgttcctggacttgtaaattgggtttctggaccttaatacttgctcatgttaaatccattctgttacttatgtttaaggtcctacatctgtcttccagcctgatcacccatcttttcagccatgtgttgtttttgaattcaactcatttgatcctttctctatgtcctttttttttttttttttgagacggggtcttgctctgttgcccaggctggagtgtggtagcacgatcaggactcaatgcaacctcgacttcctgggcttaagcgatcctcctgcctcagcccccacaagtggttgggactacaagcacgtgccaccacacctggctaatttttttgaattttagtagagatgaggtctcactatgttgcccaggctggtcttgaactcctgagctcaagtaatcctcccagctcagtctcccaaagtgctgggattacaagcgtgaaccaccatgcccagcctctctgtgtcttatgataaaaaaaatactggatgagacaagactgaggaggaagacccagggaccctttttagcagagcttaccagcgggtgtccaaggattgaatttcccttcctagacatgttttgcttcaactaaaaagatatatatatatatatatatatatatgatgtatatcacacacatatgtgtatatcacacacatatgtatgtatatcacacacatgtgtatatcaaacacatatgtatatcacacacatatgtatgtatatcacacacatatatgtatgtatatcacacatatatgtatgtatatcacacatatatatgtatgtatatcacacacatatatgtatgtatatcacacatatatatgtatgtatatcacacatatatatgtatgtatatcacacatatatgtatgtatatcacacatatatgtgtgtatatcacacatatatgtgtgtatatcatatatatatatgcatgacccatatttaaaagtaggatatttcataacgaaataccagtattaggtatcttttgaaaaagtgtcgtaactgacagcccaagtctgcattccttcatggcaccagggctagaactgagaagtagctgactttttggggtggatatgggctcccctagtcatgctatatgcctcattttatgtgactggccgggccccataggcgtttatgtttgccactcttttagaggtccctttaaggttgacatatattcattgattgatcaactcatttacacacgcatgcagtcattttttggacccctgtctatgtgctctgcacaatgcgaggtgtgggatataatggtgaccaagacagattccaaccactcactcacagatcccacagcctaccagggaagccagatatggaacaattatatacgtaattttacttgtaagtgccacaaagacaaattgtattaagtagtaccatgtggctgtggaagtttaacttgtcactaatccaccaaactctgagaagacagcatattttccgtcattcccaaaagactatcacaggcaacattgaggaatgctttgttaaactccagggatatattccacatcacacttcccccgtccaccagattagcaactgtccaaggacaaaacaaaacacacactaaaaaggaaatggggttagtccgatatgtctccatctccttatgctggttcttttgtctgcagaagccacggtttctttttctttttgaaaaaaaaaaatgacatttgcgtacctctctgcgtttctctttctccaggattcttctgggatcctaggcagtgtggtttggtgatctcactggtgagatctcttggagccctggaatgcaattcatctgggccagaagagttgaactaatttaaggacatctgagtgcttcactgatgtatttgttctgctctgtcccttcaaaataccactactcaaaacaatgttcagctggagaaagtggttaacactggaattttctttttttctgagacctaagtgacagggaagggtggatgaaggaaacatatcctttgaaaatcctttagttagaatcctttggttgcaagtaacataaatgaactctgattaatgtaagcaaaaaagaatttgttagaaggatatggggggggagggatggacagagatgtgaaggaaaagatgaagaaccaggctttagaaagtcctgaaaccaaatgaattctagggatctaggaagcagggactaatgactgtttccttcaggacaccagagatggggtgaataactctgtaaaagatgcaaatttcccacctgggtaacatagtgagaccctgtccttaaaaaaaaacagtagccaggcacagtgcctgtagtcccagctatgtggaggctgaggcagaaggatcacttaagcccaggagctcaagactgcagtgagctatgatggcactgctgcaccccagcctgggcagcagagggagaccctgtctcttaaaaaacaaatgctaaattttagagagaatagagagaatcttttcttaaaaaggtgctaagtctggggaaggagcttctgattgtcctgccttgagtcacacgaccatctctgacttgttgacccctctacaatcccatataagactccccaagagtagattctgagcaggtaaagcccatgggtgttcccaaaagtcggcctcaacctgaagccacttattcactctgagctcatcaccaatggcatgccgcactgtcaaaactctctttctgtgcatttgtctgggccactcaactcaggaaagttagttgttctgtgtgagtccccatgttctcactgatttcatttcagtctttaagctaaaaatctgtgtaaatggtaatggagaatggctacatcacacttagtatgtgtcaaagcagtatcctaagtgccttagtggtatcagcttatttaagactgacagtactctgaggtgcagtcacttctttttttttttttcctttttttcaaaacagagtctcactccgtcatccacactggagtgcagtggcatgatctcggctcaccgcaacctccgcctcccagggtcaggtgattctcatgcctcagcctcctgagtagttgggactacaggcatgcaccaccactcctggctaatttttgcatttttagtagagatggggtttcaccacgttggccaggccggtcttgaactcctgacctcaggtgatccacccacctgggcctcccaaagtgctgtaattacaggcgtgagccaccgcacccggcctgtcacttcttgtcattcacagtagttatgttctgtaaagtcactgcaaacactgaattaataaacactgaaccattgttcctaggtgaaatacaaagttgggttcctgtgagcctttggtcacagcattttcatccactgatcaacccgtaagcttattctgtgtgtgtttctgtttaaagacaccttaatatatattgttgactcattaacatctaactcactgccaacagcactccaactcgtgcctgatcaaagcttatataacacacgcatgacacatctcggactccttgcacttaggaacaccagatagcacttcaccattaccctatgggaccattttacagcaacgtcaccctcaaaaagcagaaaaatgggaaaaagcatgctgctaatataccacagagagaatgcttgtttacagcatgagagctgaagtctgaaggtagaacatggttttgttcatcctcagctgggaacacatgttggctgactcaaatattttgccactccgtacatgtccgtgagtgatcatgaaagaaccttgagtatggatttggcggttataaataaattttagcaagaggtgaatttgcaaataatgaggattgactataacccctgttattagctctagttaacagatgggggaatggaggtaaacagctctctgcaggtcttgcagccagggagtgtagaggaggctttgtcattctgggtgcacagcctgcgtccttaagaggcaatgtagtgttggctgggtgtggtggtggttcatgctgtaatcctagcactttgggaggctggggtgggtggattacttgaggttaggagttcaagaccaggctggccaacatggtgaaaccccgtctctactaaaaatacaaaaaaatcagtggggcgtggtggcacgcgcctgtaatcccagctactcaggaggttgaggcaggagaatcacttgaacttgggacgcggaggttgcagtgagctgagagcgtgtcactgcactccagcctgggcgacagaatgagactccatctcaaaaaaaaaaagaggcagtgtagtggttgagtgcagtgtagctcctgctgagagctggttttcatgttttgtgggcacacaggaagtagagaatgctgagagctgggcactgaagcagtaggagatatgggagtgggaaagtggttttctttagtaagtctgggctgttttcatagcctaggatgaagttcagcaatactcaaccttgaggttttccaggcaccttctccttgacatgaatctcctgcaaacagatgtcatagtaatctgggaataaacctttgttgttggtcctttagctatccttttttttttttttttttttttttttttttttttttgagacggagccccactgttgccaggagtgcagaagcatgatctcagctcactgcaacctccgcctccccagttcaagtgattctccagcctaggcctcccgagtagctgggattacaggcatgcaccaccatgcctggctaagttttgtatttttagtagagacggggtttcaccatgttggctaggctggtctcgagctcctgacctcaagtgatccgcccgcctcgacctttcaaagtgttgggattataggcgtgagccactgagcccggtgccctggtcctttagctttctaagacagcagcatagtagttcagagcataggctcttgggccatagcttcctgagttcgaatcctagctctgctgttttttaaactctgtgaccttgggcaagtcttaacctctctgtgcctcagttttcttgtctgcaaaatgggattaataaaaacaccgatctcataggattgttgtgaaaatcgagtgagtatgtttatagtgtttaggaaagttcctggtacacaagacatgctctgaaagtgtattaatattatttgtccttagactcagtagtactctgggggaatcgaatccccacccctaagccaggcagcatggtagaagctaggtcagctggcaggctcctgggtcttttccattctgctgcaggagatgcctgactcacctcttgtgctcacacagatgacagctaaatagaagggctctttcctcctagtattagcttaattataggggctccctagaacagtggggaaaatgagctttgagaatccccccaccacacacacaaggcccacactagcacctgaaagaggagtgaacattgcttcctgcctccttctccccctccttctcacatatgcctttgtctctgtgattctgcacgtttaatttttaatcccgggatgggttctattagtttttgtgtattttctctgccctggtttgagctccaaaaggtctgtttgggtctctgtgggtgtctgacagcctctgcaggcctttctgaattatataactcaagctttgtattttctatttgttactgggggttctttctgtgctataattttactcttagaaaatgaagtagggtactagaattttctctgggatcccctagggtttccttctgaatattttttcctgccatattttcttcgctaaaacatttttttttcttatttcagaagcaatacatcttcattatagaacattacaacaagatgcagagaaagaaaataatcttatcaagcagaaatgttaataccttgctatctacccatgtctctctgtctctgtctcctcaaacacacacaaatggggtcaagatgacataagagactatctgcttttcaattcacattttacgatctttttttttgtatggttctgtagtctccactgcttggcttgacgatctttaacaggtgccctccggatggtcatgggggtattttccatttctcactgttacaagcagtgctctgatgaaacaccttttgctggcattcctaattatgtcctgagagcagacttctagaagttttcagcagtgaggttaaagggaatgtttgcctctcctcttcactctgtgatgctcctgggggcccaggcccatgagtctctgtgtccatcttcccaagatgaaagacaaagaatgggcagagcattgacagggccctgtgttgactccttttctctcttttcccagtttttttttttttttttgagacagagtctcgctctgttgcccaggctgaagtgcggtggcgcggtcttggttcactgctacatttgcctcccaggttcaagcaattctcccgcctcagcctcccaagtagttgggattacaggcactcaccaccacacccagctaattttgtatttttaggagagacggggtttcatcatgttgcccaggctggtcttgaactcctagcctcaagtgatccactcaccttggcctcccaaagtgctgggattacaggcgtgagccactgcaccctggcccattcccgttttttaaaaaaatattttattccttttagactatttagccacagttttccattctattccttgggataagtgaaaacttgatttttaaaaaataattacaaaattttaaaatcatggtaaaaaacacataacataaaatttaccatcttaactatttttttaagtgtacagtatcattttaagtacatttacattgttgtgcaacagttaggacttttcatctcgtaaaactgaaactctatacccactggcaataacttcccatttcttcctccccaccgagcctctggtaaccaccattctgcttcctgtttctatgagtttggctattttagatgcctcatgtaagtggactcttgcagtatttgtcttttcatggctggtttcttcctttttttcttttcctttctttctttctttctttctttctttctttctttctttctttctttctttctttcttccttccttccttccttccttccttccttccttcttcctttcctttctttctttcctttttttttttttttgacagggtctccctgtttctcgcaggccaggctggagtgcagtggggcaatcacagctcatggcagccttgacctcctgtgctcaagggatcctcccatctcagcctcctgagtaactgggacttcaggcacacactaccatgcccggttaatttttttcttgatttttaatagagacaaggtcttgctatgttgcccagggttgtctcaaactcctggcctcaagagatcctcccatctcagcctcctgagtagctgggattacaggtgcacactaccatgcccagttaattttttttcttgatttttaatagagacaaggttcttgctatgttgcccaggctggtctcaaactcctggcctcaagtgatcctcccacctcagcctctcaaggtgaagggatgagcctcccaaagtgaaggcgtgagccattgctcctgggatgactggtttatttcacttagtgtaatgccctcagagttcattcatgttgtagcatatgtcagaattttcttcctctttaaggttgattaatattccattgtatgaataggcaacattttgcttatatattaatcggtcaatggacatttgagttgctttcacctcttggctattgtgaataatgctgttgtgaacatgggtatacaaatatcttttttttttttttttttgtagagatggggtctccctatgttggccaggcttgtctcaaactccttggcccaagcaatcctcctacctcagcctcccaaagtgctgagattacaggtgtgaactactgcacctggctgagactccacttccaattcttttggatatagatcctgaagtggaattgctgatggtagaaactgtctcgggaagatttttctggggatttggcttctaactgcaccacagctccagtggaaacatctattcattaaactggcatttattgaggaccagctttgttccagtcactgaacaaggctgggggcatagcgtggcttacataggtccccaccctccatggagctgatattcagcaagaagccagacaatacacaggtaagcaaattgaaaaaaacaggatgagatccactggcgataaatgtcatgatactgaatcaggatttgacaacagagtgatgtggtgagtggctactttagatcagaaaggccttcctaactgggtgacaggtgacctgagaactacaaggtggggaggagctagccacacagaatttgggaaaataccattctgggccctgggatgagcaatggaaaggtcttgaggaggaaagtggctaggcgtgatccttgttgctggggcgtggtgggtgtggggccagatcataaggggccccacaggatgagcctctgtgctaagtgcagtgggaagccactggagagttttaggtaggcgagatgcaaaggatcagatttgtatttaacacaccttccattggctgccaagtagagaatggattgttggggactggagcagaagtgggaggatgagtcaggagtcaattgcagatttctaggtgagagatggtgtctttgtctgcacgggcagcagtgcagagggagagacacaggcagatttgggaggtaaaaggacttactggtaaatgggatatgaattggaagagggaagcaaatgcacagctgggcacctggtacactttacatatgacgtctttgaacttcgtagcaatcccataaccacattttgtagatctgtgttgtccagtagaaatataacatgagccataaacctgagctgtgtatgtaatttaaaatgttcttagcaatcacattaaaatggtcaaaggaaacaggtgaaatgaactgtgagaatgttttctttaactcagcatattccaaatattcccatatcaacatgtaatcaatataaaattattaatgagatattttacttccccgcatagcaagtcttcaacatttgatatgtattttacacgtacagcacatctcaattcaaccacacttcaagtactcagtagccacatatggctagtggttaccatattggtagcacagttatagatgaggaaagagagtctcagagagtataagttcttatgcaagcttatagaattaggacttgaaccctaatttgactctggcacccgtgttgtgctcaaagcactgcatccacccccaatgatgaagacattttcaatgtaagcaaaagtcctggagatttccccacatcatatacatggggacataggaactaacatttgtcatatatttatattttcctttccaaagcagatcaaccccaagttaccttcccttagctctcgttttctgcctctctttgcaaatatcacttcattaaaaattgtgaacattctctttgccttcccttatgggcttcctgtttgaacaccacatccagggcaccctgggaactgaaccatctccttttctttttctttttgagtcagggtttcactctgtcgcctagactggaatgcagtggtgtgaccgtagctcactgcagcttcaatctcttggcctaaaacaatcctcccacctcagcctcctaagtagctgggactacaggaacacaccaccatgcctggctaatttttttatttttattttttgtagctgcaaggtctcactgtgttgcccagactggtctcaaactcctggactcaagcagtcctcccacctcagcctcccaaagtgctaggatgacaggtgtgagccacaatgcctagcccatatctccttttcttttgtggcattctagtagccctttggttcatgcgatcatttagttgttcagcaaatatggatgattgaatggatataataggtgcagggcactcccaggttctcaagatggatgatcttgggcaagttatttaatttctctggattttagtttccttgccagcaaactcaagataatagtaatgcctacttttaagtagttattgtgaagattataaggaattaacaataacgataataataagtaataatgatacatgttgtttattagagcctgctatatgccagacactaactctatgatttaaccttctcctgctaccctttactcttattatttctttaggagtgaaattcactaatcattaagctttttaactaactgaatcaattctgtttcttaagcagatgggagatcctgtggctttttaccactatccacagctctttttttctttttcttttcttttttgagacggagtcttgctctgtcacccaggctggagtgcagtggcatgatctcggctcactgcagtctccgcctccctagttcaagccattctcctgcctcagcctcccgagtagctgaggttataggcgcccgccaccacgcccagctaatttttgtatttttagtagagatggggtttcaccatcttggccaggctggtctcaaactcctgacctagtgatctacctgccttggcctcccaaagtgctgggattacaggcatgagccactgtgcctggcctatccacagctggtttcccctctttgcccccttttctggcattctcttctgattcactctcaactctgatttccaagctacccagctccttcccctagtgtgaatctgtatttgcactggatttatttttaaatgggaaatgaaagccactgtgtgctggaaaatatatatttcagacacgaggaagctggcggggaaatattttttggatgtctttctagatctcttaaaaatcctgtgagccatcaccaggttgatcttgtagtaaggtggccttggccttagtgtatttctttttgactcgatattgggcggcaggaggtttgaggattgtgatactaacaacattaacaacaacaaactttcattgattgattgccatgtgctggaaatgtgctaataaattacatttattttctctttgaatcctcaaaccaactctttgagacaagtgtgttgtattacagctgtagaaactgaggtcctaagaggtcagtagatttgctgaaggtcacagagctgagatccaaatctaagcatcacagcaagaagtatccttaaccatcatctttgctgttggttggcattagtctggctgtgctaagaaagtttcctttgacttgcagatggatcaaggcttttcttgagagaggcttctcttgcctggttctccttgattcttttactctaggagactcagttcttctcaaatccctgtctgtgggactttgggcaaaacattcaacgtcatctttacctcttagagtcactgcgagggttggactatggtgtgttaggtgttttttttttttttttttttttttttgatgaagtctcactctgtcgcccaggctggagtgcaatggcatgatcttggctcactgcaacctccgcctcctgggttcaaccgattcttctgcctcagcctcctgagtagctgggattacaggcacgcaccaccacgcctgactaatttttgtatttttagtagagacgaggtttcactatgttggccaggctggtctcgaactcctgacctcaagtgatcggcctgccttggcctcccgaagtgctgggattacaggcgtgagccaccgtgcccagccgtgttatgagttgaacagatttcttggcttcagcaggggctcagtatgggcctatcatcattttcatttatctccttttatgcctcatgctctatctgtccccttcatctctgcctgtagcagccacagaccctctctttccttggtgcatgtccctccttcccactttcctaatttcagcctgacttagttctctacctgtcagcttggacttaaggaaaggaagttctcttttcttggggggtcactggggccatgggcgtctttccactccatttcttttccaaagctgcctctggaacgaatctgtaaatcccagggcattgcatgagttttcttttctttctttccttctttctttctctctctttctttccttcttgctttcttgctttctttcttgctttcttgctttctgtcactgaaagcaaatattgtagacagatatgcttgtaggatagaaataaaatgccccattctttgaaacatattttgttttttattttagattcatggagtatgtgtgcaagtttgtcacatgggtatattgcgtgatgctgaggtttaggcaatgaacttgttacccaaatagtgagcatagtacccagtaggtagtttttaaaccgttacccccttctctccctcctttccgagttcccagtgtctgttgtttccatatttgtgtctgtgtataccccttgtttagcttccactataggtgagaacatgtggtatttggttttctgtttttctgtgataattcacttaggataatggccttcagctgcatccatgttgctgcaaaggacatgatttcattttttttatggctgtgtagtattccatagtgtatatgcaccacattttctttatccaatccattgttgatgggcacctaggtggattccatgtttttgctgttatggacagtgatgcaataaacatgagagtgaaggtgtctttttggtggaatgatgtgttttcctttgggtatatacccagtaatgggaatgctggattgaatggcaattctatttttagttctttgagaagtctctaaactgcttcccagaggggctgaactaatttacaatttcaccaacagtgtaagagcgtccttttttctccgtaatctcaccaaggcactgcataagctatctgagtggccagcaggcagaatgcttgaaggattctccagctgggggtgctgggcccaaaggctggcagctgtatggtcctggcctttttctctccagcagggtccccatgatcttcccaggtctagttttttcttgagcacacctgcatctgacagttaattgcaagaatctgacttgctgaactctcatttctccctcctcctttagcgcatcaagtccccttctttgttttcccagcttggttcttgcaaggactacctagaggaggacttcaggcaatccctttctccctggtgggctgctgtgttctcaccaataaatcaatgctctctctagtttcaggctgcctcttaggacagatgctgataccaagtgacttttgaggttgttgagttgagacacttggaccaaacagcggaaggcacagcttggctcagctaaaggaagctccgtgaaagctctctgagtgggcctattggctccatgagttggcaggctggccctcctctaggagatggtgggtcctcatgggctgtagcagggccaggccacaggagcagactgctggaggagaacatttagggccatcttccttgctgcctttctgtgatctcttcacccaggaagctgaatgctgttggcaagcaaaagggtgcttggtaaccatttcttttttaagtgtgtgctggtgccagggagggagaaatcctcaaaacccattgtgtctgactcaggcaccactggtttggccataaccgctagtttatcctccctccctctgccaccctcgtcatgtttctcgaccacaacctgtctggaccttccctgggttggccagggcttgataatctttttctgtaaggagttatcccttcctcatctgccaggatggggctactgtgcagggactgggtaacaggcttgaagttgcaagagggctggaagggtctcactagcaagcacacattatgtcttatataggtccctggccttgtgcttcagaccctatcacagcttttccacagctggggctgttgagaatgtaagtggtgacatagctggatggctaagatggggggagtatgagacctgcaagcgtgtgagtctccttttgctagcagagtgtgaatgaaatgtatttattttcccaataaattcgacatgactgatcattcatccacccacttacccacccatctactcactaacccacccactcagtcatctacacagctgttcactcgtccatccatccatccatccatccatccatccatccatccatccatccatccatccgtccatccacattcaatgtagtgtaatgattaagagcatagagtttggagttatcctgcttaggtttgaatcccagctctgccactcaccaagcatgtgatcttggttcagttttaaaacctctccttgtctcagtctcctcagctataaaatgagattgatgttgaaattaataacagagcctaccttacggcattataaaggttatgtgagtcagtatgtgtaaggtgctttcagtagtgcctgggtcatagcagtgctatctaagtgttagctattagcattatggcatctactcacctgtttatcatctataatagtcattaaaggtcttcaataaatatttctggtctttggccttgcaggccaatggtaggattgcactgcttgcctcccttgtgggtaggtggggccgtatgagtagctctgaccagtgagttgtgatccaaagtgatgtatgttcacttttatgctgggacatgtaattgctggttctagattatccagaaaaaatctttgagttatggctgctctatcaacttgctcctggagacatagaacttcttccttagctgatcaggcatgaggctgtagtatgtgagaaaaacaaacttttacctattttgagggttattactgcaggataacccagttctatctctgtctctctcatctatcatctatctatttacaataattccagtctcattttatttcccttcccttttctttttggcacctattactagctggcattttcttatattttttggagtttcctcccaaaatttatttgttattaattataagaatatgttttccatgagaaaaaggacttattcacttatctaattccaatagttagaatggtactttacacatagtagacactcagcacatatttttaaaacaataaatcagttaatgaatggatctacttgacttttagtaggtcctattgaacactgcattccacagctccttgaaaatccttactgaggcagctaatatttaagaaggaacaccctgacctttcactgtccagttttattgcctgaatcaagaaaaatatccctgagatagacctcactgcctctctgcaaacctcttaatacccttagtcaattgtaagaagctgcttggaaccctgtaagatggtctttggccagatcaagtcttgctcctcttcctctgaatcttgtaggggcctttaatctttctgtaactgtgattccccagaacaggatgcctttgttagcctagcatcttttctgttacttctatgaaacaaggagagacgctccctgggacccttaactatttctggaagcaaaatgacccttgccccactgaagacttaggagcctggtcacttccaaccgggcttttcatctttgtgactcccagtcatgggcaagaggctagctagctccaatcctaatgcccgtgccatcaactgcttcatttctggtttcttccttgcttttgtgataccctcattgactctttccactgtaccctgtggacttgcctctatgggacacttcctccccatcctgcctgaagaggaaagagcctgcctttcttctgggaacatcatcccattcagaaacaacaacctttctggagtcaggagtttgctttcctcttgttctttattgctgcttcctggagattgcattcttgtttaaaagctcacctgtaagactctgatcaaatgtccattcttccctctcacttcatccctgaagatgaatgggacatttatctttatatatgtatgtatgcctaggggaaaaaactgaaggaacattatgtatatatataatgcgtgtgtgtgtgtgtgtgtgtatatatataatgtgtgtgtatatatatatataattttttttgagacagggtcttgctagactggagtgcagtggagtgatcatggctcactgcagcctcgacctcctgggcttaagtgagcctcccaactcagcctccctagtagctaggactacaggcatgtgccaccatacccagctaattttaaaatttgtatttattattatttttggtagagatggggtctcactatgctgcctgcgctgttcttgaactcctgggctcaagcaatcctcctgtctcagcctcccaaagtgctggaaatacaggcatgagacactgcatccagtctatgatattcttatgtttttacaatgtgcttattattgagtagggaaattatgagtgatgtgtgtgtatgtatgtgtgtgtatacagatgtatgcatctgtgttcaatttttcctgttgagagtgagtaaacaaatatttttgaaaataataaaatacataaatgaggggcaggggctctcttggacacttccaaaagtactttgctcaattttctatgttaggcctatctgcaagaagcataagggtttgtcaggagctattatgattatttattctacaaatcccagttcaacaaagaagggtgaggcttgagtgttcaattagagaagctggccagttgtggtatcatatcagctctacatccaatgctcagttttcaaggggtcatgttgctctgaaaggcctggtgaggttgatgagtgtcttaatgaagccacttgtgaaagataatgtgacatgtttgtccatcacattgacgcaggaaaggagctttcacaaaagacagcacagaaattttgcaggctcggaccagaagggaatttgtcagtgtttagcttggctgacatcccacaccctaccttcttgtgcagttagaatcccttctagtgtaatgtgtgaaaaaccataggccccctgcccacaccctcctagagctgtatcaccaacagctttcaagtgtgtgcaaattgggagacggctggatcccacatctctgggtgacatttgctgaaacaaatgcctgttaataagtggcacgattcccttggtctcagtgataaagatgtacctgttactgggagcccttgagagaaatctttggtgaaggccttcacactcattttaattggtgatagacagatgtgttgagaaaacttacattttttttctccatccgtctcaattagaatgttatgaaatagcaccccctttgctcttcgtgctttatgccctagactttaaagactgacaacgagtggttaaaaaatctccattgcttcaggatgcagtatcagctgatttggtggattaaatcgttttaaggtcctgagctttaattcttacttcagtgattctcaaaccttgttttgcaaaaccccagagctttaatcttaagggatgagcctgctatttccaagacaacaaaattatttctacttcatattaatacaaaacattaaaatatacattgtctttgtaatatagtttattaattcaaagcacttgcattcccatttatctggtcttcatacaaaaccatgtatgagtgagtaggcagatggtcttatttattacttcgttcaatatatagatttttgagtgcctaccggtatacagcactgaacgaaagagaaaaatactagtttggatgggagctcaacacaatctgaggggatatattggacccattttgcagaggaagaaactttggttcaggaagggaaagtgaactctgaagtttgacataaagttagcttcagaactagaatatctgccttctgatctcagcctatcacctatctcaggttctgtctccacgataccatgtgattggaactggctcattaacctggggatggatcaatcagcatcttttttttttttttaacaggattggatggaaatctgcattccttgatcactcagtctatagggtgaacttacaatggccctcatgcttaatcttgaaatacagggatggtctgatggagtgtgctggagaccctgctgagatctttggacaactcctctccagtccactacctgaatcctttctcttctcctcaaaaaaatctgagactatccaaatgaagagtaaataaagggagaagtaagaaggaaacatgagacagagaggcagcaggagcagaatgaaacttggggagcagagggagaagccaagaaaacttactggacttggagccaataaattggccatggcatgaaggtttctgccagcaatatggcagcccattccagctctttccattttcttttcccagctgtgctgccaagcaccatgcttaggctggtttaacagagattatgctaggaggattttctaacattcatgtcctgattaccccttatctgattccttagcagtagccttcagtggcctcagagaattccaggttcagctgtctgaacagttcaatgactgtttgtaagttctgacttacgatcaaggcaggaaatgtgaaaagcatttttaaaaaggaaaaaaaccatccggcgttgttaacatttttgttattccagtattttcccatgcatataaatatgtgtacttcttttatttttcacaagagtactctcacaccataatattgttttataaccctcttttccactgtgctctagtgtaaacattttactgtaccaaatctttttccacaaaaggatttttaattactgcatagatttctattgaacggatgtactaaaatttacctaaacagctcttattattcaacatgattcaaccattgttacaaataatatagttgtatatttatctttatggaaagctatttctgaatactcctaaggataagttcatgtattagttaggttttgctgtgtaacaaatcatcgcacaacttagtggtgtcaaacaatgactatttacttacctctgcaggtctgcattttgggccaggtagttctgctggactaggctggaatcagtggacataggctctggttacttatgcatttgcaatcagctgggggactgcatgggatgatggtggtatgtcatcttccagcaggccaggttgtttccatagcagttagagttgcaagagcagcaaggaggcaaaccctgatgcacaaactttttttcaagttttggttgcatcacatttgcttctgtcccataggccaaagcatgtgacatggccaagcccggagacagtttgagaagacattaccaaaggcatggctacaaaaggcatgaaagtctcaggaccattgttgtaatcaactcatcacagtccccaaaatgggagtttctgggtcaaaaagtgtggccatttaaaggttttcattgtcacattgctctccagagaaattgtaactaatttacacaccacctagagtacatgcatttccaaattcacttgatcactggatataatcattggtttaatttccccccagaaaataatattattgcttttgaagagtacatgctttgtgagggaagctgtcttgaatgtccagcttccaggtgcaagcgcctgcatgtgtgcacaggtgacaccatgtagaaccgaagaaccacctggctgagtctagccaacccagagaattgtgagggaaaagaatatttttttaaggcagaagaaaaatgtatgttcattgtaaaaacctgaagcaatgtggtacctttatcatcaatatcttccccagtatttgattcattctgacattatgttgttgggttacatttatttctattacatttaggacctttgagtctatattcattagtgaaatttgtctgccatttactctttttttttggtttgctgtctttgacaagtttttgctattttcatcaaaacatctgggaagtcttccatcttttcttgttttttaatgcttaggaagagcataaatggcaaaggatttagaatattttttagaagtttgagtggatttaccatacccccaaagcaaaacaatttctgggcctggtgccttttccaagattagttatttgataattttttctggtgtatttcatgatcatttttggtatactttcaaatgtgttatgtttttttaagaataagcatttaattgagtctctaatttattagcataaaactatatatattgtcctgtaatgatgtgaaaaattgccttgccatctgcaattctcttttctcattcttactgagttcctatttttagtttttgaaaattttcttatgagctttgccagagtgtcactgttttatttttcccctcaaacaaccacctcttaaatttattcttcagttcaacttttttctgtttccagatgcattaatttctgctttttaattatttcctcagttttatcactcttcctagtttcttgagctaaatgtccctatgtactttcaattatatctactgatttgtcaaaaattggatagtatgctcgtctcctactatgatagtgatttttcaacacctttgtatttttttaaacaaattttgttttgtacatttctaatgtacttttatgttataggagttagagtttcatgattctccagtcttattgtgaagttactcagatctgagttcaaattctcctgtgctgcctaccaaatgatgaaccagttttagattctcctaaaagcttggtgataataatgccagtgttgcttatttttaatacttaaattaaatgatataattgatgttaagtgctcatcatagtgccaggcacatggaacacacactgctattggttatattgttattattgatgtactctttatgaatacaaaatatccatctttgtcctatgtaatatttttatgctttacattttatttgtctgataattaatatttctgctcatggcagcttttcccaccttttcattttcattttggatcattttattttcagcaagtctcatgggaaccatgtatatttgaattctattttttctttaaattatgaatctttgtcctttaatgggataattcaatccattcacattttttttttttgcaagacacagcatttggcaagtgtttacttctttcttctcccaatccactttcctgcctttgaagattttagaaccagaatttatgaaaaaaaataaatatatttgatttcccatgaattgctattgacacatgcattatttcatgcaattcaagacttttttaaagatgtgactctcaaacttacttcattactcactttttatgttttttggacccatttccctcttattgaattaattgattgattcattaattcaatcaacaaatatttattgaaaacatactgtatgcagacactgtgctagggtctgagagaaacgtatttgatgtaaacctggtctgtgtcttcactgaatctacatttagattcacaaaattagagacacaaaaatagatgacaaattaaagcagatataaaggaaaccaataagggtctcaaggagagattagtgaacgtgcatgtgagtatctatttagcaagtttaatgaggggatgctttttgtgaaggtgacatttatgctggcagcttaagaagtggcattagctgtgtgaagagaggaaggaagaaaggcattccaggcagaaggactagcatatgcaaagggcttgaaaggggaaagagccttatcctaatgttttcatagaaattatttttaaatactcaacaattagcttttgaattaaaggaatgcacacaagtgaagttaatctcttataggcaaaaccaaatgaaggattggaaaatgcctctgaagagtcagctggaaggctcttcatccatccatccaaccatccatccatccatccatccatccatccatccatccatccactcatccatccattcatccatccatccacccacccatctacccacccatccatccatccattcacccacccactcatccatctatccattcatccatccatccaataagcagtcattgagtgcctactgtgtgccagaccctgtgccaggtgttgatcacaaataatacaagcacctcctggagagtagagcctagttgtgtacatgggatggagggcccatgataataaagctggtacttctcatggagtgggatgggccaggggcatggggaaggcacacgtgctgtgctctgtagagctctgagcagggagggacgcagtgggaaagagctgagaacaattcctgccagatggctttattctttcccctgaaggaagtggggacttcgtgctgtgacatgatacacaagaacagtgtttcctgtgggtttgcaagggcattttgaatataaacactacagctcgctgatgtgtgaaaaaattattttttttgctttttcagactttgtgaagggataatcagatcaattttataagtctggaaaacaggtatttggggtgaattttaatgcacacattatagtggctggaaccctaaccaaaggcagctgtcacctgttggtgggttctcttaggcacgttgtttgttcatctagctgtcacctggcagcttatgccctccagttcctggaactgaccagttatctgcaactgactaagttctggtactggatcctgtgtgatttgactctaacctccaagaaccttactgtctttagctgtgaaatgcggagaagactggactacttgatctctcaacactctatatatctttaaagttaaatcatttgttcagtcatttgccctttcttctgccatttctctttccctctctcccatccatccatccatccacccatccacccacccatccatatatctatttaatatttatattatttatgttatttatttatttatttattttgcaatggagtcttgctctgttgtccaggctggagtgcaatggcgtgatctcggctcactgcaacctccgcctcccaggctcaagcgattcttctgcctcagcttcctgagtagctgggattacaggcacatgcaccaccatgcccggctaattttttttttttttttgagacagagtcttgctctgtcgcccaggccagagtgcagtggtgcgatctcggttcactgcaagctccgcctcccaggttcacgccattctcctgcctcagcctcccgagtagctggaactacaggcgcccaccaccacacctcgctaattttttgtatttttagtagagacagggtttcaccttgttagccaggatggtcttgatctcctgacctccagtgatccgcccatctcggcctcccaaagtgctgggattataggcgtgagccaccgcactggaccctgtctaatatttaattgagtgcctgttgtgtgctaagtactgtgctgggttctcatccagtggccagtaaattagacaatcctcccatcatagagcttgccatctagtagggagacagacaagcaaataattacacaggtaataatacaattacagttatgataagtattacaaatgagaagaatggggtaggtgagcatgtgtattaaggctatcggtctcattttgagggccagagaactctttcttgacaaaatgaagtttaaacaaaaactaggtgaagattggcagaaaagcatcccaggcagagggcacagccagtgtgaaggccttgggataggaaggggcatggccacatcaagggaggtaaaaatacataacaaaataataatatgagtaacaatggcaactactactgaaggaggaccgcctatttgccagggaccatgcgatccttaactgtgtggttttgatcaaatcatctaaactccttgcaccttggtctatgcatctataaaatggggtgatagtgatcgtgtatacttcatcaggttcttctgaggcgccaatgaagtaacgtctgggaaatccttaggtctatgcctggaccataggaagtgtttaagagacagccgttgtgactgttatttttatgaatggtattgggtgagaaaaagttcgtgttgcatctcagggcttgccttggaccctgttgatgatttctatgttgaggtcactcttggagtttctgcagaagtagaactcttggaagtctgctattcagcagatgagtgaaacaagtgcttctccctccgctcccacagaaagaggggcagagatgccagccacagcttggctttcaggcagcaggcacattgggatcagtgattggcatttgcaacattggttggcatcacagagagcatggaaggtcaaggtaataattatcaaggacagtttaagggaaacagtacattccattccttatccattgtaagaccagtacattccctgttctttaactcttgggaagacatctcccccagatctctctgctgaggatcagggccatttctctgttaaaaatgtcaaacagcaacttaccagaggaaacagaatggtggaaatgccatctcagcattcaagaagccccagtaccaaactttgcatgtatatacgtttgaaacaagctttgtaaattacttttgttcatttgtaattacttatccataagaactctctctctctctctctctctctctctctctctctctctctgtgtgtgtgtgtgtgtgtgtgtggtttgttgtcacctgggctggagtgcagtgatgcgaccatggctcactatattcaaaatcctgggctcatgcgatcctcccacctcagccttctgaggagctgggaccgtaggcacgtgccaccaggcccagcaaataaaatttatttatttatttatttatttatttatttatttatttatttatttatttatttattgtagagatagggccttgctatgttgctcaggctggtctcgaactcctggcctcaagtgatcctcctgtctcagcctcccaaagtgcagggattacagttaggtatggagagagaaggaaataaggaagacacagttattactctttaggacccataatttaactcaagtgattttgcccccaggtggtatttggcaatgtctggagacattttgtttgtcacaacttggggtggtgggggttgctactggaatctagtgggtagaggccagggatgctactgaacaaaatatacaagacagcctcacaacaaagaattgaccagtccacagtgtccacagtgccatggttgagaaaccttgatctaactgcttatgacataccacttccataaagccgagagatatcaattcttatgcagttatcactgtgtacaggaaattgtgtgtttgtacatgtgtgtgcatgaatgtgtagatataaagggataaaacctttatcttcctttcctaggtatttttacctctgtattatcaattgaaataatttgtttttgaatatacaatgcaaagtttgaaatcctacaggtacaacaaggtatacagtgaataaagaatctccccattccacttctgtcctcaagtcttcagttctctggaggagtactactgtcattagtctcctatatattagtagagagacattccgcatatgaaccttatacccttagtagcacctcacacatatttttttccttgttgcctttttttttcctatgtgatgacgtatcttagagatattttcatatcagcgcatatagagcagcctcattcattttaacagctgcacaggttttttttttttttttttttttttttttttttgtggctgtcccatacggtcttctgttgatgggcataggttatttctagtcttttgcataacaaacagtgctggagtggatctccttgtacctaactgtggacacacatgtgcaagtacgtctgtaatccaaaatcctgcaagaggaatttctaggttaagatggcatgtgcattttaaatttggctagagatttctgcagtgatgtctgatcctgtgcaccgtgcattcatcatgtgacccatttctagtccttcttgaccgccccctctcctatggggatcctgagctgatagggtcacttctgtctctcccccacactggaacagctctctctaatctacaagattaattttttttcctaatcaaaacacaattgccaaggatagtttgaaaaatattaattgtgtctgtcatcctggggctctgagcacgtgagcgtttgggatataatctttgcaaattgcctatagttcatacagcacagcaagagcctctctctctgcagccagtcctttatgatcgatcatacccaccccctctcccaatgggctgtatcctaagggtaagtagacagcatgggttctcttgcttaaaaaaaatcgttaactcaacgggggcgcctgctgcttgattgggagtatgtcggcatttagagcctgctggctgcaatctcactacgcagactggaagttgtggggtgtttttatcagcaggaaacagctttgagagcggaaggggagtgagagtagatggatagatgagggaattcgaagaggaggaagccgtgggagaaatgtcttcttttaaagacagacaaggcagatttctccagcccatctctctggaatgtcaagtaggaatgaaatgggaagttgggttaattctaccaggcctgcccagcaaccagcctgttcaggttccccaggagttgcagcctgttgtctgagactgtgaggttctcttccctgaagtgtcttgtgggaattggctggtggcagcattttctctgaggtcccaaaaattcgagtggtcaagaagacaccctgcaatgatcattccccaacattggaggccataaaagtcagtctgggtttgcaaatacacactggaagtctcagagctggtgcagacatctcagagctggtgcagacagacactgtggctgagtgtgtgtgccttgttcgttatggtttcactgctactggattggtacctggtacacagtaggcactgaaaaaatattcactgaaagaaagagaaaacttgatggcagttgtaggtctgggtctgttggaatttttacccccaggaagagatttgattttaactcaaagccagttgataaacagcctcacccagcagacagagggcagcttgggggaaactggagggtatgtagggtggggtggggctcttatctgtatggacaatgccatatattttctgaaacttggatttttctccttataagggagaagatccaagaagacaatgaaaaaacatttgcccctgcctttagaaaaaataaccttttaatttttggaataatttcagatttttagaaaagttgcaaaacatttacagagagttccactgcatacccctcacccaaagtttccccctaatgctaacatcttatgcaactgtgatgcctttgcccctaccattttgaggttaacaattaagttagtataatacttattctgtaccgagctctattctatatcattttcctgcagttgtttatttgaccctttcagcatcctttgaggaataagcactgttatagcagtccccattttacagacggggaagctgaggctcagctagactctagctagtgttcgaaacctaagttgtctggctccagtctctcacccctcaccattattatctgcacagtaatgatggtaactgtcatctcttgatgataatgcgttcaggaactgagctcaaaagtttttccctccctcccttcctcccttccttccttccttccttccttccttccttccttccttccttccttcctccctccctccctcccttccttccttccttcctttttttgagatagggtctcactctgtcacccagtctggagtgcagtgtcacgatcgtagttcactgtaaccttgaactactgggctcaagccatcctcccacctcaacttcttgagtagctttgactacaggcataagccatcatgtctacctaatttttagttttttcttttctttttttttttttttcctttttctgtagagacaaagtcttgctatgttgcatggctggtctcaaactcctggcctcaggagccctcctgcttcagcctccccaagttctgggattacaggtgtgagctgccacgcccagcctacttatgttatttctaaaccctcccctgactcagagctgtggtaaagagccccgcttttgttgtcctgctcaggacaaaaatacatggccccaggcttttgtgagtaggatccggaagggaacttaagtgtgtgtgtgtgtgtgtgtgtgtgtgcacccacgtgtgtgtgggggagtgatagagattctcctggtttctgtcctagttttttctaagcgtatggagacaggtctgctccgtacatctggggattggtattaccacatcatttcccccctaacagcagcaaagattctcaaagcttcatcagagcatgaacaatcagaaatgccttaattttgttagtcacaataaataatactttgattaattagcaagcacatgccttgggaatatgagaaagtaaatgatttctaccctagatctttcagatagctgggagggaagagagtattaaaatacgcttttaactatgggttttggatggagaagaggagaatgccggagaggggaaagcagcagtggaattgttcttggagataggagaaactgaaactctttccacccagggtctttgcagaaagtggttcccactgcctggaatactttttcttctctttacatggtgagctctcactctagtctcaacttaaatgtctccccctttgacaggcccttgctaacatcctgtttcaagttccttctggatattgattaggatggtaagcttcatgaggttaaggatctctgtttcatccactgctccatcctctggtgtctgcaacgacgctggcacaccataggcccttattaaatatgtgtcgactaaatgaatatgtggtcttattaaatatgtgtcgactaaatgaatatgtggtctatttcaagtcctcgtttgtgtctgccctagaacttagcactgtttgccattagcttgtctatttccttgtgaatagctagattccctcatgagctataagggccacgatggcagggggtgtgtctaccttgttcaccaagggtacccaggatgaacctggcctgcagctaagggggtgggctctagggtcagattacttgggctcaaatcccagatttcctatgttccagctgtgtgatttctgctaattgtcaagccactctgtgcctcattttccacataggtgcaagaggggtgataatagcatctatctcttggggttgttgaaagaattaaatatgtcagtattggctaaaacacttagaggaagctgggcgtggtggctcatgtctgtaatcccagcactttgggaggctgaggcaggtggattgcttgaggccaggagttcaagaccagcctggccaacatggcgaaaccccatctctactaaaaatacaaaaattagccagacatggttgtgggtgcctgtgatttcagctacttgggaggctgaggcagaagaatcgcttgaacccgggaagtgaaggttgcagtgagctgagatcgcactactgcactccagcctgggtgacagagcgagtcttcatctcaaaagaacaacaacaacaacaacaaaaaaccacaacacttagaagagtatctagcatatagtaagtgcttcagtgctttatacatgtcagttattggtagtactcaaaatatttgggatttaaaagttgggggatttttacataaaaggcacttttcctctttgagtggtaaaatctcccctaagaaagaggcaaggacagatggagatgatctgagaggcccaagagatccttaaaaccaggctttttaagaaatctgatgttttatttctccgtattgtcatggaaaaggccagcttttagcatgcctggtgtttctggtgttttcttctcttcactgttttctacatttctttctttgcattggtcctttttttttcttttttttttttttaataaaaaaaaaatagcacagctcggagtcttgcttgctgacttactgctagagtgtgggatccattgcttccatttagagaagcagccggccctggaatgtggccgcagggctgccaggctgactctgtgagctgagctggcgaggaatgcactttgcagcttgcactgagtttggccttacgtctgtggaatttcttctctcttcttactcattcgtgtcgttaaataaataacaacacaagcagtgcatcctcccggttataatggcaaacagtacaatgtgttacaacacacagtagcttgaagaggatatctctctcctgtggtagatgcttcattccccagaacttcactcctcacccccagaataggttgcccagttaacaggatgcctggttcagtctgcattttgggtaaacaaggaacacctttttagtataagtatgtcccaaatattgcatagcaccaacttatcctaaaacactatttgttgtttatgtgctattcaggtttaactgggcattctgtagttttatttgctaaatctgacaactccagagagtctcctagaaccagtttcctgtattttcttccagtaattttccaagcatgtgcaacctatggatatcttggcagacttactcctggtagaattcccatcacctagaacagtgcttaggacattgtaggtgcttaataaatatgggttgaatgagtgattgactctgtacccaccccatttttcttcacataagtggaaatatattatagtgttgtttcatatgtagcttttccttttaataatgtctcatggggattgatacatagagctgcctcatactcctctaagggtttcctagcattcccttttatgatgcataatgtatttaaccagtcccctgatgatcgacattggtgctgttgagagtctttagctattataaacaataaggtagtgagcattcctatatatgtttacctctgtgggtttgacgacgtgcaaggataggtgtcgcattggaatcatgaggacggaggatatgtgctttaaaatgtggattgatgttgctgaattgctttctgtacaggatctgttcacacttccctcagacagcttgttccccatctccttaccaacatagaatattatcaaactttttcattttgccaatctgatcagtgaaaaactagtatctcgctatcatcttaatttacatctctttgcttatgagaacatttttatgtttgaaagctctatttctttttctgtgaactgcttcttcttttttgcctatttttttctacttattgatttttaaccggtttttgtttgtgaaagaacatgtctgttagcctggcatatgttttatatataatgtaatttataaaattggtgtttaactttgaaaaagtgatttattatggattttttaaactctgtagacattaaaaaattcctcagtagtcaatttatgagtcttttcttccacatattctacattttgtgtcttgcttagaaaggcctcttactcaatgagattatagaggaattctcccatattttcttttactactttaacttctttttttttgcatttaaatctttaatccatctggaatttattttggttttaggagggaggtgaggatctagctttattttttaccagatggccagccagttgtcccaataccatttattgaataatccatcgcttcccacagaattgaaatgctgcctttatcatatattaaattgtggaggagggattttatactcattttctgacagcctccagtgccagctaggcagcaaggattttagggggtttcagctgactagaggcaaagatcctgacctgaaggataaccgcaatttattaaaccagaaatactctgtgtaggaacagtgggtttcctgggtggggacagggttggggtgggggaaagtgagtgtcccgtgctgggaggaatttagttacagcaagatttctcaaccttggcattattgacattggggggtggaataggtctttgttggagcctgtcccatgtagtgtaggatgtttagcagcatccttggtctctacccagtatacaccagtattaacttcaccctgatttgtaacaatcaaaaatgtctccaaacattgccctgggtggcaaaatcatcttcagttgagaattactgctttatcaagcctgggtcgagcagacctcccatccatttcttttaaacagaggcagggtcttgttccgttgcccatgcagtgcatgatgtgatcatagctcactgcagcctcaaattcctggctcaagccatcctcctgcctcagcctctggggaagctaggactataccacatgcccagctaattttttagtttttgtagagacagggtcttactatgttgcataggctggtctcaaactgctggccacaagcaatcctcttgcctaggcctcctgaagcactgggattatgggcgtgagccactgtgcccagcctgaacagaccgttgattagatgcatgtgaggccctttcttgttctgagagtctgtcatcagcagtatcaatggctccagatgtctgggaggcaggaagggaggtgcctatctatctcagagaccagaacacccagatttctggtatgagtgtggggtctgtggggaaagggtggaaccataccggtcgactccgggaggaacagaggttcccacctagccctacaggtgaatcttgcaaaactccctaggacctgcctgggagcctagccattccccctgctaaccacacccccagacaacaaggcctggccatggatccaggaacaatgactctgagaaccggaggtggcagatgttttgtgatttaacagcatatcggtttattgtcttatttttcttaggagtaaaagagtccatgggtgtattgttgggggcagcaggaagcacacgtgtctattcggagatttggggcagcaggtggggagagaaagtccatctagacgagggaggtgtgggagtgagatggaagaggagagggaagtgggtggaatccctgggagctgggggaaggaggaaaacacagagaggagctggctgaggtttgagcaaggcctctggagattggtgagagctggggcggcggggattctttatgacagtgctgcagagggaaaaaggattgttgctgagttgggtggaggtaggtaggagtgatttgaagaaggaggtccccttgggaagttgcattagtgggtgaatgggggttttataggccaggcagagaatatggggagggcaactccagcagatgaacagcttttgcaagacacctgtgtggagcatgtggcaccacctgagcgtcctccccaggtgcggctctaacacaggtgcaggttatgttgggagatagagagccagaactcaggagtgccttgggtgccttgctgtaagatttgggctttccctttatttctttttttttgagacggattctcgctctgtcgccccaggctggagtgcagtggcgccatctcggctcactgcaagctccgcctcccgggttcatgccattctccagcctcccgagtagctgggactacaggtgcccaccaccgtgcccagctaatttttttttttgtatttttagtagagacggggtttcaccgtgatctcgatctcctgacctcatgatccagccgcctcagcctcccaaagtgctgggattacaggcgtgagccaccgcgcccagcctgggctttccctttatttcaaaacactcctcacccactcaatatagaaaaccaaaaaatagaggtgagcaaaaggaagagagtgaagaacagcgtggtgtcacccacccagtggccacctccataaacgctgtccagtttcctctgcacgtccttagcatgctccctgcacacccactgggacaccagctttgtgaaggcaggggtttgttttgttttgtttacagagctaggcgaacagttggcactcagtaactgtgtaatgaatggatctgtactgcaaacctgatatcacttgctcttttcacttcgaagttcatgattcgcttccttgttagtagatacctttctgggacaggtttttaatgggcacaaattattggactgggtaaataggccacatttcacggaaccaacaccctcctgctttttatcagttttcttccacattcctctatcacaagtgctttcatttgtttgggctgctgtaaccatgggtggcttaagtgacggaaatgtattttctcacagttctggagctggaggtctgaggttcttggcgagaccctcctcttggcttatagataacctctttctccttgtattctcacgtggcagagagcagagagaggaaatcagctctctcatgtccctttttaaaaattcacatacatttaagttcaagtgcagttttattacatgggtatattgcatggtggtgaagtctgagctttttgagtaaccatcacccaaataatgtacattgtatctactaagtaatttctcatccctcaccctcttcccaccctcccaagtcactatcattccacactctatgtccgtgcacacacattataagctcccacttgtaagtgagaacatgcggtatttggctttctgtttctgagttgtttcagttaaaatattgacctctagttccttccacattgctgcaaaagatgcgatttcattccttttatggctgagtagtattctgtggtgtatatagaccacatttgcttcatccattttgagtcccttcttataagggccttgatcccattcagaaagtctccatgatctgatctaatctcatgatctaatcacctcccaaaggccccacctcctaaaagcaacacactggggggttaggcttcaaccaattaatctgtagaggacaaacacgttcagtccatagcaggaagcagtgccgccatggggaagagcattgtcgtgaaaccttttgcccctcttgttgagttttctcctccagcacaccctgaacatgctgacagtgtcaccttcctctttacttgtccctcttccgctccaagttgcctcctggcttcccagtgtctctgtgggcttgagaccagagcttgtcataagagatagatgacgtcacttgatggaaagagtcaagtgcagtgaccagcacatagaaggcggccatcaacattggtttcatcctttagagcaaagtttccccaagcgcctggtgtgcactggtgagatttggggacggggtggtacttaagacctggcactaattaacactagatcactgtgtgggaaacatagtcccttttctgttctcttcaaatccttctgatcgggctgaggagaaagcctcaggttggtgctgatgtgcttttttctcccagacccccatcctaacagaaacagagcaggtctcaggctcgggccgttaggcaatgatgtcaagccagaatgaactaacattattttgttctcgttgtgttttattttcatgggaaacttagagttatattcagagatattgatttttttaatcccatttaaaaataatgttttaattgagataaaattcatataatgtaaaattcacattttaaccatttaaaatgtacaattcagtggttttaaacatatttataatgttgtaagccatcaccactatttaattccagaacattctcatcacccccgaaagaaaccctgaaccccattagcagtcgctctccattttttttctctcttccctgcggcccctggtaaccaacaaactaattccgtttctgtagatttgcctatcctagacattttgtataaatagaatcatacaatgaatgatcctttgtgactggcttcttagaataatgttttcaaggctcatccaaggcatgtatcagtacctcattcctcttaatggttagatcactttccattgggtggatggaccatattttgtctatttattcatcaattagtgagcatttgagttgtttccactttttggctgttataaatagccataaacgtatatatgctttttttttttttttttttttttttgagacaaggtcacccaggctggagcgcagtggcacaatcacagctcattgcagccttgaactcccaggctcaagtgatcatcttccacctcagcttcccagatagctgggactacaggcatgtgccactatgcccaactgatttgtttattttttgtagacacagggtctcactttattgcccaggctgttcttcaactcctgagctcaagtgatccacccacctcggcctcccaaagtgctgggattacaggcatgcgctaccatgcctggtccaattttttgtataagcatgttttcaattctcttgggtgtcttcctaggagtggaattgctgggccctataagagctctgtgtttaacttttgcaggccatttcctgagtgactttaagttgaaaagtaagtcagtttaaagaaaactattaatcatattgcagatggtgtgtggacatgacaaacgtcataaacgtggtttgcagtgatggaagagtagaaatcctgcttggacatgacctcctccatcaactgtttcccactcacctttccagcctgtggtgcctctgttcccaggagcctcagtgcagccacgctggcctctgaactgtcttacatgagatgtccttcttcaaagatactgccgtttgtcttgtcctgggatatgcgcgacccacattttttttttttttttttttttttgagatggagtctcactgtttgcccgggctggagtgcagtggcaggatctcggctcactgcaacctccgccttctgggttcaggtgattctcctgcctcagcctcccgagtagctgggatttcaggtgcgcaccaccatgcccagctaagttttgtatttttagtagagacggagttttgccatgttagccacgctagtctcgaactcctgacctcaggtgatccacccacctccgcctcccaaagcgctgggattacagacatgagccactgtacctaactgcgccacccctttataccctccagggagctggacttttcagagatcatctttcacttagaatctaccgtttaacccttaattgcatttcccctcatattattatactcactaatgattttgttggagaatcttttgcctctgctataagccacttgagggtagcatctatattcaagtagtccattgttcctctcatagtgcagcctcacctgatcaatggtgaacagctgctgatgaacagaaccttccctggaggcccctgttctactgaatcttggtcagccccgtgtcctgatgcttgccctgcttgctgttactttttgcctgtggttttactgtttagttaacttcttcttttcctttctttctttcttctttttttttttttttttttttttgagacagagtctctctctgttgcccaggctggagtgcagtggcgtgatctaggctcactgcagtctccgcctcctgggttccagcgattctcctgcctcagcctccagagtagctgggattgcagacgtgtgccacctcacccggctaatttttgtatttttagtatagatggggtctcaccctgttgggcaggctggtctcgaactcctgacctcaggtgatccaccctctttggcctcccaaagggctgggattacaggtgtgagccaccgtgcctggcctttatttatttatttatttatttattttttgatatggagtcatgctctgttgcctaggctggagtgcagtggtgcaatcaaagctcactgcagcctcgaactcctgggctcaagttgtcctcctgcctcagcctcccaagtagctgggactacagatatgtgccaccacgcccagctaattgttgtattttttatagagactggtcttgaactcctgggcttaagcgatctgcccaccttgacctctccaaatgctgggattgcaggcaaatcagattgtttcacagacttcagaatggaggctgaggttcaaggaggtggacaccaggcagccctgggaggccatcttccatccagtatgtagagtaaggaacaggaaagcaggtgtaccgagaggcaagaaccatgaatatggacaaggagaagccgagagaacacaaggggagacccaactgtcttccagttcccagttctcttcctttccttcagccagaccgaccttcctcctattgggcccaaatcatgtcaaaaaaaaaaaatctgactggccaggcttagtcaaggaggggatcatagagtcccagtgccatgggtgagggaggcagtcagtgtagacatcatatcactggggagataagccttcaatggtgcccactattgggtgaaaaggcagacctggagctctgaacttcagcttccccttcttcccaaggttgtagaagtgggaaagccaagctagtcatttctgagtgcgggaggagaataatgtgacaaaaatggttaacatcagactagctagccttgaaagcttgagtctgaacggtgatatcttaggagaggggaaaaaataagcatgaagctgtggctctgctccatttctggggaaggaagctcttctgacttttctggctcagtgcaggaagggttgaagaatctcttaaaatctcctgagtcctctttgtccttcatctcagaattcctgtgcaggtgatgtttggctgtatgctccacgaaaggaatagggaacttggctccctccctccagggactgttgctgctcctctgagtttccttagcttaagctgtgccccctgtgtgccatttgccttgggacagagatggcccccattttccaatcctgttgtaggggtgggaatgctccccagtatgtgaaaatatccccaagctgtgttttttttttcttttcttttggggcaggctcttgtgttgcccaggctggagtgcagtagcacaatcatagctcactgcagcctcaaattcccaggctcaagcaatcttgcttcagcctcccgagttcctaagtagctgagactacaggcatgtgcctccctgcccagctaattttcattttattttattatttttgggatgaggtcttgttatgttgcccgggctcatgtcaaactcctggcctcaagtgatccttctgcctcagcttcctgaacagctgaaatatccctaggcttttaagcctcagttacttaatcaacacagtggggccagtacagcccatcattggcatttgtggatttggcagtggtggttccttttctcattagctacccagaagatccttagcacagcatcataagtcactgtcttgaaactccaccctgaattggatgcttggtgagcatctgggagaggcagaatggtgttggaaccaagattgtgggctctggagtgagatttctctgtaagtctggacaccaccccttggttgggtgatcttgggcaaattaattaatgtctctatgcctcattttccttgcccataagtgcggatgacatagcacccacctcacaaggctgttgggaggtttaaatgagttaagacctgcacagcccttagaacagggagctttcaatatgtgttggccacagctcttgtgcccaatcgatttcactcatttgggcaatgcctgggttctagatgaagggggaggaggctgcctgtagtgtcttcttcatgggccagtccagctctgcagtggactgtactggtgatgtccaccgtgcctcagcttttaagcatatattctccttgaaaactatttaagcagaacacactggggtcaagccagtccaagccagatgtttggggtcctgggtgcttctgttttctccatgtctgtttacctttaacaagatggatgggggctgtgaagcccctctgggcagccttttctggctgtgacatgcaccagaaacccacttttggcctgtttgcactgtgttagaaaacagcaggtgcagttggcagcctctcccctaccccttctcccgttagcccctgatctctggggactccttagactaatgcagttttaatgaatacacattactgtttacatgactgaaatgagaggctggctgcttattttatgctgaggtttacagccctgccttttaaaaccctctctcccttgctctgcttctggccatggcgatattttctggcggcccctatgctgtccctccaaataaggaattcaccatgaagtcctgcagcagtgtcagagccattgccttgccccggaaggagtgaactgtgtagaacaaaagcagaggctgggagctgtagttcacgcctgtaaccccagcacttcgggaggcagaggcagaaggattgcttgagcccaagaggtctagaccagccctgacaacacagtgggaccccagtctctataaaaaatacaaaatacaaaaatacaaaaattgatgacctgcacctgtagtcccagctactagtggacactgaagtaggatgattgcatgagcccaggaggtggaggctgcagtgagctttgattgcaccactgcattccagcctgggcaagagtgagactctctatcaaaaaaaaaaaaaaaaaaaaaaagcagaaagatggattctttatttttttaatttaaaaatactttttacaattcttaaatgcttgcttatgatagaacaattagaaaatgaaggtatacaaagagaagaaaataaaaatcacctctaattccactactcagaaaaaactcgatcgttaacattcctgtttatgttttagcatattttaatcaatctacatttatatgtattttaaattaaaattagaaaccaaacttaatacatgttattcagaaatctgctttttaccctacctcacaattaatatatgatgaatgtctttccgagttaagaaatatagatctgcagtatcttttctttaattttaattttaattttttagagacaggatcttgctcagttgcccaggctggagtgcagtggggtgatcacagctcactgcagcctcaatctcctgggctcaagcgattctcccacctcagcctgccgagtagctgggactacaggtgcatgccaccacatgtggctaattttttttttttttttttttttgagacgaggtcttactatgtagcccaggctggtcttgaactcctggccacaaacaagcagttctcccacctcagccttccaaagtgctgggattacaggcttgagcaccatgctcgatattgcagtatctttttttatgcatcattgtatcctattctataattgtttctatggtctcatttgtagaaaggttaacattaaatttcgaatagttatatgtactcactggttcaaaattaaaaaggcacaagagctttaatacttttattgaaagatttctctcctatccctagcccttaggccactctgttcacctcctttttggcacccaatattcaactaataataccaatttattgtgtatacttctggaaatagttcataatgtacatgcacatcatatacatttatttttctcttcctcaaacacgtacattcaaatgttagcttaccttgctttcttcacttcacaatatcctgtatcttggtgtttgttccatgtcagtgcatatagaacatcctcattcttttttttgaaacagagtctggctttgtcacccaggctggagtgcagtggtgtgatcttggctcactgcagcctctgcctcctgggctcaagcaatcctcctaccttagcctcctaagtagctgggactacaggcacacaccaccatgactggctgatttttgtatttttttttttcattgttgttggtagagacagggtttgtccctgttgcccaggctggtcttaaactcctgggctcaagtgatagggtcacctgggcctcccaaagtgttggggttacaagagtgagccactgcacccaatgtctcattctatttttatttatttattttttgagacagagtctcgctctgttgcccagaccggagtgcagtggtcttgggtcactgcaacctccactttccaggttcatgtgattcttccacctcagtttcctgactagctgggattacaggtgtgtgctaccacacccggctaatttttgtgtttttagtagagatagggttttgccatgttgcccgagctggtctcaaactcctgacttcagatgatccacctgcctcccaaagggttgggattactggcgtgagccaccacgcccggccacctcattctgttttatgattgcatcgtggtccatagtatgggcatccctggggtgtttccaaaattgggatatattgactcagaaacccttcctgtggttctgtccaagctccttgttcatatgacctggcctggggtgactggaggaaggatgtccattcggagattaggagggactgcagctctcgattatgaatgggattggcctccacaggcctgagtgacaaggacaaagcagagctggtgagccccatgccaggtggcggtcactggtggaaggccatttgtgacttctctgcagttctccagatggaccacatttaaaacagaggcactgccattcatttctacttggttgaggaaaggtttcatcgcaggcccagagagaggatcagatgttttttgcagtttctggcaagacattagtgggtatcagagggtaagtgatctcgtaaagctgactcaaagcaagagaaaatttcgtgtctgtcttagaaacacatttgcctccaaagggaaggcagggtgtggaggactaatcaacgcatttcacatttggtttctttgtctttcttggtgatcttacgtgactagccctgaatattttgcatatgtcaaggaaacatttcaaattactaagatgagaggaaaatatggggaatgaataaaatggggtttatcagcaagaacagcaaaagacttcttagagccggctggggattgttttgtgaatctctaaacaagaggggcagtttgacttggggatgggggatgttttgacacttggagggatgggagggagccaacaaagatgtaaagcaaaactgggatggtggtgatggagaagcagtgggggtttctatgggaagacataggaaataatggtctgtccttcacagagtaggtgaggtctactagaagatacttatcttttccctaaatttcagtcaacttcacatgattaagtttccattattaaagacttgttctttgtgttacctttttattattattattattattatttttttttttttgaaatagagtttcactctgtcacccaagttggagtgaattggcgtgatcttggctcactgcaacctccacctcctgggctcaagagattctcgtgcctcagccacccgagtagctgggactacaggcacacaccaccaggcctaactaatatttgtatttttagtagaggtggggtcttgccatgttggccaggctggtctcgaactcctgggctcaagtaatccacccgcctcggcctcccaaagtgctgggattacaggcatgaggcaccatgccaggccttttgtgttacttttgtaagagatgaaatgaaactaatatctaatcaaatctaagcatcaagcaattaaaaatattttcttaaataactattgagttaaataggactcaaaagtacaattgcagagaggctataaatgaaaaaaaatagagtgctatataaaacaatggataagatcagccaatgctgtgcttgcagataagttcatagctttaatacttttatgattaaggattgagatgacttgctttgagcataatctggctattcacttattctaaggaacttgtcatggctcaaacatgtttctagtatcctctttagaaattccgtttagatacagttttctttattaaaccttctaaggtgactatttcaaagatgaaacattcattttgttgtttaaattaacacgtattttttaaagggttatgtaaatgtgttatccatcaagtatatctttgagccttcatcacagtgtgatgtaagggatataagttgttaaggatccagcagtagagaaaatttctgcacaaaagtaactatagctctattacttttggaatattccctaggatacatccaaaaccaaatcaaattatactacttataaaacacatttggaaagatactatgtgaatatgctttgaatactgaggcttatgttagaacagagtcatggacgaatttgcaaaaaaaaaaaaacctccaaaatttcctggagtctgacaaaaataccggatagggttcctgaatatattttcatgatctttgctatataaccagatatctctatattttgaaatggatcatattttattagtttttcttagtacacaagcaacatgctatcattgcagatgccagaaagtaggatcacattgttgtgctatagatctccagaacttctttatcttgcaaaactcaaaaactctatcatttctcaaactcaaaactcaacaattctccattccctcttcctccaccccatggccaccaccattctactttgtctctatgaatttgaatactataggtatctcatataagtggaatcatccagtatttgtcatcttaagatttctttctttgtgtaacgttatcaaggttgatccacattgttgcgtgtgtcagaagttcccttctcttttaaaggctgaatatttcattgctttatagactgcacttttttatccattcatttgtcaatggacagttggattgctctcatcttttggctattgtgaataatgctgctatgaacaggagtgtacaaatatctcttcaaggccctgttttcaattcttttggctatgaacccagaagtggaattgctagattaaatggtaattctatttttaatttgttgagaaccaccatacttgttttcatagtggctgcaccattttgcattcccatcaacagtgcacaaggatttttccacatcctcaccagcacatgttattttctttttctttttttgatagtagccatttaatgggtatgaggtggtatctcattgtggtttttgatttgcattttgctaatgagtgatgctgagcatcttttcatgtgcttattggccatttatgtgtcttctttggagaaattctattcaagttgacttctatgattttgcattatcacatctgtattgattcaagcaagccaactagaataaattctggcatttaaaccgattttgtggtttttctgcaaataaattctgcccccaaataacctccaactttctggaagcagtcagcaggagtacagttctgaagataactttctttaaaaaaggaaattcataaaatatcatgcatcttccttttttgacactaatggaacaatttaatgtaatttcagagggaagcagagcccctggaaaggctggtgtgataagggaaggttacccagctttcctgtcaggcggtgtgtgggagcagagagtggcattctctgcatactcttggggagaagagtgggtgagacaggctgctcagggctggggcagagcccaggggaaggggatggaaggggaagaacagcccttcaagagtcctgcagaaattggtggaagttatttaacagaagtgttcggctccacccagcacattctgttgccttctacatacagagtgtgttagtctgttctcatgctgctaataaagacacacctgagaccaggtaatttataaaggaaagaggtttaatggactcacagttccacatggctggggaggcctcacgatcatggcagaaggcaaatgaggggcaaagtcacgtcttacatggtggcaggcaggagacagcatgtgcaggggaactcccatttatgaaaccgtcagatcacctgagatttattcactaccatgagaacagtatgggggaaaccacccccatgattcagttatttccacctagccccacccttgacatgcagggattattacaattcaaagtgagatttgggtggggccacagccaaaccatatcacagggtaatgaagaatgtgtgcccaagtagtagagggcttaagaaaaccactcttgggctctgagtctctctaggtctcagtttcctcatctttcaaatggcaatattaataagacccacctcatagggattgtgtggggtttaaatgagaaaagacaggtaaggtgctggtaccttataagtgattaagttgccattaaggtattggggacttagtgcttgtccttgaagagctttcggtctcgtgaggagacagcctgatcgttataaactattatagaaaatgggaagaaataagggttgaggtgtgataaagatgtgctaggccaggcaagatggctcacgtctgtaatcccagcactttgggattacaggtgggcagatcacttgaggccaggagttcaagatcagcctgaccaacatggcaaaaccctgtttctactaaaaatacaaaagttagctgggtgtggcggcacccatctgtcatcccagctacttgggaggctgaggcaggagaattgcttgaatctgagaggcagaggttgcagtgagccaaaattgcacaactgtactccagcaagactctgtcaaaaaaagaaaaaataaataaaaaaagatatgctataccctcatatcacaataatgccaggaaatagatcattaattctgaaccctaattcttgggtgggcatcaaggcaggcctcacaagaagaaggcatttgagttgaatcttataggctcagctgggttccaacagcaaagacttagggaaagggcagagcaggcaggggaacagtaagagcaaaggcttgaaggcatggaagttcatgggtaattactgactgagatgtttggtgttatggtgcatagaacactatcggatgataatgaaaacattgaattccagcatgtttagaaggacattggctgataaaaatgacgtcttaatagttatctgtggacaaatttgtaaatgtaaaagagttgtagactcaaatcctacagaaattaggcaggagacctaaatgagtgaagtgggtgggtataaaacagaggtggtggcaggaacccatgttgaattgaatagtgggtgttttgtttaaaggggcaccagtagtaatttttcctctgttggaatatgatcctagggctgccagctcttctactttttcaagagaagccagaaatctggatttcatgcaaaatttcttgtttttctttttattaaagacatggtatggaccaaaaaaagatgtctctaggctagatctctgcaacctctcatctatactctatttgcatttttaaagactatatgcaaatgttatttagcagagctacctagtttttttgtgtgatgatagcatgtgaaagagctatgatacatcttggaaatgtcaactttgaaatatacagtgactgtgttggtcactacagaatgatctctgcagaaacttcagttacattttctctaaatgacacctttgctttgacaacacattttcaaaaagaaaaatagcaaactacccttcctccagggccttagccacagtagctcctgccagcataacacaatgctgcaccttactgagggatcaggaaatgtggtttgatttataattatggcttcatgggtagaatggtggccaatgtccacatgagccacactcagtggctaagatccagagggcatttaatttaggtagccagtgttacagacatagtttagatttttgcagccttgaccaatcttaatagatctgtctgttctttagagttacctttttttcctgcctcctagctacctacaccttttaatgctaaatgtagttagctagtgaatgctgttatttgaatcttaaaatttcaggttgggacagaaccttaaaattcatgtatttcaaccaccctttgtatgaggcaggaatcttggttatgacaggtgacagaaaattcaaactagcttaattcagaagggaatttattgcctttataaaaccaaaaagtccaagggtagctgccttcaggtattgtctgatccaggggtttgttatgtttccaggacatggtttcctttattccatctctgcttatgtattggctcccttctcagatggaagagactcccctcatcaaggtgagatggctatggaagctctactcacatttcctctaggttcaagtccatgtagagaagagcacctctttctcttgttatatctcacaggctctaaattagctactagggccagtgaaaaagcaatgtgctgattgaccacccttatctactcttggagttccggatggaattaacactacctgaattatgtggaccaagagtgggaaaggaatagttctccagaaggatatttggtattgttattaaaataaggttaattgaatactcactgaaccatctaatgcttgaattcccttcatagcacgccattggtgactgtccaatcttcagttactaacatgctacccccaaaatggtgtgtttgtgcagctctaataatgacagggtttctcctaatactgagatgatattggcatctccatagttccagacattatttctggtcccaaccataatcaacctgttttgacacgggtgaacatgtaagggaagggattgctcattgtggtcacagaagtaacctacccaatagaagcacaccaacttgaagcatgcttccatgatcactgagggaggaaaatgattggcaagtctcgtattggtccttgaagcgctccctataaacacttgtcactgccaagcgtgtatcactggccaaagcaagtcacattgtgatatgattagactttgtgtccccacccaaatctcatcttgaattgtaatccccataatccccatgtgtctagggagagaactggtgggaggtgaatggatcataggggcagtttctcccatgctgttctcatgatactgagtgagttctcacaagagctgatggttttataaggggctcctcccccttcactcctcactcttctctctcccgtagccatgtgagaaggtccaagcttgcttccccttcgccttctgtcataattgtaagtttcctgaggcctccccaaccatgcggaactgtgagtcatttaaatctctttcctctagaaattacccagtctcgggtagtatcaagatagcagtgtgagaaccgactaatacgcatggccatgcctaacttcaaagcggctgggcaagtatcatattgctgtgtacttgggaggaggggagaatcagaatatttgatctggcgaccaccacacaactgaacttctctatttctgtgttcttcttgttaaccatctagtttctgtttcctcttgtgacacatatattaattaatttttcaatacccaaacacaagcctctaatatttatctttgtttagttacttcctaataaactaagatatctctacatcctgatcctaaaattcaaaggctccacgtataccatggtgactagttaattccaatatattgcatagttgaaaattgccaagagagtagattttaagtgttctcactacgaaaaaatgcatatgttaaatagcttgatttagccatttcactatgtatacatgtaggaaaacatcatgttgtacactacagatgtatacaatttttacttgtcaattataaacaacaacaacaaaactgcaaagtctccttagacccacccaatcacatgttgtctgctcatttaatgagtaaatgctatataggttcattctggacctgggtaaaatgatttacggactgggaccaagtgggaggaccctatttcaattcattaggtaaggtcttccaggtcaatatttgaccattgattggcacatctggggtatagttatttaactgccttctagtttacctcaatatgacccctcagtggagggaaaatggagcacaatgactagaagaatgttgagagatgaggaaagagagaatgggatggaaagaacataaaataggaaagcattgacattgtcacttcttggctatttcttcctgtaaaattttgcctggagtgccctacaatggggtccccatcctctgccctgataacatcttagtggatcactcctctctcccttttcattctgcaggacttgcccattggggctctttcagacctgactggtcattgggtatctgtggccatgataatcactctcttcctggacgtgaccctcctctcgttaaccaggatgcctgtgttcttaaggttggccgtttccaaggacagagagcttgcatcccatttctaggggactggggatccaaggactccattcttgacattgtcttgtcagccttgaagtgccgaaacccagcatccctgtctgaggtcatcctgtctctcttccaaacatgaggacttcttaaattttttaaaaaaagtttttacttgtataaattgagaaggcacaagtgcaattttgttacatggatatgttatttagtggtagaatctgtgcttttggtatgtccatcacccagatagggtaccctgtactcattaagtgatttcttatccttcactcccccacccaacccttccaagaaggatgactattactcaacagtcattcagtagccattggagaatgactattattccatactctgtgtctatgtgtattatatagttcccatttataactaagaatatgcattatttgactttctctttctgagttttttttttttaagataatggctttgggttccatcctgttgctgcaaaagacatgatttcagactgggcatggtggctcatgcctgtcatattagcacactgggaggctgacgaaggaagatcacttgagcccaggagtttgaaaccagcctgagcaacttggtgagactccggctctataaaaattaaattagccaggcatcgtgttgtgtacctgtggtcccagtttcttgagaggctgaggcaggaggatctcttgagcccaggagttcaaggctgcagtgagctatgatcacacaactgccccccagcctgggtgacagagtgagaccctgttttagtcaggacttcaagaccagccttgccaacatggtgaagccccatctctgcaaaaatacaaaaattagctgggcatgatggcgggtgcctgtagtcccagctactcaggaggccgaggtggaagaatcacttgaacccgggaggtggaggttgcagtgagccgagattgccccactgcactccagcctgggcgacagagtgagactgtttcaaaaaaaataaataataaataaataaataaaaataaaatcaaaggtcttactcttttttatggctgagtagtattctattgtgtgtatgtatatatagatatacatacatataccacacacatacgtgtatatatgtatatatatggtggtatgtgtgtctatatacacacaatgatatgtatattaatatatatgtatatataaatatatatacattttctttatccagtcatccattgattgatgcttaagttgattccatatctttgctattgtactgtgataaacgtatgagtgcaggcatcttttatataataatttcttctttggatagctgcccaaaattcaggtaaaagatctcagtctacaaggcagctcccaagcttcaaaaaattgtcctgccagatttttaaaagcaagttttctcaaaagcttcgatgtatacattggtcgatttatttatccattaaagtatttattgaatacttcttactgcgtatggtggtggtggtgctgaggtgtctcacagtgaacacaacaggcgtagcctctgctattaccaaaattattgtctggtaaagaatgcagatggctaaccaggcaggtgcctgtacggtgagatatgtgctgtgatggctgtaagcgcatggtgtgagcgtagagttgggtgcttaattgaaggcatcaggaaggcttccaggactaaatgatatcaaagtcccaccttaaggatgacaggtttaactaagtaaaggaggatgtggaaagaagggggagagtgctccaggcagaggaaatagtatatacaaaagcacaagaggattgaagaaccaaaatcactttggcatggctggaatgaagggcatgtttgtgtattttcagggtaggggatgtgtttagggacaagctcagagaaaaggaagtaaggaaccctgtcataaagggctcatctgtcctatgaaagagtgtgtacattttattctgagagtacagagccttttcttttttctaagcattacatgattagatttgtcttttagaaaccactctggctgccgttaaaaatgaatttcacagtgacaaggctggaggaaggatcttgggttaggaggcggtggtagtaatctaggcaggacttgaggacgcctgagtggtggtgaggaaggagagaggtggatggaagattcaagagatatttagggggtgttattgagagaacttagtgattgatttggcgtgggaggaatgagaaagtcagggatggctccctggtttctggcttgggtactaggtgcgctggtggtgcttttgacagagatagaaccatgggaggaggaacatgttttgagggaaggctgtctcccttttagacacctagttggtgtccaaatggcacagaccagttggcgtgtggatatcttggggcttagggcgtggatctgggctcagggtggagatctgagccttagctgcacatcagtagtcattgcagtcatggagtgtgctggggttttgccaagagctcatgtagattcaggcgagaagagaggaggggcccaggctgggaatactggctttggaaatactcttgaaatatatagaaatgaaagaatgtatagggctgtttccacagacgtttattttttatttttatttttttgagatggtgtttcactcttgttgcccaggctggagtgcaatggcatgatctcagctcactgcaacctccacctcccaggttcaagcaattctcctgcctcagcctactgagtagctgggattatagatgcccacgaccatgcccggctaatttttttgtatttttagtagagacacggtttcaccatgttggccaggctggtctcgaactcctgacctcaggtgatccacccaccttggcctcccaaagtgctgggattacaggcatgagccaccgcgcccggcccacagacatttactgagcaagagcttgtgcaaggcactctggtatgcatgcagtcggggaccctctgatgaatggaactcaggccttgtataaggaagtgacctccatcagagggtggagacgctgtcagtgaacatccatcacagacaagtgactgagctaggagctggggtaaggtagaaagaggaggacagtgggcgatatgagctgggaaatgcacctctgttgggggactggggagggcttcctggaggaggtgattttggtatctagtggttttgttttgttttgtttgttttttttgttttgagatggggccttgctcttgttgcccaggctggagtgcaatggcatgatctcggctcactgcaacctccgcctcccaggttcaagcgattctcctgcctcagcctcccaagtagctaggattacaggcgcccacaaccatacctggctaatttttgtatttttagtagagacggggttttgccatgttggccaggctgttcccgacctcctgacctcgtgatccgcccgcctcggcatcccaaagtgttgggattacaggcgtgagccactgcgccaggcctgtatccagtgtttaaggagatgttttgtcagataaagctggagttttgtaatggagttttggagatggggaagggcagactggcttaagagggtgctgcataagagatggctcagaggagagaaagtgtacgatgttttcaggacaaattagtccttcaccatggcaggaatctaggcggccgaaggacatttgtgggaaattgtagcagaaaatacgaggaggactttgatgccaggccacagagtttgcagtcctttttggagactcaggggagttattgaacaattagaaactaaaggctgatgtgacctccacaggatactggctaaacgcatgaactcttgaaccagatggacctggatttaagtctggattctgccatttccttgctgtgtggtcttaggcagattattaacctctctgagcctcagttttctcatctgtcaaataggagtgaaatacctcatagagggttgtgaagagtgaagtaaactaatgtggagaaggcattctgcagtgtctggaattcagcgacccctcagtacatgttaacacactaatactttctacgtaatcatacctgtaacaacacagagacgatggtattatctttacagcttgttcgcttctgtatcctgagcatctaggacagtgcctggcatgtaatggatgctggagaaatatttcttgggcaagaaatgaattgcaccagtttctttttgtaagggatctatttttttcttgtctggaaaaatactttgataaaaccttagggaaaagatgaaattccctttcttctggagcctagatttcaaagaggagaggttgagtgctctgcaaagtagaaggagaagattttgggcagtgaggaggagagaattgatgagatggtggggcacagcgtactatgaaatgtgactcttcccccgggacccccgaaaaaatcttctgtaacattttatatgtgtaagacatctctctaccatctgctatggtcgaaatgggatttgtagagagctcatgtgattctcaaacctcctagtaactctgcttacatggagagacagctgtctccaagccagctgttgtcttttggaaagctttaatctgggggaagataacaccttgagaaaagatgtcaggattggaggcagatgttgacggagccagtttctaatgccccaaggcagccacactttgtatggattgtatggatgggcaggtgcacaaggtgagttatttttttccctacccagaaatttatggaagcctggcatggtggctcacccctataatcccagcactttgggaggccaaggtgggcagatcacttgagcccaggagttcgaaaccagcctgggcaacatggtgaaaccctatctctactaaaaatacaaaaattagcctggtatgggggtatgcacctgtagtctcagctactcaggaggctgaggtgggagaactacttggacccaggaggtcgaggcttcagtgaaccatgttcatgccaccacacttcagcctgggtgagagagtgagaacctgtctaaaaaaaaatatgaagttgctcttttgaagagcattctaatgacttatctggagattctaggaaagaaattaaattcagctttcaatgtctgtctttctagatttcttccttctaacgttattgttgttatgtcctcaaacaaaaacatttagtacttattatgagcttcatagggttgttgtggattaatacatgtaaagctcttagtgcaatacacgacacatagataacatttaattttattatcgttactgttgggtagcactcagttcatgaaattcccacacacagtcaagtggtaaatgctattactttgtaaatatcatcgatgaggaacctgaagctcacagaggttgatgacttgcctaggatcgctcagaaagcaggcagcagagctgattgccatggtaaccatttccaagcttcagtgcccagagatggacccagtctggcatgggcttatcccctggagcactgtgagtgtcttgacagataagtaaaggaagtctttaatttctgaaaaatgcccagctgtgattggcattgttaggggtcagtgaagacacgctcaaagaccttactgtccagcttttttatctttcacctttaatgccgctgttagccccaggagctaaccaaaggggagttttctttatcagttccaagagggatgccatggttgtcccaagattctggagctaaaggtgggaccaggaccagaattcagtttctgtgtttccaaattcagttctattctcctctcagtagaccaggaggcctccagacaagacagatggcagacagctacagtagtttaaaatagcctgagctcacttctgaggtagacatgtgcgtggagtgagctggaagacagggacccctgtgtgggaaagattttggcaaagagaagcccagtggggagttctgatgctaggctgagtgtcatcaggttggggtgagggtgtgagaagagacctgagcaggtgccaacctgaggctgagtggggaggagagaagcgagaggacaggtgccaggcaagatgcggcactgccaatcagtagaagcttcctccctcctttccagctgtgctaccgagacggggaggtcaggtggtcgttctgggagggctggtgccttttacttcccggccttctggcctgctgggtcttggagtccagtgcaaaataatgaagttcctataaagacagtttgtatagatccttttaggatgacttgaaagcctatgcatttccttaacaatgatcaattcttggctaatcctctttcatccatatccgcacccaatgcttttcactccatttccatactggatgttttgaaataaatcccagacaccatataatttcagtaattatcaatctcaatatcacagaaagtcaaatagacattatatatcttctaatatgatgcaaatagaagtggccaatgctatctatgcaatattattactaaagatctaaccaaatttacaggaaatacagagaatatgtaggaaattctacatagaaataacttgatttcttcacgaaaccaatggcatggaagtgtgaaaaaaatagaattaaaagatatagcaatctaagatagtgtgtggacctcatttggaaataaattcaaacaaatcatccataaagaaaacattgtgagataatcaaggagaaggaaacattaactgaaatataaaatgataataaagaattgttattgcttttactgggtgggataatggaattgtggttgcttttttgttgttcttatctgtggagatatgctgaagaatttatgggtaaaataaaactaagcgatgctaggtggggaggaacctatgcatttcctattttttggcaaaaaggccccaaggtgtagtccctagcacctatgttcgaacaatgtgacccagcattcctgctgatccctgactgaaccaggtatggctccacttgatcctctctctggggactgggagttagcattcagaaatgccagctagcctccatcaacagcagactggaaggatcaggcatctcaggaatcatgcaatgtgcatcaaaaaatagagaaagcttatcttcagagagacagacaagtgaagctggctcagaggtcatgtggaccagagggatgggggaagcagttgccttggttcctgacaatcctgcattgaagtcaaactgctgttcctttccctggtttctgtttccttgtaacagacttattcctttgcttgaactgggggcttttagtggggttctgttgcttgcaaatcttaagtactctgagaaacagctaaggagatgaagatggaaaactttgtcatgaagggaatgggttactggaatctttctggagggagaatttcagaattacgaggatgcagttctgattgaagggggtcttgtgggtatctgggatttggaagtgagaatgaatgctgtagcagatgctattagctacccatccaatggcgattccttctttgtttctagttttgttcggtggcaatgtgcccaggggacagtgcatgcatgacccatgattatttccctttcagtgattggtctggaagtgggcactggacccagtttgggtcatgtaggaaagactctttcttttcatcctttcttcctgctctggaggctgttaggtgaggacataattgttggagctatggcagccacattatgactatgaacaggtgcctagatttgtagcaacactgactgagagcactgtcattcttgagacactcatacctccttctttcagactttattattttggggatgatatttattgatgagccccttttggttaagttgcatatggttggctcttctgttaattcaagccagaagattcttaattgatacagttaggcttcataatttggaggtttgggaggaaaatgaggtgaaagagcatgcattgttggggaagataatattttaaatcagaaaattaacattttctaccagaagaccttcaattattatattatagactggtttgcagagccttttgagagtggtgtgaactgatatccatccatccatccatccatccatccatccatccatccatccatcatcttctgtttgttgattttctatccatccatccattcatccatccatctatccatccatccattcgtccatccatctatccatctatccactccatccatccatccatccatccatccatccatccatccacccatccatccatcttctgtttgtcgattttctattcatccatccatccatccatccatccatccatccatcatcttgtttgtcaattttctacccatccatccatccatccttccattcatccatccatccatccatccatccacctacctcatccatccatccatccatccatccatccatcatcttctgtttgttgattttctacccactcatccatccatccatccatccatccatccatccacccatttgactttctttttacgaaactttccctttgatcaatggaggatttccttcctggacttgcttggttctgtctattatcagctgggtataaaatgcttttccttcttcagttaggtcacgtgtagagaattgatattagatagctatggtgaggagtgaatgggattctgcctggcctctctctagggacactttgccttctgcagtgtctggcatttctaagaaacgttgatttttaggcattgaggaaaaaagctgttttttttttttttttttgacattaaaagctctagttttcccttattttattccctggagcttctttcaacatattcaagcactgttggcttcaggcgtggctttgtgggctggaaagggccagggtatgttttcagaggaatcctgtgggattgaattaggaatgctgccttcaggggataagtattattttaataggaagatattctttattttttgattcttaggaattgctgtttctcatgtagatgtacttacctttgttacattaataagttccataaaatattttcagcgtatagaatttttatatatctagaccattgtctgtttcaggttaggaattgtcagtgtttatacgtgcgcctaatcccttgtagtctgttcgttactgggatggtggtgatgggggcactagagggtggaatttgcgcacatggagagaggagatggtgcatgtcagtgtgttttccagttgaggcccttggggttgtgggtggggaggaaagaggaggaggaggaagccagtgtggtaggagtgtgatccacattctcaggaagaaccatatttgatttcatttagaaaacggaattcttacttcttgaacaaagttggcttttcttctctgaacgtggcctttgcaaatgcttgagtctttgagtatggtgatgactgagtgagaggagggatttgcttggggcagcaggcacatctggaaccattgaccacaaacctggctgagcacagagccacccggatgatgggcttaataggtacaaactgggaacttcccctcaggcatgccaactcaggaggttgtcaccagtggctgcagcttggagtgatctggggatcttttaaatgccccaatgccctgcctctacctctgtcagtgaaagcaggctgtctgggagtagaatcagagcagcagtattcattaaaggctctccaggtgactgtcatcagcatccaggtttgagagccactgtggggaaataatctgtactttctataaagccagaagcagtcagttttctgaacatcactgattagaccgtagccattttccagtatggacaaagtaggttctctcctgccatcccccagctgcagcaaacttctcactaatgggcatgctttgagaaacaccaaactgcagggacccaaaggagcatacaattaacgttaaatcacaccagctttgggcatatatatccctcctccaccccaaaatctcttttaaaatagtgttttaaatgtattttttgtagtatgttcacaggactcaaaaaaaaatacaaaatgctgcactattcacaataacaaagatatggaatcaacccaggtgcccatcagtggcagaatactatgcagtcataaaagagaatgaaatcatatcctttgcagcaacatggatggagctggaggccattattttaagcaaattagagcaagaacagaaaatcaaatactgcatattctcactgataagggagagctaagcattgagcacacatagacataaatatgaaactagacactggactactggaagttagagggaggggtgggtttaaaaactacctgtcgagcactgtgctcactgccagggtgacgggatctgtacaccaaacctcagcatcttgcattattcccgtgtaacaaatctgcacatgtacctactgtatctaaaatgaaagttgaaatttaaaaaatgtttaaaatccacacagttttaaagtctcttattctcttctgttctccatccacccatttcccacccccttctctggatatcttttcagaaatcttttccttcaccccctttgttgtcacacaaaagatgacatactgcaacccctattctccaccttgttttttttttttcctgctaatatttggctagtaagcaccagcatggtgtaatgactggcatttgttctgatttgttgagcatcctcagtgactggcagaagctcacatggtgctgccagtctttagatatttgaattacttcccctgtccaccccacgtctagaagatctctctaagcaatgcaaagacagcttccttatactactttttaaaatagatgtagagtatatatatatttgagacagggtctcgctctcacccaggttgcagtacattggtgcgatcttggcttactacaacctctgcctcccaggcttgagtgatcctcccacctcagcttcctgcgtaggtgaggtcacaggtgtgcaccaccacacccaactaatttttttttttttttttttttttttgcatttttggtagagacagagtttcaccatgttgctcaggctggtctcgaactcaagcgatccacctgccttggcctcccaaaatgctgggattacagatgtgagcctggcccaagtattcattttttaatagatgtaaagtatggataattcataatttattaaacaagtcctgtagggatggactttaggtgatttccaatttggggccattacaaacaatgccattaagaatagtgtggccaatgcatcacttcagatgtgtagaaatccatctgtagagttcccataagtgctatttcttggtcaaggggcatgtgtagagtatctttagcgacgggaaatttcacgaaggcatcacattttccagtttgctgtagcaggcagctctgcttctgaaattgtagtaggtacagggttttcttttctttttttccattggtggctttgaggaactttcagatgggatagttgaaaaatgtacatctaatggttttagaggagatgcttctggagctgcagttctcctagggcctttcttgaatgacctgcaggcaccatctggtgtttgttaaaaatgtggaccctgagccctattagactctttgaggcaaggcccaataaatttttaacacaagcttcccaagcgatgcttctgtgcactgaagtttcagaaccactgttctaagggatttgttgtagaacaatgccgtgagaggacatcttttcatatgattagcacagtggaaccacactggtttactcgggacaaagtctgcgactgccatgaacattgcaagctcaataatgccaagcaaagactgagtcttggcatcgggttgaaaataacatttggctatcaacctctgatgcagcatttacaagtttgccctcaaatgcccatagaataggaggaacagggtcaacaacactgaaaatagtcagataaccagttgctggaatctcagtgaaatatccattaactcaaaggcagatggcactggattggatctacccttcacagtcaacacctccaacaagatggaacaagaccaactggaaacagctttgtctatcttccactgtcctattcctagactaagagactcagcttcgtaccaagtgggaagtcactctcttctgctcaaaattaagtttttgaaatgaccacaggcctcttacgatggctaattttcctacattcattcagagaagccagcaagggaaggggaggcagttaacttgtgcagtggtttgtgtagggaactgctggtggtgaattgaacgttcagttgtgtggctgccatacgttaggtgcatagaagagaccgaaggaactagggtgtgagtgcattgtggaatcagagaatcagattgtggaggtgggagaagagtctgaggcagttcaagagagctgcagtggatgagtgcttgctaaaatcccagtgctatatgtgtagttctgccctccaaccatggcttgagaagaggactggaccattactagcgaaaacatcactaggaagggcagcctatacaaccaatcttctggcagacacagggcctggatatatctttccaaagaataacccagtacttaagacaatgcagctgcgtttacagagttttgaagggaaatgttatcatctacatatttgattctcagtcaaactgtcacttatgtgtgaaggcaacagaaagacagttttcagatataaaaaggcactgcaaatctaccaccactgaaaaagttaattgaagatgtactctgattgagagcagatccaaaattaggaacttaagaatgaagaagtcatggtatggaggaactgggatgagcacttccagtaattaaacataatattgagtccaaataattgttataagtctccaattaagtgtcagacaacaataattatttgtgaatgagtagctatatggtgtaaaattagcttcatgatctatttgagtgcaaaatcctagcatataaatgaagactgggaagtagataacataggagcaaggatatgaaaactttacttaatctatcatcttttattggttttacttaatttttcatctttcattgtggaagacagtcagaaaacatgctgttaactttctttaatcacaatgaagtaaaactagaagttaataacaaaggttataaaaaatcaatgacttaaatataaaatactttccttaatgaccctgggacgtgttcaacatagtgctgtatgttcctgttggtccttaccattgcaatacggcaaaaaagaaagaaagaaagaaagcatacaaagaaagaaataaaactgtatttatttgcaaacgacatgcgtatctgtgcagaaaataccaaggaatctataaaacaaaccaatcaaccataaacaagccatcctacaacacataagtgaattcagcaaggttgccagatacaggggaaacatacaaaaaacaattgtatttctataaactagcaatgaatacgggaagactgaaattgaaaatataatactattgacaattgattgctcaaaggaaaaaaataattagctgtaaatccaacaaaacatttgcaggacttatgtactgaaaactgtaaaatgttgatgaaagaaataaagaatatctacataaatgaagacatactgtgttcatgaattgaaagactcaatatagtaaaggtagcagctatccccaaattgatatacaggtttaatgtgattcttataaaaatcccaacaaaattactttgtagatataaataagattattctataatttatatgagaaggcaaaggaactagcatagctaaaacagttttgaagaagtagaataaaatgggaggaatcagtctaccgtagtcaagactatgtgatattggtggagggacagacacataaatcaatagaacagaatagataacccagaaatacacccacacaagtatgctcaattgatttttgacaaaggcacaaaaggagttcaatggagaaatgaattttcaacacatagtgctagaacaattggatatttattggccaaaaaatgaacctcagcccaagtcttgcactttatacaaaaattaactcaaaattgatcatgctattaaatgtaaaatataaaactatacaacttttagaagaaaacataggagaaaatttttggaatctagggtcagggaaaatttcttagactttacaccaaaatcatgatccataaaaggaaaaattgaatagtcggacttcatcgaaactaaacgctattgttctgcaaaacgctgttgagagaatgaaaaggcaaactacaatctggaccaaatatttgcaaatcacttatctgacaaaggactattatctaggatacataaagagccctcaagtttcagctgtaagaaacaaacaatccaattaaaaaagggcaaaagctatcaacagacatttcaccaaagagggaacacagatgacaaataaacacatgaaaagatgttctacatcattggcttttaggaaaatgcaaattaaaagcacaatgagatatcactacagatcaaaatgtcaaaaatgaaaaataatggtaatgccaaattctagcaagggaggctgaggaacaactagatcacccacacatggttgctgagaatgggaactgcagtagccactctggaaaactggcagttttttaaaacatgccaactgccctatgacccagcagttgcactcttgggcatctatcctagataaatcaaagcttaaaggctcatacaaaaacctctgtgtgaatatttatagcaagcaaggaaaaaaaaacccacaagagaaacctaaggtgaactggagtaagaatatagatgagaatatataatattttatattctgatgaaatatagtgttaggatatataaaaaggattgtgttgatacctctaagagttagtcctggaaaacagaacaaagcaaagcaaacaaaagagccaataaaacatctacttctaattatatatttaatcatatatatagatcatatatatatcacgcatatatttatgtaacatatacaatgaatatatatagcaaatatatatatgaacaacatgcaagttagaagtgagaaaggacttataaatccagagatagaaaaattataagacgagatgtgctattacaatggtgttcagactggtactctcggatttatgtcgtagcttttccactactgttttctgaccttgggtgattatttactctctcagtctcaatctcctccactataaaacagggataataacgcagtagttgtatggatttggttaaataatgcatgcaaatagctcaacccagtgttggatgcctcatagaactaggatgatagctgtttttcaatttttggtattaagtttgaaagtccaagaagacagaaatgctcaaattgtctaccataaaagatagactgcctagattaggggttggcaaatgttttcttacaggactagatagtaaatattttaggtttatggggcatctgagcaactactcaatgctactattgtagcatgaaggcagccgtggacaatttataaagaagtgagcatggctgtgttccaataaatctttatcaaaacaggtggcaggcctgcaggctgtagtttactggcctctagtctaaaccaataacaagaaggaagtaatgaaagttttcaaaatcctcaccaaaacctatataacaaatgatccttttggtttttaaaacatttctctagaccatagggaaaaaggacactgtctcacttctctcctcttaccctagcatcatacatacacaaaaatctaacaaagataaggcaaaaaataaagccatggtctaatttcacttataaacacagagaaaacagtcctaaataaaatcttggcaagttgaatcctctaggatattaaaagaacaatgcatcatgatcaaggaagcttcattctagaaatacattatgatttattattaggaagtctattaatacgtcccatcaatatgtcaaaggaaaaatatgatcatagatgcaaaaaaaagcatttgttaaaatttcaatatttgttcttggtgaaaattcttggagaaaggactaagaacaaaaagatactttttcagcatgatgaagactatatgtggccaaccagtagccaaaaatatacttaattttgagatacttaaggaattcccattaaagttaagaataaatgaaagatggttgatagcaacactgttatttgtcattgttttggatgttctagtcaatgaaacaagaaaagaaacatataaatactaattacatattggaaaaatgaataccaaattaacactattcacaggttatattatttattttagcaactctaaaggaatccattgaaaaactattagtacaaataacagaattagttaagagggctgattacaaaacatgtcaaccaaaatcaataactttcttagagagcatctctaacttggtggatgacataatggaaaaataatcccttttggtctccagatgccaccagctcccttttcctcctccgcatgcttggcagaaggccagaggaagtactgtagtcctctactacagagggaagtgtaggaaactggaatattaaccatggattggcaatctgtgtgtctaaaggaaagtggtttacattttcttttaaacgtcacacttggcatgccagatccccatggcgttggagcataccaaagtgatagagcgtgggcataatatgtttcaggcaaaatgtttagcatttgcacagttaggttctcaccaatggtgtgttccttccatagacatgtgagcctggagcttggagcattggagtttgagaaatggcttgatgagggcattgagaagcactagaaaggatatggatagcaactcgattcaaattttatttttgtctacttttctaagtttgtttacttcaagcacttaaactccacttctttgagcctttgttgccttgcctacatactgaggataattaaacctttctcctagggtcttgtagcagtaaatatgattggatgaaaaatacgaaagcatgtcaacaactgcttgttaaaagttagttacctttctgcttccttcttatgcttgactagctcccttgactctttgaaaacatcagaaagcctagccttaaactcctttttggaaactaagcattgggtcccagagcctgaggtttcttaacgtctgcccctagtctggttcagcttctgcctgtttctcaactttgctctcatttcaggaaaggagacaaatgaattattcacgattattgtctcttgaggggcagtgactgtctcttctatcttgttcttccactcccctccggagcatccagagcaactctagaaataggagtgtagaaataaaacccaggaaagagggactttagaaacaagaggcaatgccatggacaggggtggcagaactgttgcccttccagtctttgctctgccatccaccagacttgttgcatgggaaactcagtcaaactctgaagcttcggagtgttctccactataaaaggagaaaaatgatcatctaccttagggtggtgttgtaaaggtcacatatgtgtggccaggcacagtggcttatgcctgtaatcctagtgctttgggaggctgagatgggaagatcacttgaggtcaggagttcaagaccaacgtggacaacatagcaagaccccatctctacaaaaaaagttaaacaatactaaccaggctagttgacatacacctgcagtcccagctacttgggaggctgaggcgggaggatcactggagcccaggaggtggaggttgcagtgagccatgattgtgccactgcatttcagcctgggtgatagagtgagactctctctctctctctttttaaagatacatgtgtgaatgtgtcttatttaactatgttacacatacatataaatataaattctgtttattaatagctcatataatatacagactctgcgcctgtacaaatgtaaaggcaatgcattttacgtaggaaaaatggttgagtcgaatgatttaatttttttacaaatcacacaatacttgcatgaaatagcaacaggtgcgaacctcctaggcagataggagtgcagtgctttgtttcacagataccatcaagcctaacctttattgtgggcttactatgtgtcaggcctgttctaggatcttgttaatgaactgattcatttttttctcataacaacatagaggggaaaagatcacatggggaaggcaccaggtccctggactttgcctcgcgtgctcctggcattttgtagagaggtaaggacttggttccttatggacttttaagctcatgattggtttggtctggtttcaattctcatcttcatgtatgctcttagaaataatctcattttaggagagaaattcagagtcaacacggaaactgaaaagctctagtactgcctgaagtctcagaataaagggtgccttcattttcacttttccaaataatctatgagagggacttttagtagatccgtaagatgtgatactaacatagtatctgcatattgtgaaaaatttataactgtatccataaaggttatttgactccattgcctcaaagtctatataattagaattccatgatgtcatctttgagctttaatatagcttaaaattatccttctgtaggttgtgtttctttctgaaacattttaaatttagaaaattaacttgttaaacttttttaagttaaatctttagatttttttttattcaccctgctgtgggggagtcagaatgacaaatgcttgaatcatcaaagtcaaatgttagggcattttagcccctctgggaaagctaaggtctccatggcccaagaatctaactctacttatggggatgatgatctcacatgatctcatgatctctgtgttttgccaacattccttcttggcaggacttaggagtgcagatgggccccagagagcatgccttgctcaagccaggtccccctcctgctgccactttgggtggctggaaaaacctcacaaagggtgcagtgtctgcggttgggagactggtctcaattttcctccatcacctgctcataaactctcatgggtttctgggtcacagtgcagccctaggtcaatcttccaaaagctgatttgctgaatttcatgtgaattgactagcttcatgtcagcattttagggaacatttgattggtcttcatgcctgctttctgcctttgcaggctgagaaacaatgaggggagagaatgagggacagagagaggaggggactgaggggccaaggaggttccgatgagcaaaaatggaagagaaagaacgtcagagaggaggctattgggggatgaggagagagaccagagatcaagaagcatgaaggtattgagggccagagaggggacttctagggacatggagaggctgcaggacagagaaagggctaggggaacgggacagtggttctttcatttcaatgatcaaagttcccagctttttgacaccacaggggcaccctgacaattctggcaataagaacatgaaaggcctggtctttatttcactcaattcctgctatgtgtggtgagtgtgggtgagccaaggggaaggtgatcctattgtcaggaggtaatttaccatgaataggggatgatatggaaataatgtgtgtgatccttcccctgccactgttgggatgtctttttaatttccttccctcatttgtcacagccgtgaaaatactttttctgatatgatgaatgacagatggcagggtgccggcagcccttctggagggatgggaggttgtgtgtgtccacgataggggcccaataagtactggctgaatgagaaaatgaggagcctcactgtgggctttctttggggtgaatggaggtgctgagtgacctctcagcttcctagaagtcacaggccagaagccgtggaatctcagtggtggaaagtcctactgatttgaggatcagggagggagagaatcagcaatggtgtgctgataaatgtttagtagttggctctctggtaaaaaagaaaaagaaaaagaaaaagaaaacaaaaacaaaacaaaacaaaaaaaacaaacaatgaacaaccctggtatgcagtgcttgccactggtcagtttccatggtcagtttctcaccatgggcaatttcatgtgccatcactgaacacagagtagggaagagatccacgccattggctcacaagctggccctaccacaccaccaggaggaatatatattgggcaacgactaatagcaatagaaaaactcatgcttctttctcctggcatgacttcatgtatatgacatacatcctctcattttatgcttgtagcaactctgaaacctaagatttatttcctcattgcaggtggggaagccaaagctcagaggggttaaataatgtttctgttattgtacagcaaatcagtggcagagtggattctaagattcgtgccttctctactcacttcactgggctgtcagaggttaagggaagagttacataagccacctctgattattagagaatgacagggctggctaattctgcctggatagtattgaagaggagcttcattcaggggcaccgctttgctaaagagaccacccaaagaatgagtagttttgagtcaccaggtaccctgaagtggtacctgaaggtacagctggtatgatggatgacagatgccggtaccttgctgtcatccatcatatcagttgtcagttaccaggtagacctagcggtaaagggtaagttatatctcttgcctaaatgtcagtttcctcatctgtaaaatgggaccctgaaagtctactttagagggctatagggttgttaagatttaatgagttaagtccataaagaacctaacgtagtgtcagacacataatagatccagagaaatgctgattcttagcaggctaactttttctttttgaattcctctttaggccagaactgactagtataggcttttcaaactttagcgtgcagaagaatcacctgtggatctaattaagatgcaggttgtgatccagtaggtctggggaggggccgggcctggaatcctacatttctaacaagctgccagatggtgctgattctgctagtccatagatcacacgttttctttcattctttctttgtctttgtcttttttttttttgagacagggtcttgtgccgtcatccaggctgaagtgcagtggtgtgatctcagctcactgcaacctccaccttctaggcttaagcgattctcttgccttagcctcccaagtagctgggattacaggcatatgcaaccactgctggctaatttttgtatttttagtagagacggggttttaccatgttggccaggctggtctcgaacttctgatctcaaacgatccacctgccttggcctcccaaagcgctggcattacaggcgtgagccaccatgcccagcccatggatcacactttgagtagcaaggggctaagggatcctgacatagcattttggggtcctgcagcttcaacttactctgctgcctgttcccatgacctctaagactgctcttctcgagacagcatccttgttctgcactggttcctttggagcagctgctcagccctgctaaaggcatcttgctcagtgcaatattagtttgctgcggaagatctgggacctgggctcctctcctcattctccttgatcttagttttggttctgccaggactttgctgggcaatctttgtcatgtcctttcccctttttagattcaatttcttgatttgcaaaacaagacagtaggagagagtcactttctagtttaggcattctgaagttctgtgaatctgtgataccagctggttggtgcattttcctgccaggccataagcagtacttgcctttatttctgggctccagtgggggtcttcagagatacatagatgcatatagtcaggacaagagttaggaggagtaaaggtaagggttcaatccaaaccttttggaatagtaacagggtggcccagagagatgaagaatgattggggcacaggaatcttcttgctttggggcctaaacgacatctccagggaatggctactcattgggcacatatgagccaggcactgtgccaagagctaatgggagacacttgtcattctttctggccacacactctggagccgctttttttttttttttttttaatatttgtgaattcgccacctcataaacccatgtctctttaatgcacaactcagaaacccactcgcccaacctcccttgcagctagagcacagacatgtgacctaggatctgtcaatcaggtgagtccttgctggactctgaattggtggctagaagcagcagacactgtgtttgatctgttctggagggggaggtgttaagtatgtccagactgcagagtcagctatggtggggcttctagcaagatctgtcccttgtgaatgttgaatattcacagcatctgtagtgcagattgcctggtctggactctggagtggtggcagcgggttctgtactgtggtcaagatgtttcttctggctttctaaatgtgtcctaattggattctcagggcctcccaaagcttgtctttcctggttaaactggttagagtgggcttccatgtttataaataagaatcttgactgcttacaacactttatgtgtgttatctcattgaattctttttttaatttttgagatggagtcttgctctgttgcccaggctggagtgcagtggtgcgatcttggctcactgcaacctccacctccagggttcaagcgagtctcatgccgcagcctcccaggtagctgggattacaggcacacagcaccatgcctggctaatttttgtatttttagtagagactaataaggttcaccatgttggccaggctggtctcaaactcctgacctcaagtgatccacctgccttggcctcccaaagtgctgggattacaggtgtgagccaccgtgcctggccctccttgaattctcacagtaacctagtgaggtaggtgttattatcctcttcttgtaactgaagaaactgagtcaagaagagatgaactaacttgctcaaggttccactgtcgataagtggaggcccaggatttgagtccagatcctctggttccaaagcacacattcttaaccaccatgcatctcctgtcagagatttgtgggtgtggaaaggtccttgcaaatcacttgtcagtagtacagggtttcatgagatctacacctgggctgggcacgcctgttggttttttactgacaacgcataatttttcgaggagtggtaatcagaggcaaccgttctagtgacagtgattcaggcgtaaacacttggctttggcccagaggttgcactgtgtgagaccacaggtgaacactagaatgtttacactcttccggagtctgtaggtggatgccagggacagagaatgagattgtaacccagagaaagaaagaaaagaaagaacgaacaaacaaaagaaagaaagaacgaacgaatggacaaaagaaagaacgaatgaaagaaagggccagcccctggggcctccttagataaggaagagaaaggagaccttgcctcaagctcagaaactggttaaaacacgagcccagtcacctagtgataagcagtgcttggttctattaactctgacaacatagtactatcttgggcagagctctttggagaagcaggttggctaactggccaacctcagttgattctcatggtcttggaactttcctgggggtccaacttcctccgttctgcccctcttttttctctaccttctatcgttttattctttgtctcctttatttttcttcaacaaatatttttgagcacctattgttaacaattcaaccaatatttattgggtgtttgctcggtgccacttacagttctaagtgctggagatacagcagtgaactagccagacaagctgtcatagagtttccaatttagtggcagtggggtagtccagtaggcatgaagccaggcaggtaccagttgttgaggtggtggtagttccacccagtactaggaagataacattcttatccccattttacagatgaagacactgaggcaagagagcttaaattaattgcctgaggtctcacaggtaggctgggatctctgtgagatctaggagtgccagagccacttgggtccagccacccacacctcttccctgtgcctcaggctgggatgacacccagagcctctcctttctccctcacctgggcccagagaccacctccttccctctccttgcattgctgctgcccatgctaaccgaaggagcctcgccgtggggcggatgtggcctccccagtggcccacttcctcctgcttctgccaacagcagcattggcccctatgatttgaattttttttttttttttttttttttttctgttgatccctctagcggcaccagatgtgggtggggtggagggtgggtacacccacactcccttaagcctggaagtaacctaggttccagactctgtgtgtccctgaatggtaatagtgactctcttcttagctgtctgtcccactgggtcctcccactccccaactggtgctcctgcttttcctcagaatgggggacataaatctccttctagtcccaacccattgtcaggcagggcttcctcctggagggctgacttcccaggactgggccagctaaaagctaagcagtatgggtaagagcacggggttctggagtcagacagacctaagttcaaaccccagtactgccgtggacaagctgtgtggcctcagacaagttgattaacctctctgagttccttttaaaataggctgaggtctgtagggataaggtacctgaggtcttagtgcctggcacagagtaaacccacgtgttggctgtttccattattgggtagaacagaggggcctcctggcatcagtgggcattttgggcctgctgctgtcttgtctatctaggccttggttttgcctttcaggctggtgcctctttgcagtttcactttagcaagtgaaactttatttttcctgtttctcctgatctgtttcctccttattttccatagtgaataatcacacataagcctttcttttctcagggcaaggttgctgtctgtgaaggagtggaatgcctgagcatccctggtaggaaaggaagagtgaccagcatcaatggggtactctattccctgagtagcaagccctcttcccgccttgtccctggctcccacacctgttatcctgccggcagtcatctccagtatcccagaggagccatagggatgggtgtttgaatataagaacactctgcagctcagatatgcggcattacttttcctgtttgactcagttctgcagagggttgctgagtgactgtcatgtgcaaagcacgtgggaggaaagatgaataatgagagcaatcgaatgcccattcccttgcatccagggtgctctactagacctgcgttcttccatcattctttcagcccacgtggttgccaatactgggagttatcagtcttttccatttttgccaatctaatggataaaatatcttgtattaatttgcatttcccagatattcatgagattaggcatacgctttttgggcacttgtatttttttctctgggaattccctcttcgtattactttgtcaatttttctagtggcttttttatttgagacagggtcttcctctgtcacccaggctggggtacagtgtccagatcacagctcactgtaacctcaactccagtgatcttcccaccttagcctccctagtaaatgggactacaggcacacaccactatgccaggctttttttttttttttttttgtagagacagggttttgccatgttgcccaggctggtcttaaactcctgggatcaactcatcctcccaacttagcctcccaaggtgctgagattacaggcatgagccactgcacctggtcccctgtctttttttttttaattaattgatagtaactctttatatattctagatgccaatccgtgatttagtctaaaaataaatccccttggtctgtcctatgtcttttcttttggtttatgaaatcttttgtaatacaggaacgtcacacttccacagtcaaatgtgtcagtcttctaaatagatataggtaccttgtatatactccttgatatatcacattgattggtggtgacctgtttgtctccctggctgtcagactgtgagaaacttgagggcaggggctgtactttattcttctctgtctctctagggactagtgcaaagctgggcacagagttttgtgcctgaatgagttttttttgtgtgtaaacgtggtataaaacaggtcttgtgactgaatgagggaatgaatgaaaaagccctgtcctgccctccctgcagagatggggtctgctgcagagatgggagtgagtcagggagtgaatcacaagctcttccgtggctcagctgacatttcaaaagccctgagcagagaagcccccctcattccaagagagcctccgcctctttgagcaggcacagtgaagctctgctgattatcaaactctgtgtgtgtatgtgcacgcacgtcaggggtttagcagttaaaactcttagtgctgcatattctgcgtatgtgtgaacaaggctttaaaaaatctctcagaggacctgtgtatgtgtgtgggtgctgggggctgcatagagagagagttaaaagagatgagggggtgtttagaatcgttgcaatgtattgcatttgtttctgggagggtggggcgactggagggggttaaatagctcccagaggcgctcttgtgagcggagcttcctgaaatctctttatctgtggccacatgctgttcttggttgtccacgtggttccctggtgtccctgttgctgaaggcacttctgttttgttcttggaggcttggcttctcattgccattttctaaagcagtagagagtgccagttagattgttagacccaaataatctgaaatgtgtgaaaaaatagtaaatatttactgtaccttttgtggaacaggttattgccatggaaatgcactgtacacgaatctggatgatggagggaagctggctcaggagctatgggagtgtttggataccatgccgcctgaattggcaggtttaggagtgagtgccgtgggtttagaatcacagtgtggttgggtgaggctgaaacacttggtccccagtcaacctgtactgagaggggcatttattcattgcttcccacatgcagggtgcttcctagagcattctccatgcattattgcgtttaatcatcatgccaccccaatgaggtgccattatcctccctgttttacggagacacagagtgtttgatctacttgcttgaaggtacgcagtcaatgaatggcagagccccctgactctgttctctggagcttgatccttccctgctcagctgtttctctcactgtgatttaccctagagaaagctaaccagctgtctaccggggttttattttccaatattgacttcggggctgacatttagaaaccatcaacaatttccagcttctcttgaaaatgtgcacaatctggctactgtgtggggcttccctagtggctgctcccgagcagccatccaggttagccgggcatcagctctgcagttggcgctgggcatcctcctgttgcagctggggagaaagcatggggtatcacacccaggggctccttgaattaattgagaactgtctgttgagagctcctcatcctgttagacttgacatttaatttagctgttgttttcatttgccaattagagcttttgagattcttttgattttcttcctgtggtctcaaggaatttgtgggtggttgagtgaagatcttcatggcaggaaaggaaggctgcaacaggagatgtaatgcgtgagcacattcattcattcattcattcatttacttgtttattcatttgttcaacatattcattgagtattggatgttgaagttacaacagtggaagtatggcaataaataagacagacccagtcactgctctcaaggagcatatagtcaaagagggcagtcagacatcaactatgatgcacgttacagggaaggcatccatcttttttttttttctgtgtcacccaggctggaatgcagtgatgtgatctcagctcactgcaacctctgcctcccgggttcaagcgattctcctgcctcagccttccaagtagctgagattacaggcacccaccaccatgcccggctaatttttttttaaattttattattattatattttaagttttagggtacatgtgcacaatgtgcaggtttgttacatatgtatacatgtgccatgtagtagagacggggtttcatcatgttgaccaggctggtcttgaactcctgacctcaggtgatctgcccaccttggcctctcaaagtgctgggattacaggcatgagacaccacgcctgaccagggaaggcatcgatcttagactgacttagtggtgtctaggtctctgaaggaggtgtcagagaaggtctccttggctaatctttgtgaccaccggagctctgttagtttcataagacataagtctcagcaactgttgcagaaagacccttcctcagtaaggatgatgggctcctcgggctcttgcccttcccgtcctgggaggaaccttctatcaagagccatggctagtcatttcatccattgggaatgagcttactggctccatttatgagagttagtttagactgaggagtaaaggaggagtgaaggagtttgggagttgtcagtgataagcatgcacatttggagttgacaggacagcatggacactagagcctgaacaccttagttcagcttagctgcactgcctattatgtgatactgggctggtttcttaactgttctatgcctcagtttccccatctgaagttgggaataaaatactcatctcatagggttattgtgaagagtaaatgagtcaagctgggtgtagcggctcatgcctgtaatcccagcactttggaaggccgaagtgggtggatggcttgaggtcaggagtttgagaacagtctggacaacacgatgaaaccctgtctctactaaaactacagaacattagctgggattacacatatgcaggtgtgtaatcccatgaaacacatttcaaataattgctaaaatttttcaagctgtggcataagagacaacagtcctgaagaggactgaaaggtcttgggatgcaggggagcttaatgtattaaaaggtgacattttggatcagtagggaaaaaattacacacaggtgtgtgtgtaatcccagctacttgggaggttgaggcacgacaatcacttgaatctgggaggtggaggttgtagtgagccaagatggcaccactgcactccagcctgggcgagcgagactgtctcaaacacacacacatgcacacacacacacacacacacagccaggcaaaggatgaagagaagcagttaataaatgtgagccattcacgtgtgtattatgattatcacgtgatatcagccagtcctgcttgagactcacttttccgacagttctttcttcggtggactgtacccatgcccctgtgtgccatatatttgtgatttccagccttcctttctgataacttcaattcattgctcttcccaggcaagtccttcaatggttatggggtgccgcgcttgccctcatccccagctgagtgttctgcgtttggggacttgtgtttataagtgtgggaggctgtcccctgggggttactgcccagacagttagggttgtccataataacagaaaagtgcatggagagagaaggtgcaggtccgcctatttgatgttgggtaggatgtgctgcttgatgaccggtgaaacatttacttctcccaccatgggcgagaccttggatgtgtcctttacctctctctttgtcacttctgtcctgaactgcccatgagtgaccaggggcttccgacagaagtgtctcacaatccaaccacacagcagaaaggcattttcctttggatttgagctttgtccctgcactgactttttgtgtcatctcctcttcattcaatgtgagatactcaccttgattcatagaatgttttctcattccaggtttgtatttttttaatcaccaaaagaagcacttatcataaaagactgtgatgatgtataactgtgtatttagtttgaaaatcttcaccttatagaagcaataaacaatatttaggtgtattatcctgtgaaatttttataaatataagactttattacgaataaacaaaaaaagagatcatatcctatatactttttttataattttttttgagagagggccttgctgtgtcatctaggctgaagtgcagtggtgtgatctcagctcactgcaacctccacctccagggctcaatcctcccacctcagactctcaagtagctgggactacaggcacgcgccaccacgtccagctaatttttgtaatattttttttttgtagagatggggttttgccctgttgcccaggctagtaactttttcccttattaataccttatttagatccaccttatgttttaaatggctgcagagtgtttcataatatggccaccatattatttacattcatatttataatttgtctaaaacattagcaataggcatttggattatttccaagttttctctataatgaacagtgcaacagtgaacactcttgggcactgtagtggggatttccatagaacaattcttagaaatggggtgtttagggcaaaggatattaacatttttagttgtaatagatattgctaaattgctctcaaatgttgtgccaatttatgcacccaccaacagcgcacgaaagtgcctcttagaaaatgtcttttagaagataaaatacctattgttaagccatgaaacacatttcaaataattgctaaaatttttctagctgtggcataagagacaagagtcctgaggaggactgaaaggtcttgggatgcaggggagcttaatgtattaaaaggtgacattttggatcagtaggaaaaaaaatggcttatttaatacatggtgctggcataattgggaggccatgtggaaggatgctgagtttgattcctaactcatacaaaaataaattacaggtggagtaagctataggcagtaaaaaaaaaaaaaaaaaaaaaaaaaaagaatattagaggaagttttaggagcatacttctgtaaccttgagtgagggaaatccagaagccataaagaaaaagattagacagtttcaattatgtaaaaataatttaatcttttaaaaggagaatgtattcatgaattgcttatgtaataagaaagactattaaaaataggtccagtagataatgtacaatggtttccaatgtgaataaagttgaagttaataaagaaaagaaagttttaggacatgtcagggagtttttgttcaaggattgagattctgcaatgtttattctaaataaagatgaatgatagactagtgcacatgtagtaaactagtaaatgtgtagcccataaaccttgtaagccctggaagggtaaagaaaaagggaaggaaatgttgttttctgcctctttattttttgttgttttgagaaagttgagtacccacccaaagccccaggtgtcccaggagagagaagattgaaaacatgccatcaaaacaggagcttcagcctcagccacaagctccagtgtttactgggggccagtgcccttattcccacgtgaagcatctgccttttttgcccccttgaagtctgagtctctcgtctgttcctggagatttttagccaagcccctcctccccacccctcaccttagtatttgtaccaccctctgaatcaaccccaaagacacccctttgtactcttcccttcatctggccatcaccagggtactgtggtcattgaagctgagtgtgtgccctcactttccgtaaactcacagttcctttattctgcaccttcagggattgcaaatcgttaagggtatgccttcaaataccagccctctgacttcctagctcaataacctcacacagctctatatctcagtttcctcatctgaaaaacagtcatgaaatggcaccacctcctagcattaatgtgaagattgttattattatgtgttattaattattattatgttatcctattaatatatgagacagaatctcactctgttgcccaggctggagtgcagtggcacaatcttggctcactgcaacctctgcttcccaagttcaagggattctcctgcctcagcctcctgagtagctgggattacaggtgtgtgccaccacgcctggctaatttttgtatttttagtagagacagggtttcgccatgttggccagggtggtcttgaactcctgatctcaggtgatctgcccaccttggcctcccaaagtactgggattacaagtgtgagccactgcgcctggcctatcttattattattattattattactttttgagatgggatctcactctgtcacccaggtgggagtgcagcagtgcaatctcagctcactgcaatgtctgcctcctgggttcaagcgattcttctgcctcagcctcctgagtagctgggaccacaggcacccaccaccatgcccggctaatttttgcatttttagtagagatggggtgtcaccatattggccaggctgatctcgaactcctgacctcgtgatccacccacctcggcctcccaatgtgctgggattacaggtgtgagccactgcgcccagcctctttttattattatacttagcacggcacttggcacttaggaaatgttcagtatatgttagctattattggctactgttatttcttcttcttctcctcctcctcttcttctttctcctcttattcctcctcctcccccactcccttccaccccctcttcttattcctcctccttctcctcattattattttaagtacctccttaccaatgcctacagaaatagactgacctagtaccaggatctagaggagttcaatcaagttcgtctgttgccttcaaggtaacagcgtagtggtggttccgagccagatgccagacccagtctgcctttgttcaaatcctggttttacacttaatactgtaggtacctcgggcaagttacctaacatttcttcacctcaatttctccatttgtaaaatgtatataatgatagtacctaccacgcatggttgttaggaagattaaatcaattaatatttgtaaagtagagcagccggctcattgtaagtattgggagtattggttaaaataattacaaaataaacaatctcacttagatacatcccttaccccctgtggattatgtcaagggtgaaagaaacagtgtgcttgaaatcctgctgtgcgccgagctgtatatcagaggtgttatggtgattcgtcatcattctcctgaccactttccatttttcttttagagtcaacactggccaatctttagggaggagctctgatcattgagaaactgacactgtggaagggggcatttctgactctctcttcctagctccatttgatcttcctaaatctttcaataatgtgtcattggggtaggaccaaagaaaaacggggtgaatgtacggttgctgctttgtttcccatagtgggagtgactctgatgtttcacaaaggcaggggtggagaggcagcgcctcgcaggaaagccttcttgctaaatcgaggacttctgcacagaaatagatacaaacttgcttactgtttaaatagaatattagcgattatcttttatccagctggagtctcctcggtttggtactgcctcaaatgagcagcctgcaatcttgggtgtcacttcctcactggttctgctttccataactgtgttgaaatcactcccccagaaggtcaccaaaagggaaaatattagtgtgtgtttattggcacgatcttgcaggtgctgggctaagtgtagacatgatttattttcatttaatcttcaaggtagttctaggcgatgtccccccactttgcagatggggacactgatgtgcaggaaatgaagtgacatgctgtagcactgttggtgctctgctgtgtcccctcacccttccatttcattgcattctggcctggcttccaatgggcagcaactgcagctgttcacctgagggcttgctctgccgtagtccattcggtccataggcatgtcaggctgtggaagcacaggaggagaggtgagggatggtgcaggagagaggagaggatgattaatgtcccccagggcccatcctcaaccaatgacttatgggaaacaacctcctagagttgtattaagctccagtgacccagaatggtaacaagctcacaaacacttccttttttaaaaaatttcacaaaaatactttattatacccatacctccttgttttagcccatcccagtacggtggtatcttcagaacacttccactttcccctctcctcacctcttccctcccacccttgagatgtaatctttggaccacttttacttctttgctttctctcagcaccctttctcccctactctatggtgactttgtgtttttgaattgaagtcgtttcatgtctgtgtcttttttttttcttcaactgttattttaagttctagggtacatgtgcaggatgtgcagatttgttacataggtaaacacgtgccatggtggtttgctgcacagatcgacccatcacctaggtattaagcccagcatccattagctattcttcctgatgctctccctcttccctccccactctgacatggcccagtgtgtgtcattccccaccaccaaatgtccatgtgttctcattattcagcgcccacttataagtgagaacatgcagtaaaacactgcctttataggcttccttcccttcactgtcttacttccccactccctactgctgctctctgggatcacctctcacagaagctgtttgtactttaatcattgtctgagagtctggggtatcccaaactaagataattgcccaaggtcttagctaaattcaacagccctatttgtctttatcctccttgtggcaatgccactactaatggatgtcccttcttaaaattcttccccattttggcttttgtgacacgtaatagaattcttctacttctgattatttctttcctttttcattaattggcagctctttctttttaaaaaaatttgctagatttttgcttatttttttttttaagaaatgaggtctcattatgttgcgcagactggccttggaatcctaggctcaagcgatcctcccatctcgtcctccgaagtgctgggattacaggcgtgagccactgtgcccatctttcttttcctttctttagccacccagttttaggtacctccagtatcccagtattttagttgtaagtgacagaaaatctgactcaaattggtttatgtataacaaaatgtaagttattggatcacatacttgggaatcttaggataggtggcttcagggaagatatgatcaaggtgttcagcaatctgattctctctccatcatgattcagctttcctctgtattgcttgattctcaggcatgtgcttgactaatgaggcaacaacaacttgcaggtccaatcttatcttcatcaatggtatcttaactacatcagtggtataggactgcttctttccttagagtcccactgtaagttttgggtttcattctcattggcctgtgttgagtgatgtatacatttctaaaccaatcacagttgccacggagatgtaatacaggttgagcatctcttatccaaaatgcttgggaccagaagcatttctgagtgtggattttttttttcttcagattttgaactatttgcattttacttgccagttgagcatcccaaatccaaaaagttaaaatccaaaatgctccaatgagcctttccttggagcatcatgtcagtgctcaaaaggttttgggttttggagcatttcacattttgggttcctggatttggggtgccctcatttcccaggctgggtcacataatcacccttggagctaaggttagagttgagccctactccataaggactgagagtggggagaggtgatttcgcaaaggaaagtcaaagtgctgtcacatgaggggatgggtactggagaggcaaaaacaacagatgttcatactccgcatctctgggttcatttatctgctcttctctttctctgtgaatcatctgatgatttccactcctgcctgcctgagtaggactctgaaactcctgcctccagatctgactccacttctgagttgtagcctcctttcccccaccctctagagttaggcatttccatttggtggtgccatgcagacctgaaactcagtgtgccacaaccctcgccacctcccacctggtttcgctccctaacgtccctgtctttgtcagtggtgccagttgggtttccatctctccctcatccgtcccaacccccacctaatttccagccccattgtgctgcttttgattccttgaatgcacctttgcaatgcttttccttggtttgtaaccctctttagcatattcttggtttggtgaacccctggccatatttagatatcagctcagaattcacttatttgggaacctctaacctggtcacccatctctgccaagcctgagttagatgctctttccctgagttctactaggccttcatctcgtctaccacagcacttctcactcagactccaatgactggctccattgcctgccttccccgtaagggcaggggcacatctgtgtaattcaccattgtatcttcagcagtccagcctgacaattgagtctaggctggtgtccaacaaaccagtctttgttttttttttcttttattttaattttgatagttttgggggagcaagtggtttttttggttacatggataagttctttcatggtgatttctgagattttggtgcacccatcactgtaacagtatatgtggtatccaatatgtagtcttttattcttcaccccctcccaccattccccggagtcctcaaagtccattatatcactcttatgcttttgcatcctcatagcttagcttcatttacaagtgagaatatatggtatttggttttccagtcctgagttacttcccttagaacaatggcctccaacttcatccaaggtgctgcaaaggccattatttcgttccgttttatggctgagtagtattccatcatgtatgtgtaccacattttctttatccactagagataaaccaggttttgaattcaggatccacctctcctgagctgtgagcacatgggcaagtttcctcaccagtccaagcctgttttctcatctctaaaatggagacaatgacggttcctccctcactgagcacttgtgagaagtaagtggtgatcacggttacaaagtgttcagcacagtgcctggaacacggtaagcgttcaatcagtgccaatgatcatttattatactcactatgaacattatttttacctcatgcagtgtctagaacataatcaactctcaacaaatgacagctcttattattagccaagaatggaacctgaaacatagtacgctccatggatcattgaagctttgtttttgaaagtttgaaattaacaaaaagagcctttgatgtttcccttgctgcacattcttcccctccaggtggagtgggcagtttccactgggtgctggaaccaaccctcctgtagttggaggtgatcttctctgatgtcactagggtgccgaggtgatgtgtcaccagcacttgtttgcttgtgtgatgtaatgagggtggacttgcttctcctagggaagagcctcattaaggttagcaaggggcttgttcctgggaagttctaaggaccgcctggggctgccacataaggaactccccttttctcattttgtctccggtaagttgttattgatctgtacatgatgtttctctttcttaccagccgtgggaatgggccatcctctggcatcactgttgccttgaacgttaccatcaccaccgttgccatgaagtcatgacagcagcaccattggctctggtttattgggtgtctaccatggacagtagtagggctagacatttagtatactccagggctactgcggggattaaatgaggtatgaagcatctataaccccacggtccaatagggtagccactagccatgtgtgcctactgagatatacattttaattaaagttaaataaagaaaaaattcaatttatcatgcacagtagccacatttcaagtgctcagtatgtgctcatggctgatgtagctggcagtgaagatggggaacattgtcatcatcacagaaaattcttccacagcgctgatctagatagaacaggattcagtccgctgtggcttgtggatccatggactgaattcatacacacagaattttgtgggaacacagctgtgcctgtttgtttatgccttatctatggctgcctttgcgctacaaggatggaattgagtagttgtgacagagaccatgtggcctgcaaaacctaaaatactcagtctcttatccttgaagaaaaagtttgtcagcctctggtctagaacattgcctggctcttggtaaggttaaatacatgtttggaactttttatttattgaaaataatatacattttgttctccacctaaccttttaaggtaagtattgttatccctgtcctagagatgagaaaactgggactggaattctgtactgtcacttccagggggcaaacacctcatgaggttttttttttttttttggcagtcttgctctgtctcccaggctggactgcagtgtcgcgatctcagctcactgcagcctctgcctcctggggttcaagtgattctcctgcttcagcctccccagtagctgggattataggtacctgccccctctccccgctaattcttgtatttttagtagagatagggtttcatcatgttggccaggctggtcttgaattcctgacctcaagtgatccacccgccttggcctcccaaagtgctgggattacaggtgtgagctaccatgcctggtctcatgagtcttgttcatcacttacctccttttgttcttccagcttcagtttcaggttcagggggtacatgtacaggtttgttacatgggtaaattgcatgtccctggagtttggtgtactaatgatttcatcacccaggtagtgagcatagtacctgatagtagtttttgatcctcaccttccaccctcaaggaggtctcagtgtctgttgttcccttctttgtgtcatgagtgcctgatgtttagctcccacttataagtgagaatatgcagcatttggttttctgttcctgtattaactcacttaggatagtggcctccagctgcgtccatgttgcagcaaagagcatggtttcattcttttttatgcctgcatagtattccatggtgtttatataccacattttctttatcccatgcaccgtggatgggcacctccgttgatttcttgtctttgctattgcatcacttactcttgaatctggagcagtgcctagcacataatagacattcaggacatgtttgttgagcaatgaatggatgagttaggaatcaattacatataaatcaataatcaataatcatcaatgatgaatttctatgaacaaatatgaaaattagatcggccgcattgtagagatgaggagacagccctgtagaaggaaagtgcctcatcaaaatgcaacatcgctgtgaaagtgtagacttggagctccagctgaagtcatctgtgtattttctaagctgtcccctctaccatcctgccttctccgggagctgccaaagtgcagcgctgatgcctcctctctctgtcccacagcctgacttttgttcagctcctgcttctcttcttcaccaactgccagcttcagctgctttgtggcaccctggggcttgaagcttcatttctggtgctgtggcaccacaaagctctgccccagtgtcacttgagtccaagtagatcagccaagtttgaatgatctctctcttggccacttcagtctatgaagctggagttgagaccatctgtgattttacacattcgttacagcaaaaccaagagggccatggggtaagagggccattaagctagaggctgagcaaaactctgctcttgaagcaccttctgagatggcttctcatggaacgtctgcgcaaagtggcttcacatccaattaagtcaaagatgcattaaatgaatccagtttgtaactgcttccaaccatgaagtcacagttccatctcttgccctgggaggggcttctttcaggctctgaggactggagccctggagactttattgccttacggtttcctcctctaccatcagatgtttctttttcatgtgttctggcctggatttgaatagactgcctggatttgaatgctgccttcacctctttctggtgtgtaatcttggacaagttaccttctttctcagtgcctcagtttcctcttcagtacaataaggataataataagacctaccacatagctgtagagaggattaaaggagccaatatgtggaaagtatttacaacagtgtactgcatagtagcttttctataagtgattattattattatcccttcgaatctaaaatccctctagtttgtttcagaggagcaaggattgtgtctcgcctgcctttaaatccctttaagttgggtgtctcaagcccaaccatctgcaggagactagaaggggacttacatgagtgaattgaatcaggtgtggatttctgtgaactagagaatgcaaggctgtctgaaaggggaactattccttattcatgcatcacatatacactggtgtgccaagccctgttctgcatctggggacacagcagagaatgaaccgggcaaaattccctgcccccttggagttgatgttgtagtggactaagctctgatgactctgttgctgcatgagaatgtgggcccactgctgacaaaacttctgatttttctgtaagaaaagccggaaacctggatttgtaaaaaccgtgaactctcctagcttaagaattggcagtggtttccatttttttttttttttaaagcacagtacatgctgtgaacccaagagccagtttgcagcccctgccttaagacactcctctaattgctctgggaggaggcctgtctctgccctgcaaatcagcagctggtcggatttcaaggtcgttggtgtggagggcgcctcctccctctcctgcgtggaggttattgtggctttttctgcccacagagcagatgacgctgccaccaggcagtgagttagaatattccttctcttatccttccttttggatggtggccttggctgggttcccagccccctgacagcagaagacaaaaggatggaagcagcttcctcatagtcacccatgggggcgatagggtggtgatggtgatgtggagaaaatgcattgggtcaggacagccacctttgaagccagaaaattaatgatctctgttgcctgaatcttttcaaagtggagaagtaatttaaaagcttgtgtgggaaggattgagaatgggattgagaaaagaagtttaggttgctatcaggaacaattcctaacagcaggaggtttttggagaggcagtggtgaaattccttggaaatttttgtgtggtgtctttttttcttttttctttctttctttcctcttttttgtttttgtttttctttttttgagatagagtctcattctgtcacataggctggagtgcaatggcacaaccccggcccactgcaacctccacctcccaggttcaagagattctcctgcctcagcctcccgagtagctgggactacaggcacccgccaccatgcccagctaatttttgtatgtttagtagagacagggttttgccttgttggccaggttggccttgaactcctgacctcaagtgaggtccacctgccgtggccttccaaagtgtttggattataggcgtgagccactgcgccgggccttttatggtgtctttgaagtgcttgtttaaatttacatgtggttgcctctcagtggggtgcatgctctctggttttccccaagccccaccactccctgttgtgctttacccacttgcctgacttagttatgcttactggcctggcctttgtgggtctttgagtttgtgccttctgctctgaaggaagcatgcttgagatgatggaatctaggttcaaacctacctgccctatctgccctttactgacttgtgtgactgtggacaagttcctccacccctgaggttgtcaggaccctgcaggaaatagaaccattcaggtggctgcaagaagaaagtttcatgaaaggactatttagggagacttgggcaaggttaagattacaaataaggaatgtggaagcacctagggccttgcaacagcaggaggcggttaccgtctgtaaagaggaagaagcaagcggagggaatagtttggagcctattgagagctggggctaagaaggaaggcatcgccagcaggaaccatggtcctggagggatgaaccgcttcccaaatagcagtaccgaggcagggaggaagagggggaagaaacaccccagcttctcttcacctctcccattgcctgttggcctcacccactggctgaacccagctggaaaccagaaggaccagatgatgaattctgtaagggtcagccttttggggctcagctcacagcagaatcagagagaaaaaaatggatctgagaggtgaaacaaggaacaagcagcacgtaactctcagcttccctaccttgaaagtggaggagaatgagataactgaccttggaaggttattgggtggctcatgtactctcgaagggaagggcctggtcaatattaagtactcataaatgctgagattcagtgtgggtttcaaaccgtttctaggagctaaaggtcctgagaaagggcttcagtttcagtatcaagagacattctcaggtgggcagatctcttgaagccaggagttcgagaccagcctgcccatcatggtgagaccccatctctactaaaaatacaaaaattagctggatgtggtggtgggtgcctgtaatccaagctactcaggaggctgaggcaagtgaattgcttgaacctgggaggcggaggttgcagtgagctgagatcgcgccactgcactccagcctgggcgacagggtgagaccctgtctcaaaaaccaaaaccaaaaagacattctcctccttcccctgcagtggggcccactgggaatggttgcatcttccatggggagtttaaagtgaatgtgtagtggctaagagcaaagaccctagaaccaagtaggtggacactgtggtagtccatcagtgtggtagacactgatctttctgttactatagattaatggccttgtacagtatgcactattttgtgtctgccttctttcacttaaaataatgtttttgagactcacgcatgcatgtgcctgtattggagtctattgagagctggtttccagtcctgattgccactgacagtcaagttacttaacttttcatgccttattttctcatctgtaaaatgaggatgttagtagtttctacctcattgggttctgaggattaaaatgagttaatctacgtaaagagcttaacacagtgtctaacacatagtagacaatcaatagatgttagctattgtaattgccatcatcgtcatcatcatcatcattatcatcatcatcgtcaccatctccatggatcagctcaaatcaaaactgacccattgtcaatagaaaaattctctgtgggatgaagtccatgccaccaggcctctcgggaacttcattgatcataccattatcttctcatcctcccacagatatgatatttcagggagtgattgataggtgtgtgtgtgtgtacgtggggaagggtgggcttgtgcctgactccagggacagagtgctttgttatgcagaatagcttgcctgtcatcccactacaggccccttccttgaaaagttccaggctatttttgagccctcatggctcacatgttcctttctacatcatgtcaatgccagtacagaaaaattgaaaccttttggcagcatctaaagcaaaagagatttcaaagtgcatggaggatgagtgttgctcaaatgacagggtattaaaacgtgacaagaaggctgagttaagagactgcaggcagcttgtgtgtttgtatttggaccttgctggatttcttgggaaatcagtggagttgtccaaggttaatgtcatctccaagaaggcaccaaagggtagtaacactccttcaccctcatttgtacatacactctgcaagagcggaagatgatgcagccagtggagtgggcggttgtcccagagcaccacctgggctctgagctacaggattctgcaggggaaagcacctgaggacagagtgaggtgggttggtgccacctgggagctccaggcttttgtgtgctgatgtgcaggcagatactggagccagaccgaattgtgtgcgaaatgtgggtctaagagtgaaggcaccaaaccctcactttttttactttcattcagccttcccatttttcttcaaagggcagaatatgactttggagtcaggtagacctgaattcaaatccctcttcttcttcagtgagtagctaaatctttccaatgctttatttaaaaggaatcacgatcacactttcagggttgttgagaggtttagagattgtggtgttacagggcccctggggctcaaaaggtgtttgctgaacccctgtcttgtgttaaatagtcacaatagtcccaaggggaggatgaacaggtagcactgccatttcataaacaggtgactgaggtgcagagtggcttatccataatgacacaggaggtgaatgctggagctggattgaaggctgagtcattggactctcctctgagggaggcagtacagagtagtggtcagggcttgaccaacctctagagtccatgggcagattttctgggcctctggcttagttttcctcatgcataaatggaatgtggggattatagtagatgtactttctatggttgtgaaggttacatatacatgagataattctataaattcttagcatgtgcttgagttacagtaaatatgcaatgaagtattcactactgttttagtattatttttattagaagccgtggcagtagttaccatcattgtcaccatctccatcgatcagctctaatcaaaactgacccattgtcaacagaaaaattccctgtggatgaagtacatgttgtaggtgtagcgggcaatcgtgatcgccatcagaaattcatattggggtttggtttacaagtgttggcctctgggagtgtttcctacgtgctccttctctcctcccctttgaggacggatggtgtgatggttcctctccatttggtccctcctctgggaccagcattctcctgccttctttgtcctactctgtgtcccaggaggtagacccctgtggactgtatctcctggactcccttgctggttgacttttgtctgagttaagccaaagggaggtggcagcaagagacgagaaggtgggaggagagagagtttggggtatttccacctgcagctccctctgtccatctctggccccgctctgtgatgctagcccccgcgaggttgcccatctctcagggtttcctctcttacttgcccctgttacgtcatttcatgggactatacctttagctttaggtgcagaacagttttccacagttaaatgtctttaattgaacatctagaatgcaaaacatattataagataatgtgttggattgttttcctttaaaaaatggtacaaccactttgcaaaacaatggcagtttcttattaagttaaacatagagttacagtatgatacagcaattccactcctaggtatttatccaagaggaattaaattgtatgcccacacaaaaaatgaatgaataaattaagacttataaatgaatgttcatagcagctttattcataataaccagatactgttaaaaaaaccccagaatattgatcagtagatgaatggataagcaaactttagaataatcatataatggaatattattcagcagtaaagatgaactaactgctaatacagacacgtgcatgcgcgagtctcaaaaacattattttaagtgaaagaaggcagacacaaaatagtgcatactgtacgaggccattaatctatatagtaacagaaagtggatcagtgtctaccacaggctgggggtgtgtacagggaaactttttaggtggtgcccatgctctgtatctcaattttggtggtacatgcgtataatacatttgtattgtcttgtatcaaagtatgcctcatgaagttcaggtatatgaaaatttgtatttgctttattatatttaaatatcagagaatgcaaaattgtaaaaagaaaaagaaatcctgaaagtccttttaactagagacaaccaccaccatccacattttatctatttcctttcagtttttaattttttcctgtacttaggttttccccttcactgtcttatttaaataaaaaagaaagcaaatggaaagtctcccatacgaaggcctttttgctatgagtttaccttgtctaagggcatctagcatgatggtgagaaggttttgtcttgtataactaaaatgtattgggaggaaatgaaaatgtttagcctggtgaaggggaaacattggggagaaaagtgagggagagtgtggtctacagtcgtgagctttaaatcacaaccaatcagccaattaaatactgagctcctgttatgtgtcagtattaggaagacagtagtgaacaaaacatatggctcctctgatttaatggagttaacagtctgggagggaaagatatttttattatttgcaacaacaatagtaatagctaatatttatgatgagctagtgcctattatggtgttaaggtttagttttttcttttagtgtttttaatgtgttgtcacatttaatcccagcaactccatgagtaggtactcttaattctcatttcatggttgaaaataataaagtggcttggagatgttaagtcaaatggggtcatacagtgagcatgttaaacctagactggcaggtcaggacggaagtgatatttaatcctcagtgaaatgatttttttctttttaatttttatttttattgagacagaatctcactctgttgcccaggctggagtgcagtggcacaatcttggctcactgcaaccttcacctcccgggttcaagcaattctcctgcatcagcctcccaagtagctgggattacaagcacccgccaccacgcccggctaatttttgtatttttagtagagatggggatttcaccatgttagccaggctggtttctaactcctgacctcaggtgattcacctgcctcggcctctcaaagtgctgggattacaggcgtgagccaccgggcccggcctctttcagtgtttttaatgtgttgtcacatttaatcccagcaactctatgagtaggtactctttttattcctactttatggttgaaaataacaaagtgacttggagacattaagtcaaatgggaacatacagtgagcatgttaaacctagattggcacgtcaggacagaagtgatatttaatccccaagaaaataatatattttttttctttttttgagacagggtctcactctgttgcccaggctggagtgcattggcatgatcacggctcactgcagcctcgacctcctgggctcaagtgatcctcccaccccagctacctgggtacaggcatgcaccaccttgccccgctactgttttgtgtttttgcagagatagggttttgctgtgttgcccaggctggtctcaaacacctgggctcaagcaattcacctttcttggcctcccaaagtgctgggattacaggcgtaaggcactctgaccagctggaaatgatatttaatctgatatctgaaggatgataggagttaaacaagaatcaagtgtcagagaccagagatatgaggtctcatatatatatatttgctcagggcagggggctggttttgggtgataattaggggctagactgaacagaattagtgtttggaagtgagtggtggtggtggtgagggaggagagaagggtgagtcccagggtaagggatgcaggcacatcctgagaaatgaggcagaagaatgagaacttggcttggggcatgttctgttcatctgaatggtggtgctgaggagacaggtggacagagaggtgtggggttcagggaggagcacaggactgagagggaccagcaggaatagaattcctgaagtcccttggattgacaagatgcttcagtgagagagagtccacagggtagagatcagcacctaggacagagcctcgagaacttcctctaggatagggaagggctggagaacaggaggaggagccaaggagaggaggaaggggccaagagggcaggatcaggactgaggcaggccgacttctgcgcagttgaagaactctaatgtcagagctgtccttaggaggcagagaacccctcgtcctggaagagtgcagggagctgcttggtgaccatcctttggggatgtcatggaaaagatatttgcatcaatctggggtgagattaggtgtctggattggttcaggttcttttgtcatttgtaagcacacaaaagaactctagttatctaaaggaaaaaaaaaactggaaatattatgggttggcacacgagtggtgccaggcctcagagagtacagggcccagggtggctctggggatctgggtggcaggagcgaatggatgaccttcacagggtgacaccatcgggaggaatcagctccagctgttttctgtccttgtcccaagaatcaaatcccagggagaacagtgtgattccccaatgttgtgaggttcagtcatgtgcaaggggaaagccgggcacctcgattgacagccccaccaggactgcataccgtggagaaaggatggcttcccaaagaaaaacaacattccagctaccagagaaaagggagtggacgctgggcaggcaaagccaacagacactttttgtagtctccatggtcctgtgtatgattcagtgatttttgcagtattcacttagcaagtcattcctcgttgcagaattgttgctagtgtttttcctggctggggattaagctttttccatttgcctattttagagtgagttgggggcctgggattgacacgcatttgtctctgggcttcaaggtagcccagagattatgccacctcaggaggcacaatttggtggctgtcactccttgtcatgtcaacaaagggtgtggcttgtggctctgtggcctctgctttaccagcaaggggaggatgctggtagtagcaaagggtctaaatcgctgttgcatcagcgaggtggatgtgcctatcctaaaggcacctactgagaagatgcccaagtaacagacactcatgggcacagtagacctgtcaaacctcatagttcctggctgactctctttgggtgacctgagtcacacgcccacgcctgaacacccactgaaactcctaggtgcattacgtcttctgcaatatctaaaggaattaagggaaggatgaaactctgtatctcaactttcctgaattcaccagtatggactgatggaattgagtgctagtaacaccaagctcctaaataataataataaaggcttacttataggaacgtacgaagcacaagagaaataagggcccccacggcccacccttcaacttctcacatttggtttgttagtcaggactcctttggtcacaagagacaaaaaaaacaattcaagttggtttaggaaaagaggcatttattggcttgtacagaggagttgagagttctttaggtctggctggatttaggtgctccagcatggtcatggggcatctcttggctcagcttttctctgtgttggcttcattctcaaaaaaacttttccttggtgatggtaaagatggcagatgcagcactttgggagcctgaggcaagaagaccacttgaggccaggagttcgaaaccagcctggtcaacctagtgagaccccatctctacaaaagaaaaaaaaattcaggtgtaatggtgtgcacctgtagtagctactagggatgttaagtgggagttgcatgaatccaggtgctcaaggttgcagtgagccataatcgcaccattgcactccaccttgggtgacagagtgagattctgtctcaaaaaaacccacaaaaaccgcccccccaaaaacggatggcagatgcaaatttattccctaccagtttaacaactctgctggaaaataaaccctctttcctaataattccagcaaaagtcctgaagctgattctctttgggtgtcctgagtcacacgcccatgcctgaatccccactgtggcccaggtcccatgtccacccttagagccagaggatgagggcagccttagctggcccacacaatcagtgagccagtgaagagcgattcctcacaggagaagcatggaggatgggtgctgtcaggcagaaacaagacatgccaccacacttggttttggggttaggcctgcttctggtctgagcaatctgctgctggatatggctggtgagtgaagagatattgatgtgtcatccccttagaccatggcattgtgtcctgctctctgcatctttgggggcctgatcaaaagcgggaagtcatggggtcaaggacagtctccacgtgccacccaaacaggaaggatgtccccagcaggtgttctgctcagggtctggctctcccagggttgttactgcagagggaagggtaggggcagctttcttctggtggatttatttacttctcaggcctgttcttttcctcatgttggctcaactgttttatcttgcttagttaaataaatttggtaacattataaaggaaaacagtcttttccggcagttgctgaccactgcaaaattactgctctttcttttgtttttcctttttagtgctgggctgtgaataagcaaatgaagtttgctatctcttcctcccctcttccaggaagaaataatcaccatcagaactttaagagtttcccataagactgggcaaattagaggaaggacctctatacggtggaacagatgcaattgtgcaaacagaatggggttattctctacatatggagatggaacagaccctcccagatgtgttagtgtggggaaaagcaggtggtggaggtgcgttcagagtagcagtgttcagctctcccaagcacattcaaatcacccaggagcttttaaaacgtactgatgcctgcccaccaccctctcctcacagccccattaaatcagaatctctgggagtgggacttgagcacttttcattttaaaagctccctggtgactcctggggagccaggactgagaactagtgctgtagaattgtatatgggcaaaacagcagggatctagataaaaaaagaaaactgaagtagggaatatctcagtccgtacctacagatagcctcacacatgtggtcgcgcatacagagaacgtctctagaaggatacacaggagactggaaagaacggttctctccagtgatgaagtacagtggtgattctcaactgtatactcgtttgtaatgttggaattttgaagccacaagcataaatgctcactgtgtactgaaagctggccagacagggctgtaagatgacccctgaactctagcttgtctgtgttggggccggctgcccacagattcacacaaaccatctccctgcccgtggtctctgcttgccctcctctactcagctgcaatgagtggtttccgagtgtgggagagaccagaagagctcattcattcattcattcgctcacatttttagtaagaattaggtataagccaggcacgtggtaggcacgtgaatctgatctcaccttcacaaccgtatgtgaaattggtggtcttatctccattctaagattggggatattttaacacagaaattcatacaaccaagctgtaaatatttgaggccgaatgaccagctaagagagcttataaactggcagcacttagatgtgtttggatggcctgtacagaactttttaaaaaaatcctatttcacgactctggaccagtgaacccagggccactgttggctagagctgagtgtcccttggaagggcatatgcccctcagttcagcgcagtccccccatatcccttcccttctgtgtcacaccagccttgcatcactcagtcacaggcctagcctctgcaggcatttgcgtttgtcacccctgtgttaaggtaggtaggatgagtgaactgtcgtctgtcctgcagggatgctgagctgaagtgtcctgtggaatgtgccatttctattccaatctggccctctgtctgctggctggaaaaccaagctcctttgctttaagtttcatttgtggactgcatgggatgggctgtgggtattgatttgtttgtggaaaagatgtgcacaatagggaatgtgtaaaatacatcatggaaatggatggttaatgccgcctggctggagtgtggggcagtggagtgacaagagatgagagtcaagttagatggtggggtatactgtgggtagatgccgggctaagcattttgaactttaacctttaggctactgctgtccaataagactttctatggtgctggaaatttcttatatctgtactatccaatgttgtctccagacgcatgtggcatcaagcacttgaaaagtagctggcatgaatgaagatttttattggcattttagattttatttaattaatttacttttacatagctccatgtggctggtagctaccacactgggcgctgcagatttaggcaatagcagtggatgtgttggagcagggaaataatatcaaagctgaatcttcagaaggtgatttttccaggagtgtacaggccgcatggggtgagcagaagtaggtagggataatattgacacttcttagcatctattaggcacttcttgtgtccacacactgtgctaagataactcacttattcctcataacaactctatgaggaaagtactatcattgtccctattttatagactagaaaatgagacacagcaaagacaatgggcatattcaaggtcacacagctaatcaacagtggcacacggtgtagaatccaggcagctcagctgtagagcttgtaccatgaatccttccatcctggaaggaaataaatgaaccttcattgagaatataccttctgctgtcccctggtgctgggcattcacacgtaaaatctcatttagatttttgttaacactcatgtgccattcggtggatttagatcctttgtgtttatggaaacttgggctcatagggatgagatatcaaggcaactgcaatctctgtggacaccagttaaggctttattgtaaaattccatgcctgtgggggaaatcacaggctgtgggagtcggggggaatgtacaggaagatatggcataaaaggtgttgcgaaggaagaatcagtgggatttagcaactgactgaatggcgggggtgaggaaagcgggggaggctttctcctggaacagtgagatgaatgacaaacacacatgtaactgcactgtgtgagttgagagtgtgggctctagaggaagacaaactggtttcaaatacaagtgttaacacggactagctgaacaaccttgggcaaattacttctctccgagcatcagtgtccctgttaatataacgaggaccgaaggcaggaggatcacttgaggtcaggagtttgagaccagcctgggcaacatagtgagatcccgtctctagaaaaaacttaaaaaattagccaggcatggtgatgcatgcctgtagtcccatctactcaggaggctgaggccagaggatcacttgagcccaggagtttgcggctacagtgagctgtgattgcaccattgcactccagcctgggtgacagagcaagactttgtctctataaaagatataatgagaatcatagcaccttcctcacaggactgtgatgaggctcaggttaagcacggatatgaaagccctttgcaaactcaatagcatgaccctgtgagtcactcttcttagtgctggtgagaccagccattgggcagaaatggtgaccagaactttctgtctttgatcatggaaacagttcgggaaattgcctgggggaaccccacttcatcttaggtacttggtagagtttaatgcggataagtctgtgggtcagctttgacctaggaggaaagagtggttctcccagcagctgtagagcaaaatctgcatgccagtggctccaacttaaatgcccttttccaccaaacagtttgcatgtgttgtcttatttgagctgcacaacaaccttatatacataggtactgtgataaaataaggctcagagaggtggagacactgagctaatgtccttcagcttataggtagtaaaatgagtgttcaaacgaaggtcctcctgcttccagaaacttagcctgtaattcctgtaggtgatgggcttctcatttcttctcctaccacagatatctgcaactagcgctagaatttctatcccagattgacatggatttaagggtaaaggttgcttcctaagaatgtcagttttccactatagaccccagtaagaattgtgtacaagaggggaatcgactccaaacagaatatatatatatatatgatttaatttagtcctctttggaatgcaatgagtaaattttagtggttagagtaaaccactaaaatttgggagttaggggtgaagtgcagtgtgaagcagagttgagatctcagtgcttttcctggggcagaaacatccgagagggcccctgtcacccaagcttttggctacagtctactccttccatctgggattaaccaggcgtttcttatccttgctgatctagtgtttcttattgctgctgtaacaaattaccacaaatttcctggcctaaaatggcacacatttattatcttatacttctagatgtcaacattctgaacagcaggtcttccggggctgaaatcgaggtgtcagcagggctgccttccttctggaggctctaggggacaatctgtttcttaccttttctagaggccacccacattccttggcttgcgttcccttccagaaatggcacaattccaacctctgcttccatcatcacgtctcatcctctgactccgagtctcttccctccctcctataaggacccctgtgatcacactgggctcatccagataatctagtataaccccctttctcaagatccttaatttaatcacatctgcaaaatcaattttgtcatgtaagtaatatattcacaggtcccaggattaggacacggatatctggtggtggtgtcagggggtcgggggtaggggatgggaacattattctgcctacagagctggcaggtggcctttcttctttcctttcttttcctttcctttccttcccttcccttccctttcctttccctttcccttcccttttttccctttcttttctccttcccttccttttttccctttctcttccccttccccttcccttccccttcccttccccttccctttcccttccccttcccttccccttcccttccccttcccttccctttcccttccccttcccttccccttcccttccccttcccttccccttcccttccccttcccttccccttccccttcccttcccttcccttccccttccccttcccctccccttccccttcccttccccttcccctccccttccccttcccttccccttccccttcccttcccttccccttcccttccctttcccttccccttcactttcccttccccttcccttccctttcccttccttttcccttccacttcccctttcccttccacttccctttcccttcaccttccccttccctttcccttccccttctctttcccttccctttcccttccctttccttttcccttcccttccctttcccttccccttcccttccctttcccttccctttcccttccccttccctttcccttccctttccctttcccttcctcttcccttccccttcccttccccttcccttcgccttcccttccccttcccttccccttcccttccccttcccttcccttccctttcccttctccttcccttccccttcccttccctttcccttccctttcccttccccttccctttccctttcccttccctttcccttccccttccctttcccttgcctttcccttccccttcgcttctgcttcccttccccttctcttctcttttcttttttttctggagtcagggtctcattctgttgcccaggctggagtgcagtggtgctaacacagctcactacagccttgatttcccagcctcccgggttcaaccaattccccccacctcagcttcccaagtagctgggaccacaggtgcccaccaccaagcctggctaattttaaaaattttttagagatggagtcttgccatgttgcccaggatggtcttgaactcctgggctcaagcaatcctcctgcctcgacctcccaaagtgctaggattataggtgtgagccactgcactcagctgcaggtggcctttctgatcttgcctgtaataagggagggtgggaggtggatagagccggagacatctttttcattctctgctggagctgagtagcaatttccccttttaaacaggccatgtgtgcagtcccctacctggccgtcagacattttcattgctcacctggcccctaggcatttgagtttcagaccccattttgtagttctagtaaagccttgctatagactggggtcagagggctgcaggctttcaacctttgtagagcaaggggttattgaataaattatgaagcatctggagattctgggctcttaactgggtacctgtttgaaagtagggtctagtacatttttttcagtagctcagtaaatgttgcctcttcttaaaaaaaaaaaaaacagaaaacaaaaactggtcttactctgaatttgccaaatagaaatgagggggcgtttatttgtgtcacaaaaggatttgatttctttaaataggcagccctactattttcttcaaagtgttttagttaatgggaaatttgatttgcacaacttttcagaaacacactgtgtaaaggaattacctgcaccagaagctcatgaggtttttcaaagtctgttctcagcttctctgcacatcatgctggggttcacttggcctattgattctgcctcagtggggatggactattcatttctgtgggtaattggaagcctacctaaagtgaccttgtcaatggttggattgacaaatatccaggctggtgggatgtcaggcgatcatccaggagctacatctaccatgaagttggttatgttttctcctttttctatgactgatgatattcattttttggttcattcattcaccaaacatttatttactgaatatcaattatgtaccaggaattgtggtagacactaggagactagagatgagctatctttatccccttctgtctccaaaggggataaagatgaataagataataattgatttttttttttgagacagagtctcgctctgtctcttaggctggagtgcagtggcgtgatctcggctcactgcagcctctgcctccctggttccagtgattctcctgcctcagtctcctgggtagctgggattaccggggcctgccaccacactttgctaatttttgtattttttgtagagaataactgatattttagatgtttggaagaaaggttgtagaataaagcacctacttgaaaatgggggaaactactttcctaaatatttctgggtcaaagaataaattaaaaccatactaatagaccacttagaaacttgatacaatgatgggactaaatataaaacataggatgcagccaaaactgtacttaaaagagggtttttagccataacatctttaaatgtttaatgaagaggaatgggaataaattaattgagcagtcaattcaagaagctttaaaaagaacagtggataatattagctgacatttgtagaatagtcatgatatggttggcatggttctgggcatggaataactcatttagttctgacaacaccactgtgatatgggtcctattgttgctgtcattttccagagaggaaactgaagtacaggaagatgaggtagtgtacctagtcttagagtttgcaaatgatagacacaggatatacacctgatcatcagactccagaattcacattcccaaccaataagtaatacaaatacaagtaagcaatacaatcacagacacacagaacaaaaaaagttaaagtagcaattaataaagtaggctaaaaccaggtagagttgataaatataatcataatctgcttctttaacatgatagaaagataaaaatagacaagaaagaacacaaacttctggaaaaaaaataacgagagactacctaacaatgcaatatgaagaaagaaacaaagaaagagaaaaggtgtaatatcatcccagataagatgctacaatttaaacacgttgagaagaacactgtggataatttccaaggaaaatataaattccaaaagtttgtttgagtagaggtgaaaaactttcctgtgtggttgaagtgtagagagggagagggaggtgaagctggggaaagctcagggatggggcgagactatgctgtcatccctttactttcatgttgaataaaagggaaagttaaacatggaactacgacagggggaaaagagagaataataaaaatattatttggggtaatacggttttctatctggaaaactcaaaggaagcaactaaaactccacaaaagctatttgagtttttttaaaaaatgctttaaaataaatatgctaacaatctattgctttcctattgtttttgtttgtttgtttgttttgtgttttgagatggagtctcgctctgttgcccaggctggagtgcagtggcatgatattggctcacttcaacctccgcctcctgggttcaagcaatctactgcctcagccttccaagtacctgggactactacaggcacctaccaccacgcccagctaattttttttgtatttttaatagagacggggtttcaccatgttggccaggctggtctcgaacttctggcctcaagtgatctgcctgcctcagtctcccaaagtgctaggattacaggcatgaaccactgcgcacagctatttgctttcctatttttaaacaatgaccagttgggaaacaaaatgaagacatgtcaaatttacaatagcataaaaaagaatcccttagatgatgctaaagggaaaatgtgtaggacttatatggagaaaataagagttcaacaaggggacaatcatttcctgatggaaagactcattgttgtcaaggcatcaattatcttgaatttaatttctaaatttaacacaatttcaatcaaagtcccaatcattttttggaggctgagggttgactgaatacaatcccaataaaaattccattggtatttttaaaatcttgataaactgattctaaagtttacttggaagaataaatatgcagtgatagccaagaaaatgttgaaaataaggataatgagggtggacttgccctgccaagatataacatattacagagctactataattaaagcccatattgctatactagaagacagatcagtggcacagaatagaaggcccaaagacagaccccagtatatataattattaaacatataataaagttggcatttgaaatcagtggggaagggatgaattattcaataaaggatgctgggacaattggttacctctttggaaaaaaatggcaaattggattcccatttcacatcagattccaagaaattagacatggatcaaagagtttaaagtggaaatgatgccatataaaagtacaaaaaaactccaaagagtaatatttatatgaccttggagcatgaagaaggctgtttgaggtgtacttggactgtctttctttgtccagttttcccttttagtggtttaaaaggaatacatagtagtttttatatttttatttatttatgtatttatttttgaaacagggtctcattaggtcacccaggctggagtgcagtggtgcagtcatggctcactgcagccccaacttcctgggctcaagcgatcctcccacctcagcctccggagtagctggactgcaggcatgcaccaccatgtctggctaatcttttattttttgtagagatggggtctcactatgttgcccaggttggtcttaaactcctgggctcaagtgatcctcctgccttggtgtcccaaagtgctgggattacagatgtgagccaccacacccggtttctattcttatttttaatacttaattgttaacacgtatatttaaacttataatgtcctatatgcaatttctcaatatcaataatcttttgaggaatataagactcagcacattttcatcttgtaaccctcctgcaactcccatttcttatgacttgggttttctctacttctctatctcttcctctgttgaaaacttttcatattatggaaaaaattaaacatatataaaagtaacattagtataatgcatccttgtgtatgcatcacccagttcaataatgacccatcatgatcaatttctttttcatctgtaatcctcccctttctctccccaccttggcatactgaattattttaaattattttatccataaagatgttaatgtatcctcaaagataaggattctataagcaaagaaaaacaagaccattatcacaccaaatatttttcattccctaatatcagtaacaataattcccttatgtcatcagaaagtgagtatatccatttccctgattgccttacagttttttaaactgttggtttttttccacttagaatccaaacaaggtccacatgttaaatttagttgatatgggttgataggtgcagcaaaccaccatggcacatgtatacctgtgtaacaaacctgaatgttctgcacgtgtatcccagaatttaaagtaaaattaaaaaaatttagttgatatgtttcttaaattcctttgaaaatatacgtttctcgtcctattttctccccacttgcagtcctctcttgtagtctatttgttgaagataccatattctttgccttgtagttttctacattctgggtatttggttggggtgggggggggtgtgtttgctgatcgcatccctgtggtgtcatttaatatgttcctctgtcacttgtattttctgtaaatctgtatttgcatcaagagacttgaaccaatcatatttgattatttgacaagtgtacttcataggtagtgaagtgagctttcctctgtaggcaagtggtatctttttgtgaccttagcaaccatagatgaatgtcacctagactcattgtgtcactagggatggccttgaggtttcctgttctattttcatttactaagcatgcactttagaaaggctctgagctgctccctgaagcatggcacccgtcctccagaaacccgcagtctagaggttgtaaaagaagatttgaacaccaagactgtaaaagatgatttgaacaacaacaacaacaacaaagcagttttattttgtatacattctttcattgtacctcccccagagggatataacctccaaataggggagccataccatagatgcattaaattcacaccaattcaaatgtgtgtatatatgtatttgcttgcagactactaaagtgacaatgtaaacgttgctgcctatttttcccactcttctattagattgacgttgcttttggtgagatggggcatgagtccaccatcctgtcccctctgtttccacatgaccctcatcgtatgaacacctctcttaagtgtgattctaggatttaaagatacatatttcttatgcattatgcacctaaacacaagccaactacttcatctggcacctgatccaagaaacaacattctgttccaaaatcaatagaagacaaggcactttaagggatcttcaagggagtgtaattttgagcatatggaatctttctaaccctagctaactttagaagtttaactcctatgcaagatgaagcatctatgttcccaagagtttgacttcagcaaaggacaagctgcagaagctgacattattgtttattttggcataaaggctttacttgttggtgaagttcaagtttaatgatctcttcctccctttctctctcttcctcctctccgctttccttcttcccttcctcccaccctgattttctcttttgcagtttgctgctttgtggtgcacaagcggtgccatgaatttgtcacattctcctgccctggcgctgacaagggtccagcctccgatgtaagtaatgggcatcgattgcttttctctgtccacagtcaatgctgccttgtgattaaatgtgagtgagcattcttagacgagtaagtgtggacgatctcactctaaggcatgtggtggtccctatagcttttgagacagttttccttttagtggaaaacaaaattttggagggagtgtggctggataggaagtcagctagtttgtctactatgattttgctaatgtcttcactttgagagctggagcacggagggtgagaggcaggggcctacttggtagtgtggctgcaaaaaggtagtttcggtggtactttgcagtgcacgttatggcactttgttagggtgttctttcttttgttattgttattattatttttattatttttcagatggagtcttgctctatcgcccaggctggagtgcagtggagcaatctcagctcactgcaagctccgcctcctgggttcatgccattctcctgcctcagcctcccgaggagctgggactacaggcacctgccactatgcctggctaattttttgttttgtatttttggtagagacggggtttcaccgtgttagacaggatggtctcgatctcctgacctcgtgatccgccgcctcggcctcccaaagtgctgggattacaggtgtgagtcactgtgcccggcctattattattattatttaagagtgttgcccaggctggtctcaaattcctgggctcaagcaatcctcctgccttggcctcccaaagtgttgggattccaggcgtgagccagtgcaccctgcttgttagggtgttcctaatatcagggcccaggaatgaggaggaaatgaatttatcctgctaccatgaatctcaaagtatgactactgctagtgggacaagagatgcttgtaggtaaaatgtgcaaaaaatttttgttttaatcattataaatgtattttaatgtggattgggaaaaatgtatctagtagtggttttgcatttatgataaggatatagaatttcctacctaagtaaagatttttaggttaaacaaaagataaactgatttgaggacaatattaagtgaatgacagtatgggtgatataaggatatggcaaaagttttggtacaaatgtgtttaaagtttagggtacattgttgattggcctacccagcagccattcacagccttcatccttctggcagaggctacctctcatgatggaagctaaaaatgcctaatacttgcttttcccggctctcttgtagctgctgaatgaggatgtgacccaatcctgctaatgggaactgaggggaagacctgggaaagagtctaggaaagatttttcctttctgataagagagagacatcccttcccttgtcctcttgggcatttttgtacaaggatataatgcttggagttgtggcagcccttttgggtcaatgagggacacattgccgacatcctgagcatggcagagtggaaaacttaaaagaaccgtgggtccatgatgatgctgatgagctgttgataccactcacagtccttttatccccaagctggatagatgggagaagaagctttttttttggccaggcacggtggctcacgcctgtaatcccagcactttgggaggctgaggcgggcagatcacaaggtcaggagatcgaaaccatcctggctaacatggtgaaaccccgtctctactaaaaatacaaaaaattagccaggcatggtggtgggcgcctgtagtcctagctccttgggaggctgaggcaggagaatggcgtgaacctgggaggcagagcttgcagtaagcggagatcgcaccactgcactccagcctgggcgacagagtgagactctgtctcgaaaaaaaagaaaaaaaagaagctttttttttttttttctttttttttttaagcaaagtcttactctttgaagccttctcttttatttttgtttttttctcttttgagacagaatcttgctctgttgcccaggccagagtgtggtggcatgatcatgtctcactcactgcagcttaacctccctggctctagcaacccccccacctcagccgcccacgtagctgggcctacaagtgcatgccaccacacctggctaattttttatttgcttgtaaagataggttttccctatgttgcccaggctggtctcgaattcctgggctgaagccctcctcctaccttgacctcccaaagtgctagaattacaggcatgagtcactgtacctgaccctgggggcattcttttacatgcagctgaaactgtcctagctgagaaggctttccaccatgcacagtctttcattgcccaataatgaactgcattcagcataccccaatgcagccatcacccctagttctcttactttgtttctgctttgaatccccttcttgaaatttctcccattggctttgtctccattactggttctgttacccacttagacttgacagctgacagcttgcccaaagtgagtagtgactatcttctgtcattggatttctttagctcctgctggtcttctgcaaatggtcatctgccaatttgctgcaaactggggtgggagtttgtggggagggcatatctgttgccatagcaacacaaagatgctggagcatatgttggatattctttgcttggaaaatgtggtaattgaggttaagaactccaagaaacatggaacaaccaaagtccttggaaatctgtttgcaaagacaaagtttgagactgtttgtcatgttctctcagatcctatgccctagcccttgtagtgcaatttcttctctcctccctagcaaaataggcaggggagtttggggagactgccctactcagtatgcagctctgagtgttcatgcagactgaaacttgatactcaacttgcagccaagaagatggtgtttcccatattctatctatctgctgaatgtttctgttgcctaagacagaaactcagctcaaactgacttatatgaaaaggaaaattttgggtccttgaaatagaaaaggcctaagggttgacttggcttcaagcacagtgaatcaaagttctaaataatgtcctcaagaacctgtttctccccttcttggcttagcctttgtctgtgttgattttattttcaggaaggcttgtctcctatgcgagcatggtggctgcaacacctttaatcttatatcttatcagtgctgcagtgcagtaacaagagctaaagtctcattagaccatgaatcacatattgccagaagaatgggttatgctgattggccaggcctgggtatatgctgctgtggtgtgaatgttttgtttctccaaacttatatcctgaaatcctaacacccaaggtatggtgttagaaggtgggccccttgggaggtgatcagttcatgggggaagagccctcataaatgagatagtgcccctataaaaaagaccccagagatatccgtcaccccttctaccatgtgaggttgcaatgagaagacagttgtgtatgagaaagtgagctctcactggagaccgaatcttccagtgccttgatcttgtactttctagcctccagaactgtgaggaataagtttatcatttaaaaatcactcaggttttggtattttgttacagcagccagaagggactaggacagaaaattttggtactaacagtgtatagaggaacaaaattttaaggatgggttttctgaattggtttcggggatttggtaattggctgccaaatctgattagatttaagaatgctaattaccctatttctagtagtaaagagagcctggatagtccgtggcatgatctgtttatagagatacacaaatcatctgcattggatactcctaatcaaccatttataagaagcaaggagccaagtgattcgatatatgatacccaaacacttttggaaaactaaggcatataatgacttgctcctaatgtctctggacaaagtggagaaagaaaaagatgagctcagggatttgaattcccagctcaaagagtttcataaatgatctaagagcttctaggtgtgccctgaaggagagccttctagcctgtagttgcagggctgaaatttctgaaaattaaatgcacaacctcatcctgcaattggctgaattacaatgcaaattggactccccaccacacagggtgtctgctctaaaagcaagggcaagggcattgatcagaaaagaatgggatcccataaggtgggaagactctgatgaagaccctaatgaagctggggacattgagcccctaaattctgacaagtcttttttttaccagtggaagtggcctccttacctcaagcaaaagtgtcatccccactcagggtggcattggcctttccatcttgtctaagggaactaaccctgcattgccctaagaaacagtaatggctttccctgaggcagttgccatgccaggcaatgctgattcttgtcagcaccgaatcccaccaccccttcaagtcctagcaggctcctaaacgtgagatgcactgtgtgacccacggggaggtatgctataccccaaaagaactatttgagttttctaatttatacaagcagaaccatagggaatatgcatgggaatgatattaagggggtaggataatggtggaagtaacatgaagttgaatcaggctgaatttattgatagaagttcactaagcagagattctgaatgtaatgttccagcttaaggagttaggaagggctctaacagtttagctggttggctgaaacatggattaaaagatggcctatcatgagtgagttggagatgcctgacctcccctggtttaatgtagaggaaaggattcaaaagcttagggagattagaatgccagagtggatttgtcatttaatacccgctcacccatgctgggaaggtcagacatacctttaagaaaggtatgtctctgtcaatactttgagaaatatatttgtgaggggagccccagcgtcctttaagagctctgtgatccctcttctctatagaccaaaccttactatgggaaccacagccacttaattggaaaacttaaatgcaatgggaataattgggtcctggagtatcaggggccatttggtggcactcaactgttaaaggcaaggtaggtgcggttaccttaatggatcgcagagttacaacaacaatcggaatagcctgactcatgcagacctatggcactgcctaatcatggtgttgctagaagtgaaataggtgggaagcctactaaattcttacttgatctgtatagcagaaaaattctaggtgaagtgaacagaagtctaacttgaatcataaaaatagagaatcatagcccctcagtccattcccagacttgagccagtttatagacccagaaccctttgaatgaaagggaggtaaaatttccttgagaaagcgattatactgctaaaagtttatcctgttaatctttctcccagccttgcccaaagggacctactgctttttatcaggataactgtgcactagagaaaaggaaatgatgagaccttttggggactactgaacactagttctgaactgacactgattctaggagacctaaaatgtcacttgtccctccagtcagaataggggcttatggtggtcaggtgatcaatggaattttagctcaggtctgtcttacagtggatccagtgagtccccaaacacatcctgcagttatttccccagttccagaatggataattagaatagacatacttagcagttggcagaatccccatactggttctttgacctgtagagtgaggcccactatgatgggtgaagccaagaggaagccattagaactgccccagcctaggaaaacagccaaccaagagcaatactacatccttagagggacagcagagatcagtgccatcatcaatgacttgaaagatgcagaggtagtgattcccaccatatcccttattcagctctcttatttggcttctgcagaagacagatgaatctagaagaatgtcagtggataatcataagcttaaccaagtgatcactccaagtgtagctgctgtatcaaatgtggtttcattggttgagcaaattaattcatcctctggtagctagtatgtagctattgatttatcaaatgcctttttctccatctctgtccataagacccaccagagcagttttattgcagctggtaaggctagcaatacaccttcactgtcctacttcaggggtatatcaactcttcagtcgtatgtcataatttagtttgcagggatcttgatcattttttccttccacaagctatgacaatggtcctttacattgatgacattatgctgatttgtcctagtgaatgagaagtagcaactactctagacattggtaagacatttgtgtgttagaggatgggaaataaatccaactaaaatttagggaccttcttcctcagtgaaatttctaggggtcagtggtgtgtggcatgttaagataccccttttaacgtgaaggataagttgttgcatctggacccttctacatccgagaaagagacagatggcctactgggcctacttggattttggaggcaacacattcctcatttaagtgtgttatgctggcctacttaccaaggggccccaagagcttctggttttcagtagggcccagaacagtagaaggctctgcaacaggtccagactgctgtgcaagctgctttgccacttgggccatctgacccagcaaatccaatggtggttggttagtggcagagagggatactgtgtggggcctttggcaagcctttataggtgaattgaagcacaagtatttaagattttggaatatagtcctgccataatccacagatagctagtttcctattaagagacagctcttggcctgctaccgggccttcgtggaaactgacgatttgaccatgggccactaaattgccgtatgacccgaattgctcttcattaactgggtcttatctaaaccaccgagccataaagtgggcatgcacagcagcacttcatcatcaaatggaagtggtatgtatgtgatcaagcctgggcaggctctaaaggcacaagtacgatacatgaagaaatggcctggatgcctgtgctccccactcttgctaccctgccttctctctcccaacttgcacctttgggctcatgaggagttagttccctatgatcagttgacaaaggaagagcagactaggacccagtttacagatgtttctgtacggtgtgcagacaccacccagaagtggacagctacagcactgtagtcactttaggacatccctgagggacaatagtgaagggaaatcttctcggtgggcagaactttgagcagtgcacctggttgtgcactttgcttgggaggagaagtggccatacatgtgactatatcctgattcatgggctgtagccaattatttgactggctgggcagggacttggaaggaatatgattgaaaaaattggtgacaaaaaagtgtggggatgaggtgtgtggatagacatctctgagtgggcaataaacatgaaaatatttgtgtcctaggtgagtgcttaccaaagggtgacctcagcagaggaggattttaataattgacttgatagaatgacccgttctttggataccaggcagcctctttccccagacaccctgtcatcacacaatgggctcatgaacaaagtggccgtggtggcagggatggaggttatgcatgggctcagcagcatagacttccactcatcaaggctgacctggctatggccaccgctgagtgctcaatctgccagcagcagagaccaacactgagttcctgatatggcaccatgcctaggggttatcagccagctacctggcggcaggttgattacattggaccccttccattatggaagaggcagcattttatccttatggaaatagacatgctggatacagatttgccttccctgcctgcagtgcttctactgaaactgccattcatggacttagagcatgctttattcactgttatgaaattccacacagcattgtgtctgatcaaagaaatcacttcaaagccaaagaggtgggcagtgaactcacactcatggaattcactggtcttaccatgttccccatcattctgaagcagctggcttgatagaatggtggaatggccttttgaagagtcagttatgttgccagctaggtagcaataccttgcatgcctgggcaagattctccagaaggctatatatgctctgaatcagcatctagtatatggtgctttttctctgatagccagaaatttatggatctgggaatcaaggaagtggaatgggagtggtaccactcattattacccctagtaattttaccaccagcaaaattttgctttcttttcccatgactttatgctctcccagcatggaggtctcagttccagagggaggaatacttccagcaggagacagaacaatgattctattgatagttaacactgccacccagccactttggggttcccatgcctctgagttaacaggccaagaaggaagttatgaagttggctggagtgattgatctggactactaaggggaaattggacactactctacaatggagaaaaggaaaaatgtgtctggatacaggagatccctaaagacatctcttagtattaccattacctgtgattaagatcaatgaaaaactacaacaactcaatacaggcaaaactatgaatggcccagaccctttaagaatgaaggtttgggtcaccctgccaggtaaggaaccaccaccagctgaggtgcccactgaaggtaaagggaatacagaataggtaatagaagaaagtagttacaaataccagctatgaccgtgtgaccagttacagaaacaaggactgtgattggcatgattattggcattattttgttatggatatgtttgtgtgtatatatacatatggtgagcaaatatctttgttttctttgctcttttagttctttatcatgtaacgtaagatgtattgactttatatcagtatttttatgtcttagtatttaagttataggataccaggacaagaggaatcattactcaaggacttcatctccttttctggggaggggattattgcattttcagttgtacaaagtctaattgtatcacatcaggtggaattatgtccttgttattctttatttggaggttctttatttaagaaggtgtgtatggatgccaagttgagaaagggtggacttgtgatggttaattttgcacatgcagttaaccttgactgggctaaggggggtacccagatagctggtaatacatgatttctgggcatgtctgtgagggtgttttcaagaaattatcatttgaatcagtagactgagtagaaaaattgccttcattgacataggcaggcaccatctaatctgttgaggactcagaacaaaaaggcagaggaagggtaaattcactctctctttttgagctggaacattaattttttcccgcctttgggtgttggtgctccaggttctcagtccttcagacgtggaccaggacctactccattggcacctatggttctcaggtctttgggctcagatttcaaacattggactaaactatacccctggctttcttggttctctggcttgcagatggaagactgtaggacttcttggcttccataattatgtacaccaattcacgttattgatttttttttggagaaccctgactaatacattgtgcctacaccgtagatgagggcgtgagtgccccttccatggattgagagtggggaagaggtagtttctctgaggaaagctagagaaacggtattgtgtcctggttaaaatcacggattatggagccagcattcctagcctcagatctgtgtgaccttggacaaataacttaaatccatttatgccttagattcctcagctaaaaaatgagttaaataatagtttctacttgatagcattgttatgagtatcaaatacatagatatctgtaaaagcacttaggacagtgtctggtgcatggcaagagctatatatgtgatgatgatgatgacaatgacaatgaataacagtgcacacatgctgagcagccagcaaggacaggtgtcttgtcagacagaccaggaaagggtgaagaatgagcaggttctctgtctgccacctggcagtccttcctagaagtgtggaggctctgtaagtggcatgagacccctctctgtatgaatgaaggagtgcagccattcattgccttgagcatgaggagagcaggaagtactccctgcagccagcatgcataggatttggcagcctacctgaaatgattctatctctggatacagttccaaaaaggtcagttggcaccaaggatgatgaattggtccagacacctgaactggcttgactcagttcattgacctttttctgctcatggttggaggcatgattaaagacctagccacacctgcttgcccacctggccagactctcctttagctgcccctgatactcatgcaggtatggaggggtgccctctccttctgcatgaccttggaggaactggtgtgcagcaagttcgtgaagcagaaacacacaggcggtgaccttggacaaggctccatccacgataaaggatgtgcttggttgcatcctctaccctctgctgttccaagcccagtctgagccaggcaatattatggatattagtagagctttgtgctgttggcattatcctacagctatgttcacatcatatcacattgaggcaattttatgaaccaggcactgtcccgtgaacctagctactgagccaaccattcaataacaatgagaatagacaacatttatgggcactcgccattggagggccacaaagtgtggcagagttcatggatgatgctcctggtcacccacagtcatccttcttgttcttgatctcaccaggcaggaaatcctcaattcatctgtctcttgtacctcttagagagaccaggtctctggtactgtcataagcattacttatggacattataggttattcagcactcagaatactgaccacatacacagcctcctgtgacatctcagaacaagaaacagaggagttgtctctgagggttgggactagggtgagtcaagtgaggtactttccctgggcacagtttaaggggttcttgtctgtgtctgtggatagctggttggttggctggtgggtggatgatctaagatggcccctttcacatgactgacgacgagcaggttgtcggcctgtgtgatttggctctcgtccatgtggcatcatcctccatccaactggctagctctgacttgttcatatggtggtttccaggctccaagaagagcaagagagcatctcccaacactttttaagcctttgtatcatgtttgctaatgtcctaaaaagctagtctctggccaagtccagattcaagtggtagaaaaatagattccagtgcctcattggagaggaagtatctatggttaatctattgcagatcctgttaacccaagaggccatagcagaacagaacccctggagaccatcacactggactttataaaaatctgcatgttatagtgtggctcagagtcatagatggcctcatcaaaagaatgcacctaatttattccctgcctcaatcgccagtggacttaaccacctctagctataagtggttaatgtggcagtttattgatcacgtcaatggtggttaagagtatggactctgaaatcagacatacctgaatttgagtcttgattctgcccagatactcattaggaaaacttgggcatgtcgttcgacttctctatgccctagtctccttatatgtaaaataggatgttagtaccaaccacataggtttatagtgataattttaaaaatatttaaaatgagaaagagttcacaaacaaaagacaaatgaatttcaaagcccttacatgaaagcgcttggcacagtgcatagcaagcccttggtacatgtagctaaggccatttccattgctccacctaggtccataatcaagaatgtactgacaattctctacattcttccacccagagcatgcccttatgaggtgattacagtttccatttccattacttcacacaaacctcaaattctgtgatgcagtgctaagaaaagaactcaaactttggagccagaaaatgctggtgtcaaattccaaatggtctctgctatgtattgctccaatgaccttgggaaaataactttaagttctgtgaccctcagtttatgtctttaaaatagagaaaataatacctaaataaagcggtttttttttttttggtaactattcaataggagactgcttgaaccatccctagaataatgtctggcacaaagaaggcactcaatacctggttttaaaatcattattaatgtctggaggagcctctcctgctctataagggatacaggttaccctctgacctgccaagaaataatagctaataataatagctaactttattgaacagggtctctgggcaggcagtacaaaaggactctttgtctggtttgtctaaagatacctttttcaacactttatggctttagaaataatttcttatgatttatagtcaagttactgagtaaaacccactgttaggtcctgtgatctcctaattccatcactaaatcaggtcaattagagatggtagacactaatgttgaccttatccttttgatcaagtctcactttgtgataagatagattaaaaatcataaacttgttaaacttgttaaatgttgaagatttgataaaacagaaatgaaagtattaaatgtatgtatacattaaagtatgtaaataagtgagaacatgtttgaaaatctggttgaaatggatgattttctcataaaattgtcaattttgtctcaaaaagaaattgaaaaccagaataggcaaataaccgagaaagaaatgaaaacattattcaaggatcttttcttctcgtaaaaccccagacaaatatgtttcatgggtaaaacttcttaaattttagagcaacgaagaatttctgttcatttaaaattgtacctgattacaaagaagaaataaacctttacaattttttttaaatgaaaatgagagaaatccagctcaaattagcagtaggaaaagagggcccattgactcctgagaaggacattgggagtagagtaagagcttcaggaccaaggacctcaaaggctggaactgaagctccagtacttgcaagatacttttccatttctgctttattggttagttattttgctctgtaacaaaccattccaaaatttagtggcttgaaacatcagttatttgtggtttctcatgattgtgtgggttacttgggtgattcttctgacctgggtttatttgggtaatccctgctgggctctgtcctgggtcttggtcagctagtggctgggccgatgctggattacctagaacagccttgctagcattgactgagggctggcaggctgtcgatctgggcatttcatttttcctccatgcgtcctcttttcctccaccaggctagcttagtttcacggttccaagcacggcaagagagggaaatcccaaagcacaggtgtgtgtgtgtgtatgtgtgtgtgcgtgcgtgtgtgtgtgtgcgtgcgtgcgtgtgtgtgtgtgaaatggagtctctttctgttacccaggctggagtgcagtggtgtgatctcggctcaccgcaaccctcccagatacaagtgattctcctgcctcagcctcctgagtagctcggattataggcacccaccaccacgcctagctaatttttgtattttttgtagagacggggtttcaccatgttggccagctggttttgaactcctgacctcaagcgttctgcctgcctcagcctcccaaagtgctaggattacaggtgtgagccactgcgcctggccagcataggtgttttttaagcctttgtttgtgtcacagtggttatggacaagatcagatttggggtggagaaacaaacttcatctctggatgggaagaatagcaaagtcacatggccaaggagcatgcggggatgggagacattggtggccattgtgcagtctaccacactgacccttatctgctgtgccagatgcctcgtttgcccttccaatccactctgctttctctgagagactaagccataatgactgcttcaactggggctcccttaccctctgacctgacctctggttggactcaaggggaggggctaataggagacttggggaggggagagtgagaccctccccgagtcagtcagtatttattatggagtcatcttcactctaccttttgactataggttgctgctcctctacagatcatcttctctatgtaattctctccttctgggttccaggagctactcccttcctttgtcctctggctcttactagcctccaatcccttatactttcccaacaccatgcccacacctttagaaacagtcctttcattgaacctttcttaaacactcttcactttagtatgccatctgtttcctgcggggcccctgactgatgcatctgctttgtcttgcctcatttgctcctgctgtagatggaacatgtctgcaaacatcgttacagttgaccccatggaaagatggcaaccctagtggaggaattagccttcttcctgcattcgttttttttttttttttgagacaaagtctcgctctgttgcccaggctggagtgcagtggtacgatctcagctcactgcaacctctgcctcctgaattcaagcaattctcctgcctcagcctcccaagtagctgggactacagatgtgcaccaccatactcagctaatttttgtattttcagtagagataaggtttcagcatattggccaggctggtctcgaactcctgatctcaagtgatctccctgtctcagcctctcaaagtgctaggattacaggcgtgagcgactgcacccagccatcttccctgcattcataattgatctcagaaaatgttctgatggagttggttctctatcactgggagaacgaactcttataacctcagacctggatcccatggcatccctttcacccaggagcagtgtatgttataagaagagtgaaggagaaactttgatgcgctgatgaaagtaataactaattattataagcttgcttaaccacaataaccgctattacctagtaaagttggcataaaaagtaaactacaagccagtctcatacatgagtctagatgaacatatcccaaataaaatagtgaatgctattttattgttgtcacggacattatgcattcaaataatgtggaggaaacaatctagagataaaacaacaaagaaaattatgatcaatataacaaaatataggaataaagataaaaatatgccagcaaggaaccgtggaatctggaaagcataaatttagatggtagaagtgatagcagaatgttacccaaccaatgtaaatggattgaaattctctactgaaaggcaaagactatgagattggatgagcaatgtacaactcttggcagtgtataaaagatgcttaaagcacaggttttaaaaataaaagggacaaaagtgtatcatgaaaatacatatataaaaatgaaacatggtcttaataatgatatcaaaagaaataggactcaaaacaaaaagcataaacgggggcagatgtcccagcagatcacttgagctcaggagtttgagaccagcctgggcaacatggcgaaaccaagtctctacaaaaaaaaaaaaaaaaaaaagaaaaaattagccaggcatggtggcatgcacctgtagtcccagctactcaggaggctgatgtgggaggatcacttaagcctgggaggtggaggctgcaatgagctgtgattgcaccactgcactccagcctgggcaacagagtgagattctgtctcaaataaacaaaactaaacaaaaacataaaacagggaaggagaaaacatgaactctaatgcattactggtgagtggcaaattagtatatgttttctaaagagcaaattttccatacatatccagagctttaaacacatttttgacctaagaattactaaatctaatcattttgacctaagaatgacaattctaggaatttttggtaagaaaccatttcaggataaatgcatagatttatctagagtgatattcattgcatcagtatttataatatcaaaaatttgaaaatgacccaagtctcactaccaattagagtttatataagtaaaatatattacagtcatatggtggaatgctggccagtgattcagtgtcacagtgtctggggataaggggaatgttctgtgtcttgactgggatggtgcctatacaggtgtacacatttttcaaaactcatcaaactatatgcttaaactctgtacattactgtatgtaaattatactttaataaaaagtcacagtgattaaaatgccattggcctggaaatgcagtcataatatattgctaaatgaaaaaaaaaaagcagacaacaaaacattaggtcaggtatgatagatttaaaaatataaaaatatatacacatgtaaagccaaaggccacattccctaaataaattttcgtgaatacttaattctgttcactgtcttatgccagacttgttacctgcagagctctgaaggtcactttgggatgttctgtagctggtttctccagttttgtttgtttctggggccactccacctctagtgcagactcaggtttcccacttagttcagtgaggaccaaacttgagtggcggttccggcgtaatcgggagtcacttacagttccttccaaatgtggttactcttgaggtcctccatccgctgggagtcagctcagttcctggactgagcatcttcaggtgcttctaataagattctggcctctgataagtcttgacttcaattcatttttggccccagagaaggggaatcttggctctgccaacaaggccctgtccatttcctgcctcagtgtgagtggcaggaagaccaccttgatcttcagggcaaaggctcgcttcctcctcttggtgtcatccggtctccttggctcagtaaagcaacgtaacagtcaagtgcacttttctcaacgcctggtttcttctgtcttacataaccccaagtggggacacccacagtgaactttcaaaaataatgctccttccagggagcgaagcagcaatgagggttgaacatctctcttgggatgaccatcacctggaccaaaagacccatttacatctctcaaggataagtaatgtcaggggcaatttagtctaaatgatacagtctccacctcccttcctcccttcctcccttcttccctctctcacttatctattatctccctacatctgaaagtgcaccatcctgctgaaatcacatcctgttcacataacactgcagtccatagcttctgaatccacacagaagttctcgtgggcgataccaaatgccaagaggatgccttagaaggagtctggagatactcgaggattggcctctctagctcagaggttacactgtcatcaaatgtccaaagagctcttgtacagaatttttgtggtgcagttctaaaggagaagtaggactgaggtccatctgtgcaggctaacgaagaacagcccatactgaccaactggttgctacataataatattagctccccatccgaggatagtaaagctcaattgccaggcatgctgtagagggcatagctgtggtagatgtgggtttctaccatgttggtggttctactagcttttgttgttttgttgcatgcaacagaaaccatctttggttaacataagttggaaaggaattcattggaaaagatgtggcatccttcagagcgttgaaagaaaacttgaacaaccagaccagttctatctgattttggttcttgtgttacattcagcctaaattcaaattccagaaggagagagattatctggccgagctcaagttgcctaacaaactcttgggtcgggcttttaaaatgttctttcaaagactaaacgctgtgggggtaggatggcttttcaaaggagaatcgaagtactgatacggggagcagggggtggggagggggaagaaggcacagatgttgcgccaattggaacaacgtgtttgctacaatttctaaatgctacattgcagattgcagagagattggatgacaggcttcacctgaagagatagagatcaggacctgggaatccatgtgttaaaaagttcttgggtaattctgatggatagctgggtttagaagccagtgtaaggcaatatgtataaaagctctgaaaccagaatgactgagtttgaattccagtttggccactaactagctgataatcttgggctagttacctaacctccctgcttcagtttcctcatctataaaaagaggataaaatggcacccacctcatagggtccacgtgaggattaaatgagttaacctagatggtaagagcttcatgccgtaactggcacataggacatgctagttaatattattgccacaaatgatcctttcaagtcttagattgtgcatttcaaaagtccatccttatttttggaattgcatgcatttatcttgctttctgcaaaatggaaaggcatctcccatgggctggttggagagaggggctgataaaatgatggtaatgtgataaaatgcagttctcttgattgtcaagtgaattctgcatgattcttctgctctcatttgccacgggctgactgcttctgcaatgcagaacccgcttgtaaaggtcagaatgaattgcttccaaacatccctttgtccctcactgtcacgaagacacagagctgcatgctgtggaggaagaagcaaatccatgatgctggaaggccagagaacagaaaccaaccgtgcacagagaggcgagctgctgggacttgaatgaagctgatgcgtcccatctataaattattgtggcttctcctagttgggaggcaggaccagcctcacaatttcccagaagaccgtaatttctggagcctgcaggcctgggggcaaatggagaaatcaaaaggcagatggccttggagataggcagccagaaaggatgtgaaaggccctggttctggactcaagagacctcacgtttcctagtcttctttctgtctctgctcttttgtgttcatgaggttcatgccctcatgagggctcccccacctccagtggtctaggattctaggatgtcttggtattctttttcaaaaaaaaaaaactaagagccagcatttatagatataattctgtcctaaacactttacatataataattcttcattcttcattacaccctgtgagataggttatcattgttataattccatttcacagatgaggaaactgaggtactcagagactaaatgacttgctcaaggtcacttgtgagaggtccagctctaggccctctggcccgtggggctatgctcttacctagtacctcaaactgcctggtagacctcaaccctgtgtacctgcacaaatggtcctgaagcaggcagctttcttccctgagagctgcctttccagatatgcactgccaaaggtctgtgaccctacagccttggcctgatttggtccagatgcgtgtggacatctctcccaaacaggatcaaattggcctcttctaggagtttagaatttggaatcaagggtgctggttttagtctggactggtcacacagtttttgacaactgtttattgtacgggaaaagtgtccagcttgatgaattctcacacagtgaatttttctttgtaagcagagccccagaagcccttctttgctccttctaatctctacacgtccctccccatccatcaaaataaccactaccagaccagcaatcctttggctgcttttccccccacccccagtgatctattttattttattttggaaagaacacgtaacatgaaatctatcctcttaacaaagttttaagtgtaaaatgcatcattgttgatgatggatgcagtacgagacagcagatctctggggcttattcatcatgcttgactgaaacttgatgcccattggtaagtaattccccattttgcccttcttccaggctgtagccaccaccctttcactctgattttctatcaatttgactatttttgttactttacgtaagtggaatcatctagtatttgttttcctgtgactagtgtttttcatttaccataatgtcctcagggttcatctatgttgtctcattgcagaacttccttctttttggggggctgaaaaatattccatcatatgcataaacacattttccttatccatttgttcgtcagtggacacctagattgcttccacgtttagctgttgtgaagagtgctgcaatgaacatggaactgctaacatttcttcaggatgttaatttcaattcttttgggtaaatacccagaggtgagggtgctgaatcatatggtagttctatttttaatgttttgaggaaccttcacacgggctaaggacttgaataggcagttgtccgaggaagacatacaaatgaccaaaaggcatatgaaaatttaaaaagctaaacatcactaatcactaggcaaatgcaaatcaaaaccacaatgagatattatctcacacttgttaggatgactattttttttttttttttgagatggagtcttgctctgttgcccaggctggagtgcaatggcgtgatcctggctcactgcaacctccacctcccgggttcaagtgattctgctgcctcagcctcccagagtgctgggattacaggtgggagccaccacgcccggcctatttttttttttaaaaaagacaagtgttagcaaagatatggagagattggaacccttgtacactgttggcaggaatacaaaatgttgcagatactatggaaaacagtttgcctgcttttgagcacttaaaaaacaaaactaggctgggcccggtggctcacatctgtaatcccagcactttgggaggccgaggtaggggggatcacttgaggtcaggagtttgagaccagcctgaccaacatggcagaaccccgtccctgctgaaaatacaaaaactagcctggcatgatggtttttgtatctgtaatcccagctactcaggaggctgaggcaggagaatcgcttgaggttgcggtgagccgagatcatgctactgcactccagcctgggtaacagagcaagactccatctcaaacaaaaaccaaaaaacagaattatagagtagaccatctcttgtgtctggctggtttctttcatatgtgtgtgtgtgtggccacatgatattgaaaggacacatagcatcctgttcatcaggatgtccagcttcagagccagcaggggccaggcaggtgggtgaatgagtgacgtgtgtgaccacaggcatgtcccattggcccattgaacaccctatctgaaaggggcagcggcactcagctccgtttcctaattcctgctgtttaaaggatgaaggtctaagttttcccatttttttccagagaaatctgaaatcccctaaatttagattttgacagagaattcaagaattacaactgtggtgtattttaaacacatttttggactggattccttctgtgaacctccggtttacaacttctgcattcgtaggtggggactgtcagtggaaggtctcccccaccccacatcggaggggagaagggaaaatgtaaatttagtcaaatgggctttctttggagagtagagagtgtgcaatagtccaaggcagggagctttaaaagaatgcagaagtcttttttctctcttggtgtctgagctctaaattggctgggacatatccttagttaggagtcagtggctatagcgccccctgctgtcctttagcaccctcttcgtgtccagtgagatctgcaggtgagcctggaagccacttgcttctcctgcaggttttgggaggaagattcatcattttaaatattgctcaagtgcctgctgctgccagtgacttcataggctcctgttagactcaccttcacttatatttggtcaattacctactccctcagtcagaccttgccactcgattttttttttctttttgatacaaggtctcactgtgttgcctacgagtgcaatggtaccatcacggctcactgcagcctctgcttcccaggcttaagtgatcctcctgcctcagtctcccaagtagctggggctacaggcatgtgccgctacgcctggttgattttttaatttttttgtagagatggggtttcatcatgttgcccaggctggtctcaaactcttgggctcaagcaatcctcccaccttggcctcccaaagtgctgggactactcaggcataagccaccatgcccagccaccactctatttttttttaaattggaggtagggtaagaaggactgggccaggtcgtccttcccacaattccagtctcactgtttctatctattgaaaagcatttctggcatttgcttggtacctttccctggtttctgggctgaaatagattttatcccatttttaaacaattccttctgatactttcaggggtagtttgtggatgagagcagagtgaaatgcataggctcaggtttgtggccttgcaagttaataaagagtgtggactttggaactagcctgcctgggctccaatcttggctctggtacctactagctgtgtatcattgttttcattgttttgttttgttttattttgttttgtttgagacaggatctcactctgttgttggggccagagttcagtggtgcaatcatagctcactgcagcctccaattcctgggatcaagtgatcctcccacctcagcctcctgagtggttaggaccacaggcatacaccaccacacctggctaattttaaatttttttgtagagatggggtcttgctatgttgcccggatgggtcttagcctcccaaagtgctgggattacaggcatgaaccattgtgtcccaccttagctgtgcactttaaataagtcacttgacctctctgttcctgtttcttcatttacaaggtgaagatgataatatactacttcttagggtgagtattaaataagttaacctatgcaaagaggttaaaacagtgcctagcatatcatagaaatgtttgcttgacccagaggcctgaacctgctttgccttcagtgttggtctttaggtcctggcttcactccttaatgctgcatctcagcctttcctcatgaaactttctgtctttgatccttttcactccttaactgtgaatctcccaaattccactgagcagtgatcaattcttggggcatcttgctctgtgttcccagacattccttcaccctcattttctctccatggccaaatcctatagtgcctcctaaataattatagctgacatgtatgtagcacctatcatatgccacgtgctgttctaagtgattgatatatgctaactcatttaatcctcaccctatgagaaagatgcttttttaacacctattttatagaggaggaaactgaggcccagagaagtgaactgacttgccaggtcacataactaataagcagagtctggatttgagtttggctctagagcctgctcttagccaccatgtcccatcctcactgagaggacccttgttcaactccactaaccctctctggacaagtagcctctggtcctgtctccctgcttcctctctgtctcactggcctaccctttccacacctttctaaaaaccaaatgtgatcatgtcatcctctttgttgaaaacatgtcaatggcttcccattgttcttgggacaaagtaaatactctttgaagtggctgcgaagcagggtggacatacgtcctcctctgccaagcttgcctataaaccaaattggtttgttctgttgtgtcagcgtaccacaaggctggtgcccttgtcatcctcacaagagtccctgttggaagatacaggatatgattgtcctactcatgaggccctgcgtgctctggcgtcagggtccctccagcctttgcttgaccactctgagtaccttcgttcactcctctgttcatcctgccaccaggcatttgcacatacttctcccttggctgagatactcttctctctcttcttccctgtgagttcagtgggtctcaattctagttgcattgtagaatcttctgcagggctttttaactgaatgcagtgtctgcacccattccagaccaactaagtccaaatctctgattgattcagaacctctcagttgcatgcagggttaagggccctggtcaactcacgctggtcctctagactgcagctcaagcatcacttcctcagggaagcccttcctgacctccctgaccaggcccatttccaatattttgtactcagcacaccacatacctcttcttgctgtcacatatcttagggacatctaaatattaggttggtgcaaaagtaattgcggtttttgctattgtaaataatggtgcaatagtaattagttaaaagtaattaaaaataatggcaaaagcacagttacttctgcaccaacctaatatttacttacatggtgacaaagaacccagattctggataaaaatgaatcactagctgtgtgaccttgggcgagttacttaacttctctgtgtctcagttttctcccctataaaataggaatagtcaaaaacctgttttacatggtcgttgaggatcaaattagttcataatatgtaaggcgcttggaacagtgcctggcacatggtgagtgctgtatgtggtagctgttactgcactagtaattattaccccctgctgggatctgtaaatccctgaaggtggggttggcatccgttgtttgatcactccacacctaggatgctgcatgaacataatagctcttcaatacctgtctgttcagcagagtggcgtcctagtgaggttcttggtaaaagatgaaaggtgagatgtggaattgcaaaaaaaaaaaaaaagtatagacatcagagttggcctgcacagaattcaccttcctcagttagggcccttgtctatgcgggcctgctggttcagggtcattgtttctagcggtcatgaggatcagagcctgcctggacttgctgtgtgcagagtccccggtgcagatggccacctggcaggcatttgctccagcagcatcctttgcaggaatgggaggctcctctgtaattcacaaactcaccgtgtccttctatacagaggatctttctgctcttctgaaatgcagacttgggtgtgctgagagcttctgtgacagagggtgctgtcaggaagctgggcatccagggctgcacctggaaaccaagctggcagcggctttgcaagttgaataatcttatgttgtgatcttgcatttacgggaccccccacttagcaaaaaggggtgctcagaccacttcccttagttggcttacggcactgcagggggagaggggtggggaggggaggagatgggtgtggttttgtgggtgatggaggatttatttataatgtgggtgtgatccgttgccatgtgactattccctgaaactactgtacaccctgagcaatgaatgcacaacccggcctgcacaggaagaggtggggctcactctgtgaacagcctccaccagaactcgaaggccccctggggaataccaagcctaacccctttgttttcagaaggaggaactgagaccagaccatggcagtgacttgcccaagatcacagatgtcatttttattctaagctaacatttgtcatatggatactacatgccagtcactgtgccaagctaagcatcatcattgtgatttcattaatctgtacacatctagaaagcaggctcattatattcagcaaacacttgcatagtgtatatatgatgtgccaggcactgtgctgagtcttttacaaatattaatccattaaattctcataatcctatgaggatttagtgtgattattatttccttttatttatttatttaagacagagtcttgctcttgtcacccaggctggagtgcaatggcatgatctcggctcactgcaacctccacctcctgggttcgagcaattctcctgcctcaacttcctcccaagtagctgggactacaggcacccgccaccatgcccagctagctaatttttgtatttttagaagagatggggttttaccatgttggccaggctggtctcgaactcctggcctcaagtgatccgcccgccttggcctcccaaaatgctgggattacaggtgtgaactgccgcgcctggccttatttccattttaaagatgaggaccctgaagctcagagaggttgggtaacctgtccaaagtcacacagctgggaggtcattgagttgggagtcaatctcagacagtctggccttgaagtgtctgctccagcactgtcatttctctccatgtgacagctcttctctccattttacaggtgagaaaatcaaggcttatataactcaagtagcttgctcgaggctgcacgactggaaattaccagagctggtgttgaatttgcacattccagctatagaatctgacccctgatctcatgctaaactccctctcagtggggctagggtcttttggctgaggggtccaagctgggaacaggtcacgggggttgaggcagagcctgaagccagcaggtggaggtggggtggtgtcagccaggtctacctgggttgactctgaacctcatgcagtggagcagttactcccttcccatggggcagagccccagctaggtggccatcgcctggttacaccctctaattccttaagatttcagcttaaacttcattttctcagggaagccctcctgactctatccagccgacactctccttgtaaattctctaagcactgagtgtctcctttgcagctgttggaagtgtacattggtttatgcttctttattgttttccccaactagactgacatagggaaggtactcaacgaatatttggtgactaaatggttaaataagtgaatggcttatagctgtagtagaaggaattggcacaggaaatcaagactgaagtccaagaagtggaaatatatataaggtttattgggaaaagtcacaactcagtaggcacagggatgccctgagcagtgataattaataattaatagttaataataatagcttgtacttattgagtgcctgctctgtgtcaggcagctgttttaaaggttgtgggtaattcattccctagaacctcacaaaacaaatattgttatcccctagggataactaccgctagggttattatcctagctccccctagggttgttgttcctagacagttaaggttaactagggataacatcaagagagctggcccaaggtcaccatttcttcccagcttttaaccaacgttttgagaatacagtattccccatcaaaatcgtggctcaccacggctgtgagtttcacccagcggcctgggtggtcatggtgaaagctagaaatacatctctggaagacattttcaggtatgctacagaggctggcatacccgggctaagagctgctggcctggctaatgaactaagatcactcgttgaaacaacaggtataaatctccaagcagaaaagactcgcttaacatggatggcaaatgttgtctaccaagaagacccaagaaaataatcaaataccctttgccaagaatgtctggttataaaataaagatataaatgacaataacttttctgtattttagcaacaaccagttaaaataaatttgaaaaaatcccagttaaaatagcaataaagaggtaaaatacctaggaataaatacttaggccccaactaagagagtttatgggggaaaaaatcttttctggaaaaacacaagaaggctcaaattacatgtgaattccacccctagctcccccaatctgtttttctcctggcagccgtggttctatatcacatcccacctcaccccttagctcagccacagcacccagctctgcacaattccttattctaaattctgattggcccagttcttccttcataaatttcatatcactgacccaaccttggtctattcagcattggctggaagtatgaggtcagatgctttactgtccactgagctggtgctgtaggttggaatttttctagaagggtcaataagttaagcagccaatgattggcatttccagcacaatctgggagaatacatggataagaataaccaagaaaaatttgaaagtaagcaggaatgctaggggaggggccagtgggtataaaggtgtgtgcctctagataccaagagcttatactatggtatggtgcaacggtggggagagagagacagatcagtggagcataagacaatattaaaaaatgagccgagaatacataagaaattcgtgtatcataaaagaggcatttcaaatcagcagggaaaagatgcatttcatacatttgctgtctaaacattaagagtagaaataaaggtctttcttgagagctcatgctaaaatgaatgccaagggaaatgatgatttcaatgtaaaaaagtgaaaccataaaagactaccagaaaatatcaggaaggactttctaaatacgacagcagagacagaaaccatacaggaaaagggaaaaatttgcactttattaaacacgcaggcacacacacacacacacacagacacgcacatgcgttatacgttgaaaaaagaacatcgacaaaattaaaaggcaaatgagaaactgggaaaacatttactgcatatatcataggtgaagggttaatatccttaaataatacacaggaaaatttgttacaaataatttgaaagaaacaaacttgaattttaaaacaggcaaaattaatgataacagtgaacatttcttctttttttgtttgtttgttttggaagcaggatcttgctctgtcacccaggctagagtgcagtggtgtgatcctggttcgctgtagccttgaactcccggcctcaagtgatcctcccacttcatccccacaagtagctgggactataggcatgcgccaccataactaatttttttttttttttttttttttttagacagagtctcgctctgtggcccaggctggagtgcagcggtgcaatctcagctcactgcaagctccacctcctgggttcatgccatactcctgcctcagcctcccgagtagctgggactacaggtgcccgccaccacgcccagctaattttttgtattttttagtagagacggggtttcaccatgttggccaggatggtctcgatctcctgacctcgtgatccgcccacctcggcctcccaaagtgctgggattacaggtgtgagccactgcgcccggcccataactggctaatttttaaatgttttgtagagatagagacaagatattactatgttgtccaggctggtctcaaactcctgggctcaagcagtcctcccaccatggcctcccaaagtgctgggaatacaggcgtgagccaccggacctggcagaacatttcttaaatgttcatcttcaccagcaactttatgcagtttccatgcagtatctcactgaactcttactaacctaggaattaagcattattattattccagtttccacacaaggaaacgaaaacttaaaagggttaaataactttccctagagtcagaaagttaataactggaagagccaagagttaagcttagatgtggctactaattcacccctatattgacatggactgcagtgcagatcttaacccaggaaatggtattttaaattctgccaaagtttatacaatagaagcttatccttcaaatggaataattacgtattcgccaaatgggcggggttagaagagggcagggtatatcaggcggttgaagcaaatcgtcacccaacacacaagtgtttacatggtgttattggctctattcattctcctctccaggaacaaaatgaaagatcgtcaccaaattatagtgtccccttttcaaatgtgccatgcgtgtgtaattacagcttctaacattctccacttttcatgctcagacaatctccgtccactcagtctcaattaaggtttccctactttttttgtcttttgcaaatttttggccttttgtttgcagttgtgggcatggcagtactgatgtgttactcacggtggtagtacaagaggtgagatttttgtaatacccagataaaccctaaaatattctactttacatcaaaagtatagaaaagtctgtgctgagaagttttactctctgtctactttattctctcttgcctccatagatgaacacttgtattaggttttttttttctttttttttttttggtgtatcctgccagaggtgtaattaagagtcgactttccccggttactcaggaggctcaggcaggaggatcacttgagcccagaagtttgaggctccagtgaactatgatctcgccactgtgctccagcctgggcaacatagtgagaccttgtctctgaaaataattttaaaaagaaaggatacacacttaacttattgcacctcgctttctcacacacacaaaaggtaccatgtaatatacacacctcagcaccttgatttttttgtttgtttcacttaaaaaatacaaccttggtcgggtgcagtggctcacgcctgtaatcctagcattctgggaggccgaagcaggcggaccacttgagcttgagctcaggcgaccagcctgactaatatggcgaaaccctgtctctgcaaaaaatataaaaagtagctaggcatggtagcgtgcaccagtagtcccagacacttcgggggctgaggcaggaggattgtttgaacctgggaggttgaggctgcagtgagccgagattgcactgctgcactccagcctgggtgacaaagtgaggccttgcctaaaaaaaaaaaagaaaaaaaaatgagatttttttccatattaatgcagagaacttcctcattgtactttatacctgagtagtcttccattatgtggctacactatgatttatttaaacaaccctttcccagtgacacttagcgtgtttaaatcttatgctaccctaaacagggcttcagtgaataactgtatctgtatattacttcctatgtatgcaggttattttaccttcgtccaacgtgatggagtgaaaggtgaaaagaatttgtaattttacaaaagcatttgtactttggataggtagtgccaaattgcccccacaggatgacaccaattggcccacccaccaggaatatgtgtctctgtttctccacagcttttcaacagaaactgtcgggatgaacatttaaaattttcattttaaaattttaaattgtctacttcattttaaggtgcattagaaaaggcagtttgcatattgatcccatgagttcacactcttagtttcatttttaaaaataggtttatttaaataaaaatggcagtactgaattgaagaaaaatatcaagtaaatattatgttggtgcaaaagtaattgcggtttttgccattactttcaatggtaaaatccacaatgacttttgcacctacctaatactgttacaggttgaatgcaggcatgcgaagttatgacagctcatgactgaagctggggaaatgttgccatgatgattttttctcttgggaataataaaatcaagaggttttatgttctgtgtgcaggacactgtgcttgaggttttataaagtggatacggttattggacccattttatggctgaggaaccagagactcagggtggttaagtcacttccctgaggtcacacagctaactctggagcctgcgcttgttaatttccctctgttctgagggtatttccaactgggaccttcaatttaaccttgcctacctaccccatgggaagtagagcctcaggagctttcatagcttgtaaatgtccagggatgacacagtctgaacttgcaatttgcttttcctttctcctctatggatgctgttagcttgtgttttctctctgtgtgcctcatttcagcttccttattcctgcagttttacttcagcccaaccagatttcagcccacctgtgggcaaagctgcacagcccattcagactgagagagacttttctttttctttctttctttctttctttctttctttctttctttctttctttctttctttctttctttctctttctttctttctttccctccctccctcccttctttctttctttctttttttctttctttctttccttctctctctttctttctttccttccttccttccttctttcttttcctccctccctctctccctcccttcccttccttcctctttctttctttctttctttctttctttctttctttctttctttccttccttccttccttcttcctttcttcctttctttttctttcttttctccctctccctcccttccttccttccttccttccttccttccttccttccttccttccttccttccttccttcctccttccctccctccctcccccctcctccatctctctcacctgtgcttcctttcctcttagctgcctgtgtctgggattaagtgatgacctaggatctgcctgtctttgatgctggggattgtttttcactataaagactctggtttgggggtggcagggacccaagtactctgtcactggccggtgctgaatttgtgtgagatgaagagtgttattgtctataacccccgtgttaggtgggagactctctggggaggctgaggagcaggggggcagccaggggacactgaggggttcccactcggctggctgcatttctggagtctgacaaacttggcttccagtcctggctctcccatgtccttgctttgtgaccttgggcaagttacttctctgagcctcagttttctcatctggaataccaggataacagtctaactcctccatcactgggctgtcaggagaatctggggacatgacatagaggactcagcacagtgcttggcaggtagtatgtgttcaattcaataaaattggtggcagtaaaagtcacattcgacggttattttgttgttgtattcaacaatctcttgaataaagattggaaatggaaggaaatttgggaatccaagcttgcctaataccaggcatgtggagatggagcctcagcaacaggaaatactgggaagaggaatcgtgccaggatcctgtggaaacctgatttccaggggtgggcgagatgactggggatgatcaaggggtgatgctgcggcaggagtgtaatagtttcaaacctgtttttgagagcacttgagactgagtcagacaaactcactcgggagtttaggggatgtgttcacatggggttggattccagcactgttgggaagaaggtagggagtctggcagaggtcccaaatccaaattcctacagggtccaggcaggaaaggggaaagagagaagcaggcctggtgtaagacaatagggaagagtggggactgtggaaaactagaaagtttattacttatctaaaggggaaaaccactgctcagcccacagaaatgagtgttctgtgttgtcacagctgatgatttctcaaaaggaagcaatatttcacattttttattctttctttctttcttttttttgtttgagacagagtctcgctctgttgcccaggctggagtgcagtggtgcgatctcagctcactgcaagctccgcctcccgggttcatgccattatcctgcctcagcctcctgagtagctgggactagaggtgcatgccgccacgcccggctaattctttttgtatttttagtagagacagggtttcaccgtgttagccaggatggtctcgatctcctgacctcgtgatccgcctgcctcggactcccaaagtgctgggattacaggcgtgagccactgtgcctggccaaaatttcacattttaatctgatagttcctgacttaaatatagtaaacttatttggatttctaagaagcaccttgttggccaacggtagcttctttacaggcttgatatagcttctgggttccacactgtggcccctgggcatgaaggagggcccaggccagggatgggacaggctctaggtggcctggaggtgtctagtcagtgtggcctgggtgacgaggatctgatgtaaaatgagactaggggagggattgaggcagagatggaagctgtgtctttttttttgtttttgagtcagagtttctctctgtcactggagtgcagtggtgccatcatggctcactgcagccttgaattcctgggctcaagcgatcttcccaccttggctgggattacaggcatgagccactgctcccagccaggaagctgcatctttgaatgcgatcagaaccaaaccccatagagggagtgatggcttacaggccatgaggattcccagactcatctcaggcttggtcaatacccacagcatcaaggctaggaagggaatgtattttggttaaaggcaggactgatacttatttatttattttgagacggagtctcgctctgtcacccaggctggagtgcagtggcgggatctcggctcactgcaagctctgcctcccaggttcacaccattctcctgcctcagcctcctgaatagctgggactacaggcgcccgccaccacgcccggctaattttttgtatttttagtagagacggggtttcaccgtgttagccaggatggtcttgatctcctgacctcgtgatccgccagcctcggcctcccaaagtgctgggattacagacgtgagccaccgcacccggccaggcaggactgatatttaacctgcatgccctggcactactgtaccagtggtggaaatattgaaatactctgaaaccgatgggtaaatagccactgggtcctctgggccttttcccccaaccttccacttacccatatctgcctctgccagctcctaccacaccccctccatgacgtggtgactagagtgctaactcccagcacagccaggctctgctgtccattccgtttggtctgtgggcagtccctgagccaaggcaattatagatatcttgactcacccctggttgtaggtaacatgcctacctggattggctgaagcacaaaggacaaattttagaggacacagggaggcagatggaattggaaggcaggatgccagaaccccagggaccagaaccaggagcttcatccctggggtcatgtagtctttgtctttgtttctccaggttcctcagagcgcaccataaaaatcagcaccaactgtcatttgctacaatgtggatgaacctggaggacattatgctaagtgaaataagccaggcacagaaagacaaatactgcatgatctcacttagatgtggaatctaatgaagttgaactcacagaagtagagagtagaatgatggttaccagaagctgggggacagcaggaggcaggagtagggaagaaatggagagttgctgagcaaagagtacaatgtttcggataggaggaattgcctttgagatctattgcacagcagggtgacattagtcaataatatgtatgtttcaaagtaattaagagagtaaatttcaaatatctcaagctaagaaaatgataggcaagttaggtgatggatatgttaattttcttgatttaatcatgccacattgtgtgtgtatattcagaacaatcagaacaatcacattgtaccccataaatgcatacaattataatttgtcaatcaaatataaaattagcagcctcagccctggaactgtatgtctgctggcctcaggactgattacctgtgtcccagccactcagcatatgtgacccttgagccaagtgtccacctctgccccagtcagctgtgttcagggaatgtggatgtctcaaagtacaagcatggcttttgggaggtgcccatctcagagatggcattgggctcaggcaggcatggaaaggtaccctgaaagatgcaccttgagggtcgtggagggagtcatgaggaccacaggtgtaggagtgtggctttaagctctttcaggtagcaggaaggaggagggaagaatccactgaggatgacctggtttgtctggtctgaaggattggggcagtgggtgggtagagttggtgcctacaagtatgatccctcatgaaagcggagggaggggaatgaggtcagaggagctctccagcagcctctaaataagccgtaagaagtcaatgtttccctgcaacttgccgattggttttcctgtctctcatctggctctaatctgtgctgcacagccccttctaagtcattttcctaaaatagcatgtttatggtgcaggggtttgcagtggccaacagcgatgattgcagccctacagctgtcacaacaacccattgaccactgtgtgcaatgctgtgcttgccacgggcaaaacacttcgtctcttagttcttcggtttcctcatctgtaaaacaggggtagtaagtagtatgtactttatagggctgttatgaggatcgaatgcattaatgcctgatgaatcccttaaaatagtccctggcatgaataaatgttccataaatgttaactctcacttattaagtatttattgagcatcttctgtatgccaagtacagtttatgccctgagagtataatgatgagcaaaatttcctcacattgcatgcagtgaagtgtggaagagatgcaattaagcgtgcatttataagtcagtggtttaagtgccgtgatggagaggatttagaatataagttccatgaaagcagaagctcttttgttcacagctgtatccccaatgcctaggaagaacttgaccctcagtatacatttgctaggtgaatgaacgaatgagtcaagttctatcttagccgcacatgaagatgaggtgtcaatggagtaaagttgggagtgaggagagaagggaggggaacttggtgtgaaccccatctctgcaagggtccagctgggtggccttggtgaagttactctgtagttaggatctgtttcattgttgctaaaatgggaacaaatgataccttctgcatggcatgtcataaggattggagagagtacatgtgagacacccagcgtacacatgtagctctcaagcagtgtgttgagactgggtgtggtggttcacacctgtaatcctagtactttgcaaggctgaggcaggcagatcacttgagcccaggagtttgagaccagcctgggcaacatagcaaaaaccctgtctctacaaaaaataaaaattagccaggcatatggcatgtgccttcagtcccagctgctcaggaggctgaggtggaagggtcgcttgaacctgggaggcagaggctgcggtgagctatgatcgcaccactgcactccagcctgcatgacagagcaagaccctgtctcaacaagacaaaaaacaaaacacacacaaacacagaaatgtgtttccttttcccttcccattctttgtgcttcttggtatctcctcttgtttaagagactgttgatatggagaaaggtctggatcatttttggtcagaaatgcttgaatccttgtcttggagatcgctcaagaaaatatttacatgaagaaaagtgcaaaaccaacagaggcaacttattattagttgtgattttgccccagatcttaaagtagagctcacaaggccttgaggaactcctttcttctctactaggcaggactaaggaaattcaaacctgaactcaaacctaactcttggcctctgtaagatcaatatatcagagaaaccagaagggaccacaagagccaagagtagagacagaatgtgtcctaggtcttggagaggagctggctcaggccacttctaccaagggtctcagggcaatactataagacttggacccagtagcgtcctgggagaagtgaaggatgtaagggagaaggagaagagaaagatggcaaggatgccttttaacctccatgcgagctccaccactggggtctggccaatccgtgtcttggaatccatccaattaaatcaactctgcctccttagaggttaagtaggggtgtaagagaacctggagcttctcctacaggccaataccagtcatgaacaggggttccttttttattattattatactttaagttctggggtacacgtgcagaatgtgcagttttgtttcataggtatacacctgccatggtggtttgctggacccatcaacttgtcatctacattaggtatttctcctaatgcctcccctagtcccccaccccccgacaggtccaggtgtattatgttcccctccctgtgtcgatgtgttctcatcgttcaactcccacttatgagtgagaacatgcggtgtttgattttcgaacaggtgttcctttttaggtgggtttgaagcactgaactcccaactttaaggtgaatgtccaagaagcacaatgggaactgttctgtggcacagagcagggggactctgataggaaccttatgtattcacttagtctcattgtccggagatagagacatggctggttaagctgccaaaagggatcccttagttttttggggggtggatttccaagccctgttgttgttactaggacggcacctcaatctttgagcaggacagatgattgctggggtccttttgtagctgagagcactcagggtcccactggcgacagcagaaaagacctcgcttctcaaacttggctgtccagtgctctggacgagtacttcatctgcctgactgcagagggtgggaacgttgtgaaagaaactttgtagctcattaacaagataagaagcaaccgaagtctgcagtggctgaggattttcagtcaggtttattgagacatacgtttcctgtggtaaaagtcactttaaacaattttttttgagacagggtcttgctctcccacccatgctggagtccagtggcgtgatcatagctcactgcagccttgaactcttgggttcaagtgatcctcccaccttggcctccctagtagctagaactacaggcatgcaccactatgtctggctttaatacatatatatagtagagacagggtctcactgtgttgcctaggctgatctcaaactcctgggttcaagctcaagcagtcctcccgccttggcctcctaaagtgttgggattgaaggcatgagctactgtgcccagcaaaattcactttttttcttttttcttttttttgagatggagtcttgctctgtcgcccaggctggagtgcagtggcatgatttcagctcactgcaacctctgcctcttgggttcaagcaattcttctgtctcagcctcccaagtagctgggactacaggtgcatgccactatgcccagctaatttttgtattttaaatagagacagggtttcaccatatcggtcaggctggtcttgaactcctgacctaaggtgatccacccacctcggcttcccgaagtgctgggattacaggcatgagccactgctccaggccacaaattcacttttaaaaatataaagtaaaattcatcacagttaatatatagaccactccaatatccaaaacaaaaaagttgctgcatctgcctctttttagttaattccctatccacctccaaccccttttaaccactgatgttttctgtccccatagttttgtgtttttcagaacatttagaaatgaacctacacttgtgttgaacatctttgttttaccagaatcctttcgaggttcatgaatgctgctgcatgtgtcaatagttcattcctttttactgctgaaaagtattccactgtgtggatgcctcacactgtatccattcacacgtcgaacgacatttgggtcctttccagtttggggctattataagtaaggtagctataaaccttcatgtatggatatggttgttgttttttttttttccccttctctgtcacccaggctggagtgcagtagcacgatctcggctcactgcaacctccgcctcctgggttcaagtgattctcgtgcctcaccctcccaagtagctgggactacaggcatgtgccaccacaccctgctaatttttgtatttttaatagagacagggttcctccatgttggccaggctggtctcgaactcctgacctcaagcgatctgcccgcctcggcctcccaaagtgctggaattacaggcgtgagccactgtgcccggcctggatgttttcatttcaccgaaaagtaggattcctgggtcctaggagagttccagtttatgttctttcttcactaacacttggtatcgttggttttagttttcaaacattttagcaactctggtaggtatgtgatatggttaggctttgtgtccccacctaaatctcatcttgaattgtaatcctcataatccacacatgtcaagggagagaccaggtggaggcaattgaatcttggggcagtttcccccatgctgttctcatgatagcgagtgagttctcacacgatctgatggttttataaggggcatgtccccctttgctcggcacttctccttcctgctgctttgtgaagaaggtgccttgctttcccttcgccttccactacgattttaagtttcttgaggcctcctcgtcctcaagaaaattgactgttagtcaattaaatctctttcctttgtaaattacccaatctcaggcagttctttatagcagtatgaaagcagactaatacagtatggaattattttaaagttttgaaaagaacagtttccttaggagaagcactcatcacattaacagcacataaaagaatatctatgtagtatgtctgtttatttgcttacatgttcattttctgtcactagagtacaattttaaaggaggcatctgtggcagcatcaataaatacatgtgaatggatgaatgaaggaaggaagaaactggtagcatgtaccaaaggctagggtgtcagatcagccctggattggaacctaaggcccatgttattaacttctgccatgtacttttttttcctttttttaagagagagagggtcttgctctcttgcccaggctggagtgcagtgatgcaatcatagctcacacatagccttgaattcttgggctcaagtgatcttcccacttcaacttcccaagtagctgggactacaggcatatgccaccacacctggctaattttttattgttgtagacatggggtctcactatgttgcccaggctggtcttgatctcctggcctcaagtgatcctcccaccttggcctctcaaagtgctggggttataggcgtgagacactgtacctggtctgcaatgtataacagagaaagcaacttttacagaaagagttctcttgaactaaaaccaattctgtgaggaaagaatctcttgaagaagaaagagaaatgcagagccaaaggcttacaaagggcatggtctgtttgggagcgggggtgcgctctgagtgctgagaatgtacatagtatgtgtgcatgtgggtgggtgggaggagggggcttagctggggatcaccttggccaaatagtaatagcaatcatggaaagcttatgctgcttgctatgtgccaggtggttctaagacctctacacaggttcattcatttatgcttcccaacagtcttataaggagagcactagcattatcagcattttacagatagggaaactgaagcacaaaaagatcaaattagctgggcatggtggtgtgcacctggcattccagcaattttggaggctgaggtgggaggatcatttgaggccaggaatttgagactagcctgggcaacatagtgagacccccctctctacaaaaaaaaaaaaaaaattaaaaattagctgggcaggttgggcacagtggctcatgcctgtagtcccagctactcgggaggctgagacagaagaatcacttgaacccaggagacagaggttgcagtgagccaagattgtgccactgcactccagcctgggtgataagagcaaaactctatctcaaaaaaaaaaaaaagatcagctcagcatagttgcatgcacctgtagtcccagctactcaagaagctgaggcaggagaatcacttgagcccaggaagtcaaggtcccagtgagctataattgtgccactgcactccagcctgggtgacagagcaaaaccatgtctcttaaaaaacaaaagaaaacaaaaaaccatcaaacaacttgcacaaactcacacagcttagagccccggaagtttatccaagtctgccttttaccactgcactgcactgccaggctatcaagggcatatttattgattaggaaattatgtaaggttctgtgagaaatagctcccaaaatatagtgacttaaacaaggcagaaattaggtttttctctcaggggtcagcccaaagggacaaaattcaaggctggtagggtggctttgtcctttccacatatggctccaagtttgggtccaggacagtcacttccagttctcaccatctttgaaccagtggggagagggaaaggctcaaggaagtatgcatttccatttgaagggaatggccctggagcacacacatcccattggccagaactcagcaccatggcggcacctgcaagaggtgctgggaaatatggcctctatctggatagccatgctctctgctaaaactcaaggattctactattaaagggaagaatggatattggtggaaaaccagcagtctctgccacaacttgcagactgtccactgggctttgaactttattctgtcagtgatgaggaactggcaatggtttctaagcagggagatttcacatccagacttgggtttttgatcactgcagaagcatgcttggagaataaaggtggggagaaagaaaagtcaggagccctgtttagatgatgtgtctgttactttgttttcccatctctggagtccctactacaggcaggagcctgtaggttgagttcccaggcaggcccagatggagggtttgcaggcagggtgagtgagcatggggctgcaaagggaacaatcatctgtctttgtccttcattccttccacaactatttatccagcaccgtttctgggcacagggctccagcgatggtcccaacaggtacaatgacctctggggaccaagttcagttcttggtgagttctccagtgcctctcgatgtaggatgaaccgttggcatgctccactgacgctggctccttctgttgtttctcttggctccaggacccccgcagcaaacacaagtttaagatccacacgtactccagccccacgttttgtgaccactgtgggtcactgctgtatggactcatccaccaggggatgaaatgtgacagtaagtactttttctctctgggggcatctgctgatggcagaagcaatgggaagggctgcttccacttggtttggggtccaggtctgccatacattcccccctgtcctcgttggggctggtgtaccagttatctgttgctgcataatgatcctcccaccccaaaacactgtgactgaagacaataaacatttttttagctcatgactctgcaaggcagttctttgaatctgggctggcctcagctgatgtcacgcatgttcataaagcatgaactcatggttcatggtggattagcagatggaggtgggctgggagctgtctgggccatggtggcctcacccacatgtcctggaggatggctggctgtcatctgggtgatggtgatgaccaggccacgtgtctttcctcctcagtgggctaggctacctagcctccgtgcatgcacggaggtcacagggtcctgagtttcttaggagggcaagtcccattggcagccacacttcaagtctctacttgtgtcttttgctcctgatccactggtcaaagcaagtggcatgtgagatgcacagtcacagtgtgggaaggggcagtccatggctgttgacacccagaggcatgaacaaatcatgggcatttctgcagccatgcaccaccactgttttcagcattgagatgtggggctgatgcattctttgcatggagaagacctgtggccctgcagcacccacaggtttgtgctggaggaggaaagagcatcattctctggccaggatgtggtaggaaaggcaggtggggtaggactcctctttatgaggccaaggcccggatggcctgtggggcaggggagcagacaggctttgagagctatggccacaaagctacagggacactggaggtgctggtggctcccacagacctgttggtctgcagcaggctgggtgtcatgaggctagtggtactgctctcccaagggtcctgaggcccagaggacagagggagaaagtcatagggcagagagtgacagagaggactgtgagggtgaataagggtggtagggagcaagacagacagcaagaaacacacatgcatagacagacacagatgcaggggaaagatggacacatgcaaccctaacacagggaggaatgtggggcgtggaagctacagagagactcagctagagagagactcaggcaaaaggagggacaggcagacacacagaccaacagataagccaggtgcagtggttcactcctgtaatcccaacactttgggaggctgaggcgggtggatcacctaaggtcaggagtttgagaccagcttggccaacgtggcaaaacccaatctctactaaaaatacaaaaattagccagtcaaggtggtgggtacttgtaatcccagctacttgggaggctgaggcaggaaaatcacttgaacccaggaagcagaggttgcagtgagctgagatcacactactgcactccagcctgggtgacagagtgagactctcaaagaagaagaagaagaaaagataaaatgattggcatggacacagagagagacgccattacacaggctcatgcagaggtatagagatggaaagaccagagacagagacagaagcacacatggagagccacagagagacacggaggagagaggcagagagacacagttggagaaagggagagacaaagaggccagagacaagtgcagagagtggaacagaccgattcacagacacggccaaggcagtgagccacgtgcagaagtgggacagcagagacaagagacatgcagcaacgtggaaacagagagacagacacagaaacatggcaagagccacagggggacagtgaggttggagccttctgcctgcaggacaccagctcctcttaccacacatggggccctaatatagggacaatgtccctgcctcagagacagtggtgggtgggagctcaggctggtgctcaggtcccagagggctctcccttccctccccacaactcatttctagtttttgtaataggcctgctgcctcctgggacttgggtggtctgagaagggtcccttgcccccagatcccttgaaataggggcccatggggtgacttggcctctccttctggcttctccaactggaactagcgtccccctggagaatcctgggtgcctggcacaccttcctggagtggggcattattgctcaagacctagaagaaatcacccaccacattgaaatagacacagatactctacggaggagtgcgcagagggagtggatatcctataacatgagagatggccgaaggccaaattcagtgtataggcacattttatccaccctgccctggctctaaatctttttccttgtaattaattatggtggacactatggccagcccagaccccctcttcatggtcccaccccatcccctagctgtggttcacagcagtgccccatcctgcataattgcccaagataatgcctcttccagggagaccagatgattgtggtgcccagccctcttgtctcagtttggaacaactctgaagggtcatctcagctctgggctccccctaacatcagctttgattgcatccacgtggcaaacgaacttctccccacaagagcactccccaaaaaccttgtgctcaaaactccccgtctcagactctttccagggagcccaacctattagctgttaatatttaaaaatcagagctgtcacgtacacatcgagattcctgcatacgttgagaaatggggaatgtttttgctctgtttcccacttggcttggccaagtccctgccacccccttagctttcctcactcatgtgaccagccagcctgtgagcattgaagttggtgactctggcttcagagccttaaggggtgtggggtgtgcttgcttcagactgcacccttggctgtgggtggggaacagacaagttctacctcctttgcccatcagggttcagggggaagagttggaaaagcccttctgatgagatcctggcaggcaagttggtctcagccaggctcgtgtgtctcagctgtctcaaaggagggaaacaggaagggctcagcggtcttgggtggggcagatgtctgcagcccccagcctgggccagcctaagccacatcccctctctctgccctcacagcctgcatgatgaatgtgcacaagcgctgcgtgatgaatgttcccagcctgtgtggcacggaccacacggagcgccgcggccgcatctacatccaggcccacatcgacagggacgtcctcattgtcctcggtaggtggccctggggctccactggctcctgaccttgcttgacctgtgtgattgagaaggggagggtggcggaggggtggggcagtccagtggaggggtggggcagtccagggacggggagggggtgtggcactgcttctgccccatgccctgcccatgacagcccctccctgcagcagggggatctttagaaactgtacaccctcaaagcttcgtccatcagcaccccaggctgacttgggttcagagaggagacgtctgagttccttggacttctaacttcctcaggatcctccacttcccttctctccttctcatttcccactcttttttagtaatcttttgggatgggtagttgcatttcctttactcagatagcagagaagggaagcttgcttcttccgcaaacttttccagcaggaaaaatggagtcttgatgataaaccccagatttggagaatataatatcttgggaaggaggagggttggagggtgcaattcaggggctttccacatatttgaaatatttctttcttgaacctgatggtggctatgctgtaattttattattctctatattttctgcatgtctaaaatatttcatgataattagaaagcaggatggtacagtctcctgggagatgcagtgagaggaggagctgctggtggtggtggtggtggtggtggtggggctgtcactcatgtatcccagcattcaagacatacctggctctgatatgggaagttcaagcaaaattggaactcagcagcactggcttgaggaatactcagccataagccccggtataaccagcactgagctggctgggagtggagctaaaactttgcaggaatttcttctcaaaggctagtgacaaactactgtggactttatatatctaatgaatataaataagggtttatgagttggtaactcaggaaattgatcatggaagagattaattttgcaaaaattagtgtttctgaggcctcagactggttcagtagctctgatgcattgagccctgggttgcggaggggctttacgtagattgtgtaaaagctgaaaaatacttatccctgtacaatataattcttttaaacttgagatttcgtgaagcccagtgagattttagaaaatgtgcaatccattgcattatgttttcctccaagtggtcgcctgcctcccagtgtgatgcttgggggccccaggggaaatcccgcagtttcaggttcaagggaagccagttttccccactgattgaggttcccgatgctggtgagacaaatatgagactctgcttccctctggtgtcattctgtgggaaatacactcgttccaaagcatgactgcgggcagccaacatttatgggccgcatgggatgtgcagtgctctaaaccttacgtgttatctctttccaccttcacaacattgtgaaatctctattattcttgtttgagagggagactccatctgttgcccaggctggagtgtggtggcgccatcttagctcactggaacctccacctcccgggttcaagcgattctcctgcctcagcctcctgagtagctgggattacaggcgcccaccaccacgcctggctaatatttgtatttttagtagagacagggtttcaccacgttggccaggctggtctagaactcctgacctcaagtgatccgcccatctcggcctcccaaagtgctgggattacaggtgtgagccactgcgcccaaccttctattattcttgttttatgaacaaagaagccacggctcagagaagttatattccaagagctcacaccatttgcaataataataaaacaatagctaagatgtgtttagtttttaaaatgtgttaatcattgtgaaaagcacttacaggcagtatctgatttacattgtttcaacaactcaaatgagttaagttatcattctacccatcagaaaacacatttcctcacctaggtctgtttgactcaaaagtactatatagtaggttacttttttgtttagtttagtttcgtttcgtttctctatgccctccaccgtatttattccttttgtggtttggctagggcacctcctatgggcattccttagggagtctttgttctgatgtggtacagtacaatatttcttcaagttcaaggtcaaagtcttcccccttaatcatagatatgctgtgaactttgagaacctggatcacaagcccccgcttctcaggacacactgataggaggtgtatccatttgctgtggctgccataacaaaataccacaaactgggtggcttaagacaagacgtttaaaaaaaaaaaaaaagaaacgaaaagaaaaagaaaaaaacaataggccaggcacagtggctcatgcctataatcccagcgctttggaagaccgaggtgggtggatcacttgaactcaggagtcagcctgggcaacatgtcgaaacatcatctctactaaaaatacaaaaaattagccaagtgtggtggtgcacgactgtaatcccagctacttgggaggctgaggcaggaggatcacttgagcctgggaggtggaggttgcagtgagctgagattgcaccactgcactccagcctgggtgacagagcaagactccgtctcataaaacaaaaacaagaaaaacaaacaaacaaaaaaggccaggtgtggtggctcacacctgtaatcccagcactttgggaggctaagacaggaggattgcttgagactaggcgttcaagaccagcctggccaacatagtgagaccctggcatattgtaggatttcatttctttgggatgttcagagcaggcaaatgtataaagaagtttaatagcactttgtgcttttccaaatactttgatatcacaccattcgggaaagggcacgttgttgccatcatggaagggaaaacgaagtctcagcaaggctgaacaccctgaccaatgtcacatgctgagcaggggtgagcacctgggcctctggccccatgtcacaatgccctgcaattgcccatacaccatgctgggcacagcctgtactcagcatgggcttgttgattgatggatgatagaagagagccctgatgctgtggccgagttctctaaaaatagagccaagatggggattttgttccagtgatttattgggctgctcatgggaaaagagaagtgaaggaaccatgcttccttcctcaggcagggaaaaagcttggcgagagtgtggtctccgtggaagtcttcttcagcctggtatctggtggaattttgtaccaaacactgtagcacagtcagtcccatcttgaggcaagggggctgttctgtcgtgttccaggtcagtcagtgctgtgggatgacttgtgtctcccccagatttgtatcttaaagcctcacccccagtgtggtggtatttggagctatgggacctttgggtggtaattagggttagatgaggttgtgagggtggggccctcataatgggatttgtggatttctaagaggaagaagaaagagagatcattctgtctccaccaaaggaaggatacagcaagaaggtggccgtctgcaagccaggaagtgagtccttaccaggaattgaagctgctggtacctcgatcttggacttcccagcccccagaactgtgaagaaataaatgtctttttttctttttttctttttattttgttttagatggagtcttgctctgtcacccaggctggagtgcagtggcatgatctctgctcactgcaacctctgcctctcatgttcaagcgattctccggtctcagcctcccgagtggctaggattacaggcacgtgccaccatgcccagctgattttttttatttttagtagagacggagtttcaccatgttagccaggatggtctcaatctcctgacctcaagtgatccgcccgccttggcctcccaaagtgttgggattacaggcgtgagccactgtgccggcctaaatgtctgttgtttaagccacccagtccatggtattctgttatgacagcctgagctggctgatatagtcagttactgctgtaggctgctggggatggaggtgggaaggtagagtaacttcccaggtgaggaggcttctgtgcagttgaggacagttatctggacataggggtaactgtgagccattaacagccatcatacacagcacccaggggatgggtgcattggccagcatggaggggagctgggcagggtccaacagcatctggcacactcaagtttcccttggtctcctgactgtcttcctggtttcattgctgggactccagccccctcctccttggtcttggcaagacagatcagagaggagcgagcactaaaggttgtgcggggtccttcccagcagtgccaggccagaagtggccttgtggtgtttgtggaatggccccacctcatccagacccaagaagcatggtcagtattaggattttccactgaccatcagcccaggacactgccgtttgccctgagtgtcatatgttctttggaaatctcagcatctctagaggtcaaaggttttctaacttgcctggctactgaaattgagctcatatatctgttcttagtgttttggcaggtcaagatgagaataaatctgatcagttctcctccttttaaaaacccatcaatggtttcccattgtctttataacagactaaatctaacatggcgatctcattctttattcactgtctcctccccctttcttttaatccttggtcctctgcagactgccacacaccataagacatctgtgcgttctgtttagaatgtttgccattgccatcttctctttttctagcaattaactcttcctctcgatctcggttcatttttaccatctaataagcttcctccaacttccccctttcgtagacactcatggtaacctgagcttggccttgtgaaaggggtgattttatgttggatttgattaatgtctgcatctcatcacaaggcattagctccatgagggcgggactgtgtcttgccactctactcccagcacctagcaaggtgggcatcactaaatatttatgggctcaatggctgtatgtatgaatgagaaacccctggaggatcctgatagatagatataaggctttcactgatggtccccagatcagtgcctcctaaagtcaggaaatgaaggtcaacggattgtccaatttataccattattctcatgggaggtagaacatgcagaaaatcttaagtaccaggtccaacgtcaacagcaaatgttactgggactgagacccgcttgttggagtcatgaccacccttgttccctggacaatgtagaaaagacatggagcagtgggatttgtagtatcccaggaaaccgtattgacatcatgatgcccataggtgtcatgagatcaggcaatacaatgtccagatcagagttgtaaaatgctcccaaggtttgtgaagcctgcgtgttcatacatgcaacaataattttttttgtgtgtgtgtgacagagtcttgctgtcacccaggctggagtgcagtggtgcaatctcagctcactgcaacctccccctcccaggttcaagccattctcctgcctcagcctcccgagtagctgcgactacaggcgcatgccaccatggccggctaatttttttttgtatttttggtagagatggagtttcactgtgttagccaggatggtctcgatctcctgacctcatgatttgcccacctcagcctcccaaagggctgggattacaggcgtgagccaccgcacccagctaacaatatcttattcaatgctttttcaattcagtatctacctatcaacataacaactgacatctattatttatactcccatctacattacagccacctccaaatgcttagccatgtccatcctcatatctatctcccaaaagttgggagtgttcttaaagaaagcagaaagaacctttttttttttaaatgtttctctttggaactcccattctatattcttaccattatattgtgttatacagaaactttttagactgaaacatctccctgacagccttaggtactcccaatattgtgatatttaaatccttcttaagatctgacatccacacatcaaaagaaaaagagtaccaaagaggctgagtgtggtggctcacgtcggtaatcccagcattttgggaggctgaggcggctgtatcacctacagtcaggagttcaagaccaacgtgacaaaaccctgtctctactaaaaatacaaaaattagccaggtgtggtggtggatgcctgtaatcccagctactcaggaggctgagacaggagaatcgcttggacccaggaggcagaggttgcagtgagctgagattgcatcacagcactccagcctgggtaacagagtgagactccatcttggaaaaaaaaaaaaaaaagaattgggaagaaaaagggcaatgtaaacaagaaaaaaaaatccagatagcttaatatttatttttgtttaacttttatttgaactttggtgggggggtacgtgtgcaggtttgttatataggtaaacttgtgtcatgggggtttgtgtaatattgcccagccatgcgtcaattgcagacagaaaattattataaactaggccgcgagggcccactagggggcagtctctgccttcaaagccattcctcctcggaggctctctcaggagatgccccaatttgtgaaaccacagtactgtcattgctcataatggaaggtgcagcagagaccagctacgctcactgaggtccagagaaaggttacttcttcaggtcacacacagatagggcccagttctggtagatctcccttcccttttacattattggtttgtaattttttcccaagtctttattttgaactaagttgaaagaattttacagcaaacactcatttatccaccacctatattctgtcgttaacgtttccacacttgcttaatcacatttccaactatctcgctctccatccatcaatctgtcttatttttgacacatttcaaagtaaactgcagacaccaattcgatttcccccaaacacttcagcatgcccaacatcaatagaattcaaaatttacttgtagggtttcttttttttttttaacttttgaggtgaaatgtacatacaatgatacatacaaaattttttttttttttgagacagtctcactttgtcacccaagctggagtgtagtggcgtaatcacggcttactgcagcctcgacctcccaggctcaattgattctcccacctcagcctacaaagtagctgggactacaggcatgagccaccacactcagctaatttttgtagttttgtagagatggggttttgccatgttgcctaggctggtcttgaactccatggttcaagcaatcctcccactttggcctcccaaagcgctgggattatagatgtgagccactgtgcccggtgatgtcttaagtgtacaatggctgagttttgacaaatgcatatgactgtcattctaacccttatcaaattaattctcttttttgatgtcacagctgctgttgaggatccaagggaaggtatgaaccagagaaatgcctttatgtccccacacactgcactcatactcatgagctctggctattgggatgtctattatacctaaaatcccttagatgacatgaaacttaatagttgttcaattttttttgtttgttttttgaggagttataatgcagtaaagtagaaactttgaaaattggaaattcttgtttacaattttttgttatgtattcattgaagagcaaaatgcctttaaaaactcaatacacctgctttattttgctttttttttagtattgttgtaatgaagaagttcagttaaatcatatctgtctatggaacatctatcatctttctcagtgtattactgatagttgtctgcacaccccatgaggccaggggaagggtctcttgcccatccttccttcaaagcctatcagcttgttaggttgaggtgagtgtctcaggcactgaagttttgggatactggacctaaggagatgtagggaagctgacgtcttgctattcagtgttccttctcttcttccctggtcatttaagtctcatgagaattatcaaggccaggccagcgtctgaggccttcaggatgtgctgggcgcggtcattgctcccaaatgtctagggaattgcattgaagtgggcactgctgggacctgcagggctgtgacttgtgactgcctttggggacagtggtccagcaatgtctattaaaatatgtatacatatgaacattttgactctcacgttttcctttagggaatctattctcttaaaatgaaacaccagcgtgcaaagaaataaaatctagaacaagcatgtttattgatgttttctttgagatgcaaagaaaacatcagcctaatgaaggggtacccattttatgtgatactaggtagttgttgaaagcattgaattaggccaggcgcggtggctcacacctgtaatcccagcactttgggaggctgaggagggtggatcacttgaggccaggagttccaaaccagtctggccaacatggtgaaaccccgtctctactaaaaaaaatccaaaaaattagctgggtatggtggtgcatgcctgtaatcccacctgctctggagggtgagacacgagaatcacttgaaccctgcaggtggagtttgcagtgaacagagatcaggtcattcatgcactacagcctgggtgatagagtaagactctgtctcaaaaaaaagaaaagaaaagactgaattaaaatgagaaaatgagtataatttttgacatgggaactggttacacaggtgaatttcctttgtgagaattcaagctgtaagattatgatttatacacttttctataggtatattatacttcctatacttttattatttaaaagtttgtgataaaaattctaaataactaaaaacaaaacaccaatgggttagagctacagatattggtgtaaagcagaggttgccaaactggcctgctgcctgtttttataaataaagttttattggaacacagccacatccattcatttatatattatctatggctgctcttgtgatacaatggcagagttcactgcgtagttgtgacaaagcttgtacaatctgcaaaatgtaaaatatttgttctctggcctttactgaaaacatttggcagtccttgaactagaggaacatctatggttaagtgaaagggttaggttgcgtaaaaatatatttagtatgatctcattttgaagaaataagcaacagcaacagacacctcctatgtgtgaagttttgtctgtatattttataacctgtgtgtgaagaaaggtgtggaaggataccaaccaggttgtaaacactgggatcgcagcaggattgggagtgaagaggctgtggcggtgagggggattgtgttgtgtctctgtagttttcattacgtttcacaggttgattgcaatacatatcatttccgcaatttttgaaaaataaaaacagaaaaatctccaaataggaaaaatgaacagaaataaattgtctcaacaacaatagcagaaaaaaaaaatgaatggataatgccccaaatgatggggtgttggttgcttgaggagggttgttgggtggttctcagcttgagcagagctgggcccaggccctgtctgggtatttttgagtttttattgtcactagcttccatcttgtgtagcatctgccttgtgagctgggcctgttctccgagtttcatggtgtttgatgttttttgccttctttcagcaaggtcgctggcatcatccttgctgagtcgcatatgttctgggaaccacctcctcttctctgtgcctctcgcctggcaggtctacgctaaactgccccctgccctcccaggcccaccccacctccaagtctgagttctttgacttaaacttcaatcctgtttcccatgggctgtggcttcccaaccctcagtttcagttgaagctaatttttttttccagaaatcactgtgggccctggctgctctgggtgtggtctggggaccagctgcatcccatcggcattacctgggagctcgttagcaattcgggatctcagcttcccctccaggcctgctgaatcagaatctgcaatttaacaacatcccctggggatgcactgtaacattcgagcagccctgctgcagaggatcgcagtgagacgggaagaatgtgtcttttccactagatggcaggccttacctgcgcttggctcctgcgcagaccaccacaggtggatgtgccaggggtgatgtgaacctccagccccgcgttggccatggcatcttaccagtcatgaagctcgggtgtcagtcccgccagggctggaatcctctttcattggtgacctgcacctacctgcatgtcctggcctggtgcagcatgagcttctggcttgagccatttgtgtaaagtgacccagagcctttctttcttccctgctttgcctttgtcctctaccacctggaaggtgaaggcatgtctctggggagcttcctagtcattagcctctgtgttgcttttctggatggcttgctgcacgtctctgctaattttaggccaatgtggtctatgattacaaaggttttgcatgggctttggagtcaggcctgggtttgaatcctgcctttcccactcctccaacaagtatttgttgggggcctcccatgtgctgggcactgcttacaggcaaggcccctgtgctcatggcctctgccttctttctaatgatgggagatgaagaggaagcaaacaaaacactttgagaaaacaaggaacactatcaaggaaataaaataaagcggcatgatgtgatagagggtggccagtgggctgagtgtgattagcagggataatggcatttagttgagacctcagggaccagcaggagggagccagcttgctgaaaattccagggaagagtataccaggcagagggagcggcagaggcagaggccagagggaagagtgaagcagcaggcttgtgagtgacaggaactgacagccagtgggtgtgactggagcctcgggatggggaggggtgggtgacgctggaggaaaggcagggacagccagttaggctttgtgagccccatggtgggcttggtttctttctaagtgcatggaaatttagatcccaggagtatctgaaggacatcatgcaaggtcagtgtgtttaggccccaaaaccacccagtgggggcagtcattttgtttttctcattttacaaaggagaaaacagagccttgaaaaatctgagcctggtgtggtagcatgtggctatggtcccagttactcaggaggctgaagcaggatcatcagttgaggccacaagtttgagaccagcctcagcaacacagtgagaaaaaaagtcttaaaaattagctgggtaggcagggtgcggtggctcatgcctgtaatcccagcacttggggagtctgaggtgggtggatcacaaggtcaggcgttcgagaccagcctggtcaacatagtgaaacctcatctctactaaaaatacaaaaaaaaaattagctgggcgtggtggtgcgtgtctgcagtcccaactgctcaggaggctgaggcaggagaatcgcttgaacccgggaggcagaagttgcagtgagctgagattgtgccaccgcactccagcctgggtgacagagtgagactccatctcaaaaaataaataaataaaataaaataaaataaaatacaaattagctggacatggaggcatgcacctgtagtcccagctacttgggaggctgaggcgggaagatgacttgagcccaggagttggtggctgcggtgagctatgatctcgctactgcactctaggctgggcgacagagcgagaccctgtctctccttctaaaaaaaaaaaaaagaatttgagcacccgcctctagtccctaaggcagtgcatggaggaggctggatttgtaccctgggtccatctgtctggcaggttctaacacattaagtcagatgttggaaagatacagtttaagactatgagacattggaacataagaaacacccaccataccagtggggagaggaaggagatgcttcagcactggtagttctcatagtcttatctttcagtggctttagggcacaggttgggactagtttagccttaaggtcttggagaagacctgcttttcatttgcctgttgccccagcactgtggggtcagaatctttcttgtgatcagagtttagagaagggagggagcagtgggctggaggcattccaggtagccctggagaaggcaggagaggcataagttagaagggtgagggaagggaggagggccagtggctgacgcttactgagcccttgctgtgaacccagcacagtgctagccatcgtggggcacaaaagcctgtgcaagatgcagtcgcagctcctgagcagcctcgctgtctggttgggttccatctgctttaccactaccaacaaaaccaagggacggacacctcttactgatagtaaccaccaggcactgggcgaagcacgttgctcagccatgtcgtataatcctatcaacaacctgtagtcccagctacttgggtgggagagagttactgagggcatctccattttacagatggggaaactgagacacagagaaagaggttaaataacttgcccaagccacacaactaggaagatgtggagctgggacttgaatctaactatgccattccagataattaggctcttggacaccgtcttatcctggcactaagtacatcagtggagtgatgatgatacatgatattagtagcagccacttttacttctttcttttcttttctttcttttttttttttttataacagagtctcactctgtcgccaggctggagtgcagtggcacaatctcagctcactgcaacctccgcctccctggttccagcgattctcctgcctcagccttccaagtagctgggactacaggcatgcgccaccatgcccagctaatttttttgtatttttagtagagacagggtttcaccatgttggtcaggctgcctgacctcaaatgatctgcccacctcggccccccaaagtgctgggattacaggtgtgagtcaccgtgcccagccacagccaccttttctaaaacccttccaaatgcctggcttttgctaggaactctacaagcgttccttcaggtaatcctcctaacaacttttgctattacccgtagtccttctctccattatatggtgaggaaactgagactttgcttcatatgactccattttccccaacacttcctgctagcctgttttgctcctttgggagtatgagagtcagtgtttgctggactgtgaggctgaagatgataacatttcttcaaattggcctgttttttttttttttttttttttttttttttgcagaaagacagatttcactggccaagatctgcccaagaggctgaataaattcctaggttgtgagaagcaggtggatggagaagactttctctccaaacctccctgtgttaggaccagggaatgggttatgtgaatctggcaaccctgtcccaccctggacctgcaccctttaccactaccctggcacatccgggacctgcaccctttaccactaccctggcacatccgggacctgcacccttaaccactaccctggcacatccgggacctgcaccttaaccactaccctggcacacccgggacctgcacccttaaccactaccctggcacatccaggacctgcaaccttaaccactaacctggcacatccaggacctgcaccgttaaccactaacctggcacaaccaggacatgtgcccttaactattaccctggcacaaccgggacatgcacccttaaccactaccctggcacatctgggacatgcacgcttaaccactactctagcatcatccgggacctgcacccttaactactaccctggtctgcctccttgagtggcccagggaacatctagaagctgagagaaagagagggataaaaccaagttcacagcagtatcctaagaaagtgttctcacttaaaaatgcaaagatgctcacagagtgttcaggttacactggaaaactccagaaacaaagtggtttgtgtacatgggaggaagcagaatcaacttcccaccttagcattgtgggtgcttagcccacgcctgtgtatcgctcagggaatcagagtcactataagcatcatggaataagggatttactgtacacgttagaccttatacaagcttggagatgctggagacgggaagatctggaggggtgaattgagaatcagaggaagagcagtggtgcaggtggacaagtaggagttggtaggggatccaagaagccaagcacgttgagctgctgacatagatattgatgaatttcatgaagcttttacaggcactggtttcacccttgggtaactcagtacaggtatgttgacagccttccactaattcaaagatggttcataggtgtcccagaatcttttaattcccaagtgaggcagccccaactccttcagccatttactttctaatccttaatccacagcccacaacctcaaacacatgatagggccgagtatgccatcattgatgtcaacccggaactcttcctagacaacactccagttggagtagcttccttataaagcagggtgcccagagtgaaagagaatccacctgtgttgccgaggagcgaaggattgtcactttccttattctagatcagctgttttcaaacctttcggcttccagcccatctaggttttatgtaacacacacacacacacacacacacactgcacaaacaagcacaaactcacaaacacacacacattgcacaaacaagcacacactcacaaccaaaaccaaactgccattaatgcttacctctacttatgctcaccacacactctgatacattctcctctcttttgtggccctcttttctgttcatttccattctatttcctttaagaaaccctttaaggaaaatgctcttactctgcaaattgatttcactaacaattggcaaatgtgtcatgacccgccgcttgaaaaacactgtcctagacaacaaaattctctttctgcatcctgagatgatactactcttttggggggtctgggggtaccaccagccacattgcactgttgacttatcttgggtttatgatcagttaaagctctcttgtctatcacatcgggtgctgctagcctgcaggccccacatccttgtgcaagattttttttttttttgagactccaggatgaaacctgatgcatttcatcttgtagggtttggccttttgctccacggccaggctgagagcttttgggtcttcctgttcttgtgccgagtgtcttccggacatcaccttcctcacaccattctctgtgctacttgttctgccctccttacttttgaaaagatagtttattactcatagatgaggagcaggcgtgccactccatgaaaggccacacagggaagcagcagggtctgccaggaggcagaggaagcggaaagaaaacgtggcaggagcatttgctgctgtttctgtgagaaggagcaggtagggcgggaaaccagccttagggctggctggtttgaatgatctcagcagactctgggtgtagaggctgtctctctagttgcctggtacctgatacctggtgcttttacctggggtaattagcacaggctggcccagagtgtaagagccccatgaaggagttggttggaggtttgggctttggattggttggtttgcatatgaaaggtgcgcttgcaggtgagttctttactgtctctaggaatgggctagccctgggacagacagtttctccagggtcagcaaggctccgagacaccaaagcatcagaaatacagaaaatagagccaggtgcagtggctcatgcctgtaatcccagagactcaggaggctgaggtgaagaatcacttgaggcaaggagtttgagaccagtctgggcaacatagtgagacccctgtccctaaaaaaaattaaaaataaaattacccaggcatggtagtgcagcatgcctgtaatctcagctactcaggagactgaggaaggaggatcactgaatccaggagttcaaggaaagaggccgggcacagtggctcacgcctgtaatcccagcactttgggaggctgaggcaggtggcgagtgaatcaccaggtcaggaaagggagaccatcctggccaacatggtgaaaccctgtctctactaaaaatacaaaaattagctgggcatggtggcgggcacctgtaatcccagctactcaggaggctgaggcaggagaatcgcttgaacctgggaggtggaggttgcagtgagcaagcgagactccgtctcaaaaaaaaaaaaaaagacataaaattaatagaccttagactattttatttaattattttatcaaaataggataggcatagttaaaaatgccaatgtgcattggagagctgaggatgaaaagcaatgtcctgtacttgagcttgcatcagaatcatctagagagtgccccaccctcagagtttctgattcagtagacattgaagaatgagaatttgaatttctaacaggtccccagagaatgctggtgtgttcacactccggttaccagaaagggatcccgatccagaacccaagagaggttcttaggtcttttgcaagaaagaattcgaggcaaatccataaagtcaaagcaagcttactaagaaagtaaaggaataaagcatggctactccacaggcagagcagccctaaagctgctggctagccacttttgaggtcatttcctgattatatgctaaaaaaggggtggatttttcatgagttttctgggaaaggggtggcagattcccagaactgaggattcctcctctttttagaccatgtagggtaacttcctgacgttgccatgacgattgtaaactgtcatggcgctgctgggagtgtctcttagcatgctaatgcattacaattactgtataatgagcagcaaagacgaccagacgtcacttttgttgccatcttggttttggaggattttgacctacttctttaacacaacctgttttatcagcaaggtctttgtgacctgtaccttgtgctgacgtcctgtctcattcagtgacttagaatcccttaacctcctgagaatgcagcccagtaggtctcagccttattttacccagcccctattcaagatggagtcactctggttcaaacatctctgacactctgagaaccactgcattggaagacactattttcaactctttaaactctttcttccagcacttgagctctaaattttaatcatgtgctctgtctctctgtcatttcactatttcatggctctgacttcctgagaaggttttaattctctgatgtgatccctctagttctcttcccctcacatccagcacggggttactgccatttgtagttcactcactcaaaaaaaagtgattattaagcatcttctgcatgtcaggcattgacttagtcactggagatttgtcagagaacaagccaaagtcctgccctcatggagcttatattttagtgcagggcttgacaaactttttctgtgaagggccagatgggctttggagctatctggtcactgtcacaactacttaactctgccattgtaacacggaagtggccacagtgtgccaatgaatgggcacgggtgtgtgccaataaaactttatttacaaaaacaggcaggaggctggatttggcccttgggctgtagtttgtagacctctgttgtagtgtgggagaagacaaagtaggtaaataagtaaaatacgaacagtaagctaaggggaaaaagaaaaaacggaaaaagaggatgggaaggaggcaggaggggactggacctgcacatttagatatggtggcaagcaggcagtcactgagatggggacattgagtaaagactttcaaaggagatgaaggagggagccatgcatctccctggcagaagagcattccaggcacagtaacagctggtgcaaaggccctgtggcatgagcatgttcggtgtgcttgaagaaacagcaaggaggctcgtgtgtctaagtggggcaagtcaagggaagggagcaggagaggaaagcggaggaaacagagaggcagctgctgagggctatgtgattcttgggagggaatttgtcttttctcttagtccaatgggaatccattattgtgactctagtagttgtaatagttcctttaagttttatttatttattttagatacaggttctcactgtatcactcaggctggagtacagaggcacaatcactgctcactgcagcctcaaactcctggcctcaagcaatcctcctgcctcagcctcctgagtagctgggactgcaggcacacaccaccatgcccagccaaatttttaaaaattttataatagagatgggatctggctatgttgcccaggctagtttcaaactcctggcctcaagtgaccctcttgcctcagcctcccaaagtgctgggattacaggtgtgagccactgaacctggctatttaagttatgtatttgcaactccatttcttgctttcccaatggtaggcaatatctcttaactttgtcttttgtagagcatttttatatgcatgatatcatttactccctatgagatgtgactattgtccctattctgtagaggaggcaactgaagctcggaaaggttaaatgacttggccagattcatatagctgataagtgctggtgctggaatttaaacccaggtttgtcttaatatggagatcttagcacctattttatatgaagagacaatcctttagggatactggggaaacctgtggcttttggacaataaattaaaaaccctttcccaagaaggggagctgtgtgtgtatcaatcaaacaaaatgagaactattctgagagggaggaaaaggttcttttctgtgggaacgctgaccaagccgttgacagctcatttatgtgatgctggtgcagtttgacattcatagtacaagacttgcatgcaattagcacgaatcgttctaacagtctcttgaaaacatttggaattttccctctgtctggccttgtgcatgatgtaaacatggctttatttagttggtcatccatcccagaatagtgtggtctgcatctgtctgcatcactgtggtctgattgaggtcttgttttcctggagggcagagactgttgtgtaggcttgctttgtggatcctcctcccccaggatcattcgccacaaacccgatggcagcctctctctttagctcatgacaatttctccaagtgtaagctgggggtcccgttcagtatgcaatgcaaatgagatgcaaatgaggggccctcttgggcacaggccaggaggccagagctctggggacttctgtacccctcctctgagttgcctaatgaagctgaccgttcctttcacaatcatcttctccacccaccaaaggcctcttaatgagggcagaagctgactgctctgaaaccccttcagacacctggtgattggaagctggagagacagtgagctttagatgggctgtcagccgctgctgagtcctcatcagctgcctgctgggttctgagaagcactagggaaggaagggagatggccctggaactgactgctattgtctgttcctcctcccctgacgagctgcatgcggcagccacggatggctgggtttgggctttcacgtcggcttctctggcccttgctggatgcctgcttcagctcagagaatgtggcttcacagggacttggaataagagctgagagcctgttccccccatcgaggatcaatgctcctttgatttcatttcttctttccagacgaatccactgtcttagcccgttgttggagaaatcccgacctaagcaggctttcaaattggggaaagaaaagtgaaccaatctgaaatcatggaatggttggtggagaaggacaagtaggcatatccataaagagccagcagtcccaaaggatgttccagtgcatctttctgcttatttcttctagttttgtaggggtgtgtggtgtgcaatgctgtttgcttgacagaatcctttcagtctctctctctctcgaaatataaatttcctgcactacaacagcctactaagtgccagacacagtgctgggctctttacctgcatcaacccattttgtctccattgacaaaaggggaaactgaggctcagagaggttaattgacttgctcaaggtcaactgggcttctgtgtggcagaactggagtttggtcccaggtctgtttgcatctaacacccagccccttaaccactttgccgaattgagaatttggaaattaaaatggtgatttcaactcagggatgggtgtgctttctttcagccttgcagtaagtgcacatcttctttctcttttcctctttgaagctgccagcctctcccttggggttctccttggctctggccatgatttccccagcttcctcattcatacctcctggcatcagactgacctgggctaatcaccatctctgcctgtcactagttcaagaggcagcttatggggacttgtgggtcatacaggttcccctagaaagatgatgggcagactgacattgggattgaaatgtcttgtctccagcgttcttgaataggggcaacaatgcccactgggtctccaggcatggggtctaaaagtgaatgcaaaatacctgtgatacagtgtggatgttttatccccaccaagtctcatgttgaaatgtgatcctcggtgttggaggtgaggcctcgtgggaggtgcttgggccatttttgggtcatggggcagacacctcatgcctggcttggtgcactccatgtcacctaaacgagttctcgctccatgttcactagagatctggttgtttaaaagagtctggcacctcccctctctcattcttgttcccgctcctaccatgtgatacacgggctcccctttctccttgtaccatgattggaagcttcctgagtccctcaccagaagtggatgccagcaccatgcttcctggacagcctacagaaccatgaacaaaaataaacctcttttctttataaagtacccagcctcaggtattccttgagagcaacgcaaacggatgaacacagcctatttccatagccttgctattggtgagtcttgggcccgtggtgcatgcacaggggccagatccagcccttaccccaagagcagattcaaacgtgtctttccctgattatttatggccactaaaatggaaggtgatggttgtggtgggtgtctatgatcagggctcaataaatatttgttgaaaacaaaaatgtaaacaagaaaaagacaggaccttgtcaacaagtgttatatagttgcagatctttatcttggattgttcagactctgcccttctctggcaggcacacttttgggaatgggaagggccaacagtgcttctttggtcccattagatccccatgtcagccctatgaaataatactatcccatacttactactatttcagctttacagaagggaaaaatgcagctcagagaggtgaattcacttgcccaaagtcccatcgctagggagcgatgggatttgaattaaaaatgcagatgtgattgattctaaacgcaggctgttaatgcatagctttcctggggaacaaaaagagctttcctttcatacctcattcattcattcattcacttattctttaatctcttctgtatgggaggtcatttgctagatactggatggctgtaggaatgaatatgattctttacacgctgagtatttcatagccctactaagagagaagaagagagagctcactataaaaggggggattggtgaagagataatggagtaggaagcacatgctgtgggaggtgccaggggatgagaggttaattccaacccatggggttgtgataggcttcacagaggcaaaggcagtggacttagttctggatggggcagagatctaacgcttattgatggcttgccccttgctaggactcagctcggtgggcgctttgtctattttctactttgaaagatgaatagaaactttgacggtcttttgccctctgaaatccactcttcacacccagccacaggaatctttctaaaatgtaaatcaggccatgtcacccccctgcttaaatgattccaagccttctcagagcttccaactgaaacctaaactcctcactcctgctctaagagcctgcagattctgcttccttcagcctctttccaaccttgtttgttcttttcccatgatagccacatctctgagccaacaaatatttttccttccttcttgcacttgctcttccctcagcttgggttgcttttccttgggctctatgtgttgccaactttccagtagccttcagtcatcactaaatgtcaccttctcagaaagcccgcctctgagtcttatctgaagaaacccctcccagtcactccctatcccattactctgtttgcatttgtttatttatttgcttcttgcctgtttctctccactggatggagagcaagaaccttccttattttttatgccactttgtgctagtgcagtgcacaattgacatgtacagatgcacaattagagtttgctgagtaaatggctaaataggttaaaaaaaaaaaccaaaaacggtgggctgctaggcagaagtgtaaccacacaagtgaaccttgaaagttaccatgaaacgtaaccttcatgccctgtgaaggtgccttaggtttctggtgtgtttggaccatagattgtagctatgaagtctgattaatgcctgaatcagacattgaatgacctgaataaatagttaaaaagttggacttctaggctgaagtgtaaccacatgagagaagcatgaatgttaccatgaaggtgcctagggtttctggtgtgttcagaccatagattgtagctatgaagtctgattaatgccagctcacagaagagcttgctcaagcatgctagggatttggtgagccattgtaggtggtaatgacctgatctagttaccatgggtgacaattaaaaagaaggattaaagatgtaagggactagagctgtagagacccatccaggagctattgatccctgtaggatggaggagatgaaacatacatgaattaaggaagtggaaggataagaataaattgatgtagaggatcagggagaggatggaggagtcaggactaacagagatttctgactcaggaagacatgtggatagtgagcgtgatagccaattagggttagaagtcacagaagcttaccagaagggaaaggtaatcatcttgctttagtatatgttgagatgtttttgggttgcatgggtgactgtgtccagtaggcagatgaatctgtatatccagagatccgattggaaaaacagagccaacagtatggatgcaggggtcaccggccctaacagtggaagctgaattctttgagtgggtcaggaattagtgcagcactgtaagagcaggaaggttcaggctctgggaaatggagccacttcagtcatcagtggagcaagaggagccagtgaaggagaatttaaaaataatgcttttaagtccaggtgcagtggctcatgtctgtaatcccagcactttgggagtctgaggcagaaggatcgcttgagcccaggagttcaagaccatcctggatgataaagggagactccatttctacaaaaaaaaattttttttttttaatgtagccagtgtggtggtgcatgcctgtggtccaagccactggggaggctaaggtggaaggagcccttgagcccagaagtttgaggctgcagtaagctatgatcacagcactgcactccagcctgagtgacagagtgacaccctatctcgaataataattattattagtagtaataattatagtgcttttagagaatgaaggggaaccagccgagtaaatggtcatagaagccaagggaagagagaattcaagaaagtggatatggccaacaccttagatgctgccaactggtaatgataaacacgaggctaagaattgaacagagtcactggatttggtcatttaacttagggacttgggaagtgctctttcagtggcatagtaggagttaagaggcaggatgccggaaagcctggatgctggatgttgaggagggaattgaaggaggggatgtggaaagaggagtgtagacaactcatgagaatttgggttgtggaagaaaggggccagggaaggcgtcttagaaggaagttatttctgagaggcatctgagcaggtttatagcatgaatggaagaaagcaaggtgcctgggaatagggataggaattaagcagaagcggtcctaggctttgtcttcaggaagataggtgttcaagtcccagctctgccacatgctggctgtgggactttgggcaagttaatgaagccccatgagtctcagtgtcctcatctggcgagcagagagagtagcctgtaccttgcagagtcatggcaaggatgaaacaagaatgtctctcagggccttcacagcgcttagtgcataatgaggggttagttagtgaactcctaccaagctcctttgtacagggcatttagcaaagacgtcagtgaccctgagaatccctagtctaaggtaggtaccccttccctaagcgctgaacttcctcccttatgcatgtatcacatctacaatgtttccttgtgtagtggatactgtggtgtgccaccaggatccctctctcagcacagaggcactcctgccccaagccacgcagagtattggctctgaccactcacggcttcagtatttccgtaggatttgccctgagggagctgcagtgcccaaggttatgccctcttccaggggcagctcacagtctatgattggttgctggtggggaatgggcttataaatgctcttccccagcctcagtagggaacaagtctaaggggccatcccagctacagagctccctcatggatcaggtgacacctctgttgcagctacattgcagttcagtttctcgatttcatcctgcttcccccattccttgcaggagttcctcccaaggttattccctgagaagccgcctgcatacaatatccagatcagtcttttttcagggaacccgacttaagatgccttgtttaatgtttgtatcttttctctaaaatataagctttttgtagggactgactattctgtcttgttcattttgtgtcaccatgtctaggtacataataggtgcttgttaataatttttaatctttttttttttgagacagggtcttgctctgttgctcaggctggagtgcagtggcatgatcttggctcactgcaacctccgcctcccgaattcaagcaattcttatgcctcagcctcccaagtagctgggattacaggtgtgcatcaccacacccagctaatttttgtatttttagtagagacggggttttgccatgttggccaggctgatctcaaactcctgagctcaagtgatctgcccactttggccccgcaaagtgctgggattacaggcatgagccaccacatgcggccattaattgaataagtgaatgaacaggtttcctaaacacacacacaggagtgccctgatatatacagtttttcagagttgtgattagagaataggttatctggaagtgccttcctgtgggagtgtgagcttgcataggctcccccagcatggagccatcactagcaatggctgtgtcttccacgagctatttccagggttccatcagcaaacagtggtcacgatttataaaacgttcacacaagaacatttgggctgcattctacatcattttagtacagagaggttgttccttggggcctttaattttctagctttcattattgagagagtaaaatgtatcacttgcattccaaaattgatttttatttcccaaaagaagcccataaaaataaataacttcccgggagggaaaacagaaaagcactctatacactgggcaatttgttaaaaaagaaaagaaaaggaaaggaagcctggagcgacaaagcaatctaaacatttagattgtatctcttgtattcccccactccccctgcaccttaaataaataaaaaaaaaaaaaaaaaaaaaaacttgaggcctgctggactttgaaaatgcccatgttgttgagaaaactctgttgggcagcttcatgggacagcatcctttggagcactgcctcatggttcacacccctggtatcccaacccactgctatgttgttattagcaagatacgtttccagtatctcattactaattgtatcagtaagcatttgctgtgtaacaaattgctgcaagggtagtgggcttaaaacaacattctttctctcaattttgtgggtcttctgggaggttcttgtgatctgggccagcttgtctggggctggagggtctgtgaggccctcactctcacatctggtggttggctcagtgtcagctggagggacagggatgccttggccattgcctgccaccacccagcaggctagcctttgcctgctcactggcatctcaagagcagtaagtgagggcatttcaatccaagccccaattcccaagcacttttgaggattctgtttgcatcgcattggctaatgtcccagtcacatgaccaaacccagatgcagggaatggagaaacgaattgttgttctttccttgacattttactttctcaagtataaaggggggtttgtaggcaaggaagatgccaagtagtcccattttatagctaataaactgagaaccagagaggttgagcaactggtctgaagtcacgcagcaagcccagaacacactgggtaaccaatccactgggggtgagttcaccctgtgcagccacatttgatctccccttgcttcattccctccagcactctggcagccaggaggacagctccctgtggggactgtgacattactggcccctcactcagctcttcttgtgccaattagaatgcatacttatttttttttgcaggttgtcctttgcttgcatccctcacctcccccatccactctgtgatcttctctgtggctcaagagcctgactccttcagagtgcatgacatgggctcttttcctttttagtttctgattgagttcaagcagtaagaggcattgattggcaagagattgtaggatggtaggaatgagaagatgcggcatttctgtcccaattcctctgctcttggctgtgtgtccagcagtatcagaaggccccttctctgtgtctccagatttcactgggctctggtaacactacttccttctttggcctcttcaggcctaggggtagcaatgacatctcaatgctgctactctctggatgtctcaccatgcgttgttgatccctttaaccctgtcttcacatttgtgagtagtaccttaattaaaatctctagagccttctgaattggattctgttttctgcttgcgcctatcctgatacactttttttttttttttgagatggagtctcactctgttgcccaggctggagtgcagtggcatgatcttggctctctacaacctccgcctcctgagttcaagcgattctcctgcctcagcctctcaagtagctgggattacaggcgtgtgccaccatgtctgcctaatttttgtatttttaggagagacagagtttcatcatgttggccaggctggcctcgaactcctgacctcatgtgatccgcccgccttggcctctcagagtgctgggattacaggcgtgagtcaccatgcctggccactgatgtactttcactgggttccattttttttataaggggagaaagaatggagtttgcagcatgcgcttagggaacccagtatcatgatgatagaggagtgagtagcctgcatgaatgctgctgtggcaggaagaatgtttgagaacttgagcactagagtgtgagatttctggttgtcttggctccattcagggaattcttaggactctgggaaggacataccaggatatttatggcatcactgtttgtggtggcaaaaagctaatagcctcctgaatgcccgtttttgaaggctgaacatgttgtagtctgtccatgctgtggtataacttgcagttgaaaaagaatgagtttcaaactgactgacatattgttgggtgggaaaagcattttgcagagcagcgtgtatagtgtgattccgtttttgtacagtaaccctcccagtccatttgtttctaggtgattgtctcagccaggagaaaggtaggaaagagtaaacaccaggttgccgtccttcttacctggcagttggggaggaggagaaagatagaatgggaaagcaagtaggtaaagggagcttgaaaaaaaaatcatagcaaatgggaacatacacatagatttaatttggtgtcccttttctaactttttgagatagatatagcattgatttttcagcctatcttctttcctaatatgtacattaaggctacacattttcctttaagcacagctttagttgactctcacaagttttgaatatttttgaattttcatgatgatttttcctatgatttattcaaaagtgtatgtttaattttcaagcatttgtaaatattctagttatctttttgttattgatagtttgtttccaccacagtctgaaaacatacataatttcattcatttgacatttgggtaaatattccatgtgcacttacaaagaatatgtatcctgtgtttgttggatgccatattgtgtgtgtgtaaattagtttcgttagttgtgttgttcatattttctatatcttgtttgatttttattttgcttgcttgttctgttactgaaagaattggatttaagtctcctattatgattctgggtttttttcctttcagttttatcaatttttggtttgtatattttgaagcaatgttattattataaaatataattgatatctcctcggtgaattgatccttttatcattctgaaaggtatctgtttatctcaaataatgcttcttgccttaaagcctactttgcctcttgtaaatataccagttttcttttggttgatgttttatgatgtgtgtgtttatatgtatatacatatatacatatatatagaccgaatatatgtattatatatgttttatataatgttttatggtgtgtgtgtatatatatatataaaaagactgaaagggaaaagggggaaatatatctatatataaaataatataaatatatatatatttttcccccttttccctttcagtctttctgtagccttacatttagagtgtgtcttttataagcacaatttttaatacagtctgacaatagttgattttaattggagcatttagaccatttacattttatataattgctgatatatttgagtctatatctaccacttcctatgatttttcgtttgtcccatgtgttttacattcctttttctctttattattgccttttggggatcacttaagtatattttattatttcatattcctttctattaactaattagtcatgtattgtttttattatttttatattgattctagagattgcaatatgcatctttggattttagaatttaatatattagtacttttattacgttccaaatgatcctaggttctttaacattttagtcctgtttaccccatcctaccatacacattgtaattttacatgtgatttaaactacattatgataatgcttcatataatcagcatttacttggatttaataatatatttaccctttctgttagttttcattctttcttacattttcacatttccatctgggatcattttctttctctctaaagaacgtcttttattatttagtttaggcctgctgcaaatacatcttaagatacttgtatttcaagctgggcacagtggcacatgcctgtagtcccagctattcaggagtctgagacaggaggattgcttgagctcaagacttcaagtccagtctgggcaacatcgtgagatcccatctctggggaaaaaaaatctttatttcacattcacccttggatagaatttgaaactggctgttattttctttcggcactttaaatataccatcccgttgttcttcttccatcatttttgttgattttgtcagtcttattgtggctcttttgaagtcctattgttgcctttatgcaatctgtatgattttagattttctctctctctttgattttcagcaatgtgactgtgatgttcctgtgtgtgtgtgtgtgtgtgtgtgtgtgtgtgtgtgtttgtatgtgtttatcttggttggtgtttctttacttcttgcctctttaacttgatgtttttcattagtattttcttgtccattgtctgccctatccttttctctccttttcatgcttgactttgattatatgtatgttagaccttggtactgtgtcctctgtctctgacactctcttctgtactctctgtctcttttaatctttatgccatagtctgatttttcttaataatctgtttttcagctcactgatttgccttctaactgcttccaatctgctgctaagccatgcattgagttattaattttaagtattgcattttaaataaactttttattttagaatagttttagatgtacagaaaagttgcagaggatagacttcccgtatacctttcactcagttttccattattaacacgttacatgaccatgacacatccgtcaaaatgaagatgttaacactaattagtactgtattgttaactaaactccaaactttatttggattttccttttttttttcacgatattcttagtgtattccaggatctcatgtaggataccaaattacattaagttgtcatgtttcctaagtgtcctctggtttatgacaatttctcaatcgtttcttatttttcatgaccttgacagttttgagaagtactggtcaagtatctggtagaatgtccatccacttgggaattattgtatgtttaattctaaagctttcatttgctttatttagttattttgagacaagggtcttgctctgtcacccaagctggagtgcagtggcacaatcatcactcattgcagccttgaactcctggcctcaagcaatcttcccacctcagcctcctgagaagctgggaccacaggtgcatgccactgagcttggctaatttttaaaaatttttgtagagatgaggtctcgctgtgttgccccaggctggtcttgaactcctggcctcaagtgatcacccctcctcagcctcctaaagtgttgggattacaggtgtgagccactgtacccagtcagtttcttttttgtaaccaatagttctctggtgaaactttccacattgtcatcctttctcccttcttttaaacatcttaataagttattttaaagttcatgtttgataattccagtgtctgaatcacccatggatctgccctcttgtctgtttttttaaaattttttagacgggatcttattctgtcacctaggctggagtgcagtggtgcaatcatagctcgctgcagcctctacctcctgggctcaagcaatcctcccacctcagactcctgagtagctgggactatagatgtgtatcaccacaccccactaatgtttgtatttttgtagagatggggttttactatgttgtccaggctggtcttgaattcctgagctcaagccgtctgcccatgtttgcctgtcaaagtgctgagattacaggcatgcatcaccacgcctaggtgttttttgcttctggtcctatttcttggcatgtttggaagttttgtttgaatttcagatgattccttgctaaattagaaagctgttggacaggtgtggtggctcatgcctgtaatctcagcactttgggaggacaaggtgggtggatcatctgagatcaggagtttgagatcatcctggccaacatagtgaagccccatctctaccaaaaatacaaaaattagcctggcatggtggcacatgcctgtaatcccagctactggggaggctgaggcacgagaatcacttgaacctgggaggcggaggttacagtgagcctgggtgacagagcgagactccgtctcaaaaaaaaaaaaaaaaaagagagagagagagagctgaggaagaggttattttccatgcaggttggggtcacccttctggtggtgatcgagctcactgtgtgctggtttatagccttcgtaaggtttgttctatttctggttcatttccactcctatggtgtagaggtttccaactctgaggctgaagacttgccagggccctccttttaactgggtcctgaaccccaatttttgtttctctagcaccataagcctgacaaaacctctcagctgatttctgttttgtgtctcaacctctgcagtgtgattggtagagactcaagagaaaaatcaatgcctagcgttgagttcacttctctgctcttcccctcccactatgatttggcccctcaagtcctgccttccctggaagctttgattcctagccccaagaataagcttcaagctctggtggcctccctccttcttagcaggtgccctctgtctagcttcttagtcctttgccctgtgttgagaattgatttatggcccaaaggaaaaaaaaaaaaaaaccacacacagaatattggacttatcttaattctaattccttcaaaattccagtttcttgaaaaatattttttatctggcttttatagttgctctcagtgggagagctactttatcattgccccaagtggtatgatattaaataaaaatataaaatacaaaatagatttagagtggtataattatgtaaaaattgaatgttaacatggaaaaagaccagaaggtgaatatacaaatgaaagcatttatttaattttgggataagatctaaggtaatatttgtttggttcagaaaattatttttaaagaagggtgttgtgagcatcagtgatagagtgaggaatcctcatttctttcagatcctggtaggggaccctgagaactttggggagtgaagatagtgaagtaaaggttgctaagcattctgctagaacactatggagacagcgatataaaataagagccaataataacaaagtagcacatagtgaatgtttaccatatgccagacattctattaatttataatgattgtaacattcctatgagccaacatccttatcattagccccattttttaaacaaggagactgagttaccgagaagttaggtaactttcaggtcacaaagctgctctatggcagagctgatctgccaggatctctgggtttaagctcctcaccatcacacttgactaatttggtatagaaagtggctttagatcagataagggtacatgaaatgcaggaggtgccgtgttagaggacagtttggtccagtccccatgtcctggggcaaatgaagcagatggcctcagaacagcctgtttttaaatcatgtaagactgacttctttcagctgctggattcctgcctcccagagtgagacgttgaagtttggcccggaagaggctgagcactggggacgagcagtgctgtgctgtgtatagagtgcttaaaacagtgcctgggtctgagcgtggtggctcatgcctgtaatcccacctctttgggaggccatggtgggaagattgcttgagcccaggagtttgatttcagcctgcaacatagtgagaccccatttctacaaaaaattttaagaagtagtcaggcatggtcgtacacctgtagtcccagctacttgggaggctgaggtgggaggatcacttgaaccccaaaggttgaggctgcagtgagtcgtgattgcactactgtactccagcctgagtaacaaagcaagactttgtatcaaaacaaaacaaacaaaacaaaacagtgcctggcatatagtatgtgctcaataaaagttgtcattgttattgtcatgacatcatcagagcctagaacaaatcacaaaacctgtatattctctctgggctggaggtcttaagattcttctccattcccaacgggtactcccgagatgacgtgattcatggccattccttccttccttcagtgtgtggctcacactgtgctgggctatggcgtcaccactgtcaatacgacaaataaatggataattacagcaaagtgttaggactgctgtgccagacacgagtgcaaggtgtcctgggcaaccagggaagggacgttaacttacactgggattggggccctgtgatggtaagcttttcatcttgcaggaaaccaggggatttttttttttttttttttgagacaaggtcttgctctgtcgtccaggctggagtgcagtggcacgatcttggctcactgcaacctctgcctcctgggttcaagcgattcttgtgcctcagtctcccaagtagctgggattacaggcatgtgccatcactcttggctaatctttgtattttcagtagcgacggatttttgccatcttggccaggctggtctcaaactcctgacctcaagtgattcgcctgcctcagcctcccaaaatgctggaattacaggcatgagccgttgcgcccggccttgaaaccagggaatttaatgacatttaaaaatcatttattaagtatatatgaaatatatagaaaatagtatcccaggcacctaatagaacagaataataataatgactaggagttgttgagtgtaaaataggttgcagtcattacaacgcatataatagcatgaagtatatagctcctcagccctctcagccatcttatgagggaacactgttgctattctcatattacagatgaggaaactgaggctcagagaggttaagtaatcctccaagcctccgcagccaggaagtggtatcactttgaactcaaactcaggtctgtttgatcctgaggccaagcccttggccagaaaaattaggaagtcatagtcccttcccttaaggagctctatttaatatagcagaacaagtaaagcaagtacatatctctctaaagtatactgtgtcactgaagataagaaaggaagaaatcctgtgatgggtcagatgaagtcaggaaaggcttctgggaagaggtggccttatagatctaactagaaggatgaatgagctttgggccaaaggcaagggagggaaccatctggacaaagggtagttagtacacactgtgacctgaagagggagctcaaagcccccctccactccagggctgatgtgaggatgtgagttaaggacttggatgctgctcttggggctttcagagataggggaggagcttaatgacctcgtcttcatgatataccctaagcattctctcttggctttccatttgagacttactctgccttcagacctctcagaactctgcatatctggtatggtaagaggagcctgagctacctcttctctgcattgccttgaaaacaaaacatggccgggcacgatggctgacgtctgtaatcctagcactttgagaggccaaggcgggtggatcgcttgagctcaggagtttgagactagcctgggtaacatggtgagaccctgtctaaaaaaaaaaaaaaaaaaaaaaaaaagacaaacaggactggggaaaaggaataagaggagcccgtccaaccttccaatttccaccaattttaatgtggatccagaattgagaatgctagtctagctcaactcaacagggccagtggttctacttgtgattgggggtaaaggtcctagggtagtaaagagagtgagtacctgcctggcttgtccgctctgcacatgtctctgggcagtagctgtgggatgtggtcctggacactagatcccatctgtctcctcctatggaggcaggatcttacagggaacagccggcagccaaggctagctggagtctggcctacaccatataaggagatggtgcaggaaaggctgaaagttatggtgggggccgaagagggcgttgagttgcagtaaccatgcccaagcctttgtggagttaatgatcacagtggacacattctggaggggtcgtcggcatcactgggccctgctccaggatctcagcaaggatgttattattatcatgagggtgcccaattcagtttgctacttgtttatgggctgattgcaatttggatagagtttaacccccaccccacccccgccttttgtttttaaaaatttgctgaggtgaaattcacatgacttaaaatgatctgttttagagtgaacagttcagcggcatttagtacatgcacagtgttgtgcaaccaccactgctatttagttccaaaacatttccatcattccaaaataaagccccatactgattaagcagtgactacccatccctgccttctcccagcccctggcaaccatcaatctgcttttgtttttaatttttttgagacagggtgtttctctgtcacccaggctggagtgcagtggtacgatcatagctcactgcagcctggaactcctgagctcaagcaatcctcccacatcagcctcctaagtagctgggactgtaggcatgcaccaccatgctcagataattattatttttattttttataaagatgggggtctccaactcctggcctcaagtgatcctcccacctcagcttcccaaagagttgggattacaggtgtaagccaccacaaccagccaatctgctttctttaactctctctttctctctctctctcttttttttttgagatggagtttccctcttgtcacccaggctggagtgcaatggcatgatctctgctcactgcaacctctgcctcctgggttcaagcaattctcctgcctcagcctcccaagtagctgggattacaggcctgtgccaccagaccgagctaatttttgtatttttagtagagacggggtttcaccatgttggccaggctgatatcgacctcctgacctgaggtgatccacccgcctcagcctcccaaagcactgggattacatgtgtgcgccacgcacctggcctaactctctctctctttttaaggctgtttaaaaatgaaactattcagtagctcaagtataccttactgtaaagaggaagtatttatgcagtgctcagtcatcttgatcagagatgattatcaaaacatcaaaatatctctatgccagctggcaactaagaaataccaccagatgtcctctgcctctctggccttgttagtttcttctccaagagcccttggatgtgatctgataatgaaaaggtgaatgtctagttcagtgggagccttcacatctaccccagggctttggctgtctccaatctgatggataaaccgcttgctaaatattttgactatcagccctgtgattaaggtcaggattagaactgttgtatttgtaagaacctctcctaaagatggcctcccattgcccacctgtttgaatcctacctgccttaaacatttttgccatttttatttatttcttagaaacaggatcttgctctgtctcccaggctggagtacggtggtacaatgttggctcattgcagcctcagactcctgggctcaagtgatcctcccgcctcagccccttgagttactgggactacaggcgcatgccaccatgtctggctaatcgtgaaaattgtttttgtagagacaaagtcttgctatgttgcccaggctaatctcaaattcctggcctcaagtgatcctccctccttgacctctcaaattgctgggattacaggtgtgagccattgcgcctggccggttttttaaatgtctcagtctaaagttcaatattcatcccctagcccctaagccatgtttttaacacctcgataaacgatgtgctgactttacctaaaatgtgtccagtattccttctgagatggaaagatgctattttgggggtaaatatgttgatcttttccagaaggagtccaagacagctgatgatagcttttgcttgttctctatagaagagcaagtgatggccgggcgtggtggctcacgcctgtaatcccaacactttgggaggccgaggcaggcggatcacgaggtcaggagatcgagaccatcctggctaacatggtgaaaccccgatacaaaaatattagccgggcgtggttggtggcgggcgcctgtagtaccagctgctggggaggctgaggcaggagaatggcatgaactcaggaggtggagcttgcagtgagccgagatcatgccactgcacttcagtctgggtgacagagcaagactccatctcaaaaaaaaaaaaagaagagcaagtgatgtgtttaagacacacctcgaagctactgccatagaatgtgtgaccatggttatggatttcataaggggcaccctaagagggaaaaataatctgacccagatggatcttccgaggcactgtgatgtcgtgcctaagagtgcagccttgggaggaagacagagagggttcaaatcccgctctactgttatcagctctctgtataccttggacaagtcactcaaccccctcagctgtcaggttccacatcagtaaaatggggaaaacagtaacactcacatcataaggttcttgtaaggattcaatgagataattcatgtgcagtccttagaatagtgcttggctcatatagtaagagctcattcaccgtcaactattattatttaatctattttctatcatattttggaataaaacattttggcttactaaaaaagaacaaaaagaacatgtatttaaaatcagtaggcaacagtgagtcagtgaggatgttctgagagtaggaatgacatgataagatctgcgttctgggaagattaatttgtctgaagcttatagggtgacctgaaaggagacgaggaggggagggaaatctgtaaggaggctgatgcaacggtctaagctgctttgtgcaatatggcagccactagccacgtggggctgtttaaatttaaattaacgagcttggcctggtggctcacacctgtaatcccaaaactttgggaggccaaggtggaaggattgcttgaggccaggagtttgagaccaatctgagcaacatagcaaaaacttgcctctacaaaaaataaagttagccaaatgtggtgggatatgcctatagtcccagctactcgggaggctgaggcagaaggctcacatgagcccaagaggttgagactacagtgagtcatgattgcaccacgcactctagcctgggtgacagaacaagaccctatctcaaaaaaaaaaaaaaaaaatttaattaaagaaaattaaataaaatgcaaaactcaatttttccaacacaatagccacatttcaggtattcagtggcctcatgtggctagtggttactatactggacatcaaacacttccattattttagaaagttctattggacagtgtaactgtaataggttcactgcccaatgcatgcagcaagtcaatacactaagccactgagttgcagcagagaaacaggtttaattgtagggaagagacaggaggaaacctcaaatccatctcccagaggagtctggggctaggatttttaagggttttgcagtgggctgaagtgtggagattgttgattggtggaaaagagcaggatggagtcatgggacagggagataaagaagctgtgttctcttgctgattcagttcctctgtttggggtctttaaactggttggcatcagctattctgctggaattcaggatctgtttaagcaactcttaaacaaaagcctatgattctaatgtcagaaatcctatctgtaggaacaacgaggttgcaaatggtcagtatccagtgttacctgacttttagttgcaaggaagtgggtcaaagttagcctgattaatgctgaattgtaactatatttctgtccagaattcttcctaccctggtgaggctggcttcaacaacactggtcaaaagcagtggttttcatacatgagtgtcacatcagagtcatctggaaagtgtgttaaaatacaggttgctgggttccatcctcaattcagcaggtctgagcagggcctgagatcatgcatttctttttttttgtttgttattatactttaagttctagggtacgtgtgcacaatgtgcaggtttgttacctatgtatacatgtgccatgttggtgtgctgcacccactaactcgtcatttacattaggtgggaggaataacattaggagatcatgcatttctaatgagttcccaggtgatgctgacgctgctagtctgggccacaccctttgagaaccactctctgaaacaggacttctcagtcatggtgtgagggaaaggggagttgtttggagcatgtgaaaagccttatttatatgccccagttaagcccaattgggatttggactcagcctctttccaggattggcagttgttggcagatgtacaggagtgcttttggcttttctggttaaaagaggtgaaaggtggggctaattcagagtatggagatcagaggggtgaatcatggagcaaaaagggggccttatctgcttcttcatccattctctctgtcatcctggagctcagcttttggggcctgatagggagaaagacgagacagaagctttcagaactgagaagtcagaattcactggctttgttcctcactaataccttgacaactttctccctaaggcagtggatgactcacgtctagctgcatggtctggggggaggagcctcagggtacaagtgacagaattcaatgaagtgcaaagtgggagaaacaggcacttcaaacctcaacgtattaccttgctacaagtgtgcctttaactcactgtttgagtcacagaaggaaacagcatagggcttgctctcagggagccggagtatagcatctgctgatggccagggtcactggaatatttgcctctgtctgggcagagtttagaataacaggcagaggcatagggtgggggctgtgccggaactctgtctatctcatctgtgtacccttttatagatggtcatcggatttgtatttgcatctcagtgtagtcagacattcttccagaacactccagcagtgcttctgtgcctgctggaaaatagctgcagctctctcctgaggcagctcttcccacagtcccagctgctcccctgggatcctccttggacctccccatagcctggcaagtaaacttagcacctgggcatatcagggggcctctaggaccctgttccagtactgagcacagcatcagtactggttagcttgtgcttgggctgtgccatttggaagtattttgaagatgcacatgcacgtgtgtgtgtgtctgtgtgtctacggtggtgaagaatggagggatgtgggatggggcagattcagtagatgccttgagatatggatagtttggtaaaattatgataataagaaaatggaaaggatgccagtttccttccagctagttaagacccattactttactcattgacccacctaacccatccatccatccacccatgcattcatctctccatccatccatccatccatccatccatccatccaatccatacattcatccatctaatccatccatccatccacacatgcattcatctctccatccatccatccatccatccatccatccagttcatacattcatccatacattcattcatctgtctaacccatccatccatccactcagccaactcatccatccatgtaatcatatatccgtttaggataaatgtatccagcactctcttttagtgcttctgtgtgactgaggatgtttgacaatgaaaggaggaagcattcatctgctgggaccccttctaacagatgttttcttctcccttcatccctgaacaacagtaggagaaacaggaaacttgtcttcaaatggtagcccttttccctgactgtctgaggatcatggtctgagaatgtgcctctcagtttttaaaaatccttgaattccatgattcagtgatgtagttaatgtagacagggctcttctatcaaagcagggagcctattgaagatatgagaaaatatgcactgtttctctagagaagggaagtaaacccgccttcctcagagctgggaaggcttttgtcccaagcttctgaaaattaaacccatcacttaacgttctcactgagcagattgcggggcttctggccctatgctgcttgggttgtgcagagctgccgacagacagttttgattgaatgtccaaattaagctgccaagcagcgactctgcagctccagggactccatgttagtatttatgtcacatctttagaaataatcacattgcaaagcagcacccagagccatgtctgcagccgctgcagcgtgggagagggggctgttgagcacctcctgcctccatgcttcatgctgcatttactcagcacccaagcaagggtggggccccatggcacgccatcctggttcctgtcccgaggatatgagtgaggaattggtaaacctcgtctgtccttcttgttttcacttaacttgaggcaggaggtggtctccaaacaagaagtaaagctaacttattggatgcctgactcccaaaccatctgtcctaggcagacagaaagaccctcagggccaacctgaggggaacagatgtttatggggggcaggtttactcttgtttttccaagctgggctgaagagctcctcttccatctgcatcaagccctgaaaactctgccgtgcatgagtaaagtagcaagtgctgcatcccccagtgagatccagtggtgacattgtccacaccactggggaatgctagttattaagagactgggcttgtgagagctcaaaggtggactaacccagatcttccctgtcgagggaaatggtctctagacttgtggggttgtggttgtgtggagtcagagtaagtgtggagcaacgctgggaactgtaggaccctgaatgaccagggaaaccgctgtagaaaatagttgacactaaactgggtttagggggtcataaaacctccaagatttcaaagcttctgggtcccaggaggactcagttactgagcacaaaagttgcatggttttggtgtcaggcctctgagcccaagctaagccatcatatcccctgtgacctgcacgtatacatccagatggcctgaagcaacggaagatccacaaaagaagtgaaaatagccttaactaatgacgttccaccattgtgatttgttcctgccccaccctaactgatacgatatattctcccccgcccttaagaaggtactttgtacacctatcccaaacctataagaactaatgataatcccatcatcctttgctgactctcttttcggactcagcctgcctgcacccaggtgaaataaacagccttgctgctcccacaaagcctgtttggtggtctcttcacacggacacacgtgacatttggcagtgttgcaaaaccctcagaagtccgagtatcagctggactgaaccttggggcacccgcgttgtgtctagttccagtttgttaagaattaggtgcacaagaccagccccccttttacacaatgatttctttctctcagatttagagtaacatttttttttctaactaaaaatgtaattaatgctcaactgagaccatatattgaatgtctccttcttccaaattcccactgaagtgacaaagagattaaaaatggaaaaaaattgatcagggtgacaaaccagaaaaatggtatcaatcagatgccagaatctttggggaatttttctaagatacaattcagacaatccaagctgattttgtgttctcttttccaacatctaagcctcttatacaatacttttaaaaaatgtaattgcgttgattggtactttcagaacaatgttaaattatgatagtgatggtgggcattcttaatttgattgtggccttaatagatatgcctctagagttttacccgtaagcataatgaaggctgttggtatatttattacgtcaagaaaagcattcatttatttctatttttccaagtgttaaaaggacgaatggttattgaattttgtcagtcgcctttttcgtcattttttaagataattatatagtttttctcctttgacctagttttatagtgaatcatattattaatagattttctaaaattatgaaagatttttgtttgaagagtgtgcgatcggtttctagcttttgaaagatcactttggtgggggagtgaaggaagggctcaatagaagaccacaggcaggaaaccaatgaggaggatcttaatttcacccagagaggaaaagtgagtggccagggagcaatcatatgagcagctgctgtttatgaatcactcatcacctgcccagcacaataccaggattcaaatataacttaataatcacagtaattctatggcacacttattattgttcagatggcagtgatatgaatagtagggactcaggtacacaaaatgagaaagaggcagatcaaacagcacggggttgtagattgcaccaaagggaggagaccagaatgatttctagattcttactggggcagttgggtggatagttcaacactcactaagactggcattgaaagacagggaggagacatggtggtgtcgggggagcaggaggataatgagcgttgttggacatgttgagtttagcgtacatatgggacatccagtacaagataaccagtggacagttgtacatacagttgtaaaggtcagtaaagaggtgtgggtgggagttgtcagtatttaggtagaagtaaaatcataagagtagagcccctggaaaaatacggaaactaacaaacaaacttccgaataatccatggtttagttcaaagaagaagtctcaagggaaataagaaaatattttgaattgaaagaaaataaaagtataacacatgatactttgtggaatccagattaaaaagtgcttaaaaggaaatttatattggtaaattctaccaacacttaaagatgaaataatactgattctcctaaaaagtagatgagaagggaacatttttcaacctattttatgaggctagcattaccctcataccaaaaccagacaaaaatagtacaagaaaactacaagcaaatatctcaaatattttcttccagttcgtcatttgtgttttgcagaacaaatgtttttaaactttaataaagtacaatttatcatttttttcttttataggtcatgtttttagtgtcatgtgtaagaactctttgtaaacataaatataaaaatcttcatagaaatattagcaaattaaattcagcaatatataaatgaaaaatacactccgtccaaatgagttttatcctgagaatgcaagctggcttaataataaaaaaaaaaatcaaccaatgtaatttaccatattaataatctaaagaaagaaaaaaaattaacatatcaattgatgcagaaaaaattggacaaaactcaatattcatttatgatgaaagttctcagcacactagaaatagaagggaactttcttgatccaataagaagtatctaccaaaaacctgtaacatacttaatgatgaaaaactgcatgctttctcattaagctatgaaacaaaactaaaatgttcatcctccccagtcctattcaacatcatgtcataaccagcacagtaagataaaaaaaatttttaaaggcatgtggggctcggctcggtggctcatgcctgtaatcccagcactttgggagcctgaggtgggtggatcatctgaggtcaggagttcgagaccaacctggccaacatggtgaaacccccacatctactaaaaatacaaaaattagtcgggcgtggtggcagatgcctgtagtctcacctacttgggagtaggcaggagaattgcttgaacctgggaggcagaggttgcagtgagctgagattgcaccactgcactccagcctgggtgacagagcaagactctgtctcaaaaaagtaataataaaataaaaaataaaaaccatatggaatggaaaggaaaaaaagaaaaattgtttctatacacagaaaacagtattgtttatgtagaaaatccacaggaatctaccaagaaattactagaaataatgagtgagtttagctgggttgcagcatacaagtcaacacacaaaaatcaattgtatttctatatattaacaactagaaaccaaaaatttaaaaaatactacttacagcagctgcaaaacaaaggaaatatttaggtataaatctaacaacacatgtctagaatctatatgctaaaaattccaaaacactgaaagaaatcaaagaatacctaaataaatgaagagataacccatgttcatggattgaaagactcagcagagtgaagatagcaagtcttacgattgatttgtaggcttaatgaaattcaagtcaaaatcccagcaggattttttgtatgtttggacacagtgattctaaaacttgtatagaagggcagtgaatccagaatggccaaaacaattcttaagatgaagaataaagttggaagaattactgtacccaatcttaagacttactatataaagcttcagtaatcaaatgtgatattggtgacaggatagatacacaagccattggaacacagtagagaatccagaaatagacccacacaaatacggcctattgattttcaacaaaagtgcgaaaacaatgaaatggaaaaaggacggtctttcaacaaatgatgttggaatgattagacattcatatgaaaacaaaatgaaccttgacctccatctcacaccttttgcaagaattaactcaaaatgggtcatggagcaaaatataaaggtataaaatttcagaaaacacaggagaaaatctttatgacctgtagttatacaaagagttcttagacgtgacacttaaaaacgtgacccataaaagaaaaaaaaaaaagtggtaaattgtactttattaaagtttaaaaacttttattttgcaagaaacaaactataaactggaagaaaatatttgcaaatcacatatctgacaaaggacttgtatccaactcattgtatcagaactctcagactcatttgtatgaagccagccttacttaaaatgtaatctaaaaacctgaacaaacactttaccaaataatacaaggatggccaatacattcatggaaagatattcaatatcactagaaattacagaaatgcaaattaaaaccacaatgagataccattgcacacttactagaatggctaaaataatgatgataatgataataaatactgtcaatatggtgtgctaatgagtatgcagaacaagaggaactctcattcatcactgtgggaatgcaaaatggtacagctgctccgggaaagtgtggcagcttcttataaagctaaacaaacgcatataactgaatgatcccactcctagttatttatcttaaagaagtgaaactttatgctcacacaagaacccgtgagtatatcagctctatttgtaatcactaaaatttgaagaccactgaaatattctttaacagttgaatagataaaccttgatacatccatgcaataaaatactactctgcaataaaaaagaattaactgttcatatacacaacaacatggatgaccctcaaaggccctttgccgagaaagagaaaccaatctcaaaaggttttcttgctgtatgattccatttaggtattattcttgaaaagataaaactgtagtgatgagaaacagatcggtggttgccaggggctgaggatgagaagaggatgtgactatagaggagaagtatgaggaatttttccgaggtgatagaactcttctgtattctgattgtgtgatggttacgtgaatctatacatgcattaaaatgtataaattttttcacaaaactgtgcaccaaaaagtcaattttactgcatgtaattaaacacataaaataaatgttataggcagaaaataagctgataaaagacacaagtacacacagagagagagaagagagagaaaagaaggcaatagtccaagatgaagagggagatggataagaggaatgcagaagaaagaaggttgtcatgttatgatactaaaaagtaatttaaaacagtagactaaatcaaagtgtgtagaagcagtagatagaggagtgcctactgcagaaaatgtaataagtaatatggaaacaagcttaaggagtgctccaatggggatggcaggggaaagggacaaataaataaatataaccactaaataaatgacagatgtagagaacaaatagcatttatccatgggtaaatgagtatcagatactcctagagaaaagaccagagcaaatggaaaagcatctatactgtattcaaagtagagttcaagacaaatatataatatactatataaaatgtgtcttttatttatggtaagtaaagtctggggacaaaaagtaatcatgaacctagggccaaaatgcataaagcaaaaacttgaaatgaaaggagtaatttacagaaataccataatagaagggctttaaaaacacactttgtcagtcttggacagataaaagcggttaagaaaatggatatagataatttaaataatataattagagtgaatataaaatacctctctatcttgaatcctgaacccttcaataaaagaattacattttttccctagtattcacaaaattagtgatatattaacttgttaaggaaacctcattaaattccctccaaaatgcccccagaaattgctcagcccacattttccgataaaaataaaacagaactagaaattaatgacaaaaacatataataccaaagatcaatggatgagtgagatggaggtaggaatcagatgggagcctcaagaattgaaatcttgaaattgcttctgtaaggaatgggaaattaactagggacacccaataggtttgacaagcagtgtgcgggactttgctgtggttggagatcatgggtatatagtggcatgaagcccctatgtgtgacactttcccctggggacactgtctagagcaaatttcactcatggttgagggtatgcacacaggatgttgaagagacaggaaggtaaggacatttaagccactggtcagaagcgattgaatggcttttccatatgggaagtggtagggaggaagtaaaaccgtagcaatgcactgatggaccaggggaaaggaaacagttgaggaactggagggtttgatgaaatgaaaaaaaaaaaaaagccaggtaaagggagtagagacataaaaggataaactaccactggagagtttagaggctatgccatatcaggtgaaactccaaatgcctggactggagtggagaggaggtcataagaagaatggatgatacgtttgacttcacgtcgtctattattctcagacctcctccaagattcatttgtatgaaaatcacattggagggatactcttttagccctggaatttatcttgattgttacataatttggtctaaattctctgaaaggagaaaggaaatcaacatttgttgagcctctgccatgtgccttacattccactttgacactgttatcctctatcattagggtagtcatataatttattgttaaaatttggactctcttaagagtgagaggacaacagttctaaattgaggttgctctgggaaaactgggatggatggtcacccccactattatccaagagcccatttgagttgtctgtgtaggtttatgagaatttgggggtggggagacaaaggctcagagaagccatttgagtgagatcacccagttagtgagagtcatggcagaggtagaattgacaaccgtgtctgcctgactctgaggtctagccattgctaacttagttcctgattcaccacgctagctctccaccattgtttcactagctgtggcttgacaggctctcttcttgacagacaccatgacagtcccagctggaagtctgtctcaacacagataattagatgtgtgataactgtaccactgccagcaatgatgggaagccagctgttctaggagcctttgggaccacgatgtgctcgggaggactttgatgctggatgtgggctgcccaaagaccccacgtttgctggttttgtaatcagagcctatcaggtgaagattatacagcatggccagttacagaggctgggaaggggattctgagggatttcagggctcataaaagccacagcatcagagaaccttggggtcagaaacccccagggttagaagaagtaataagtaaacaggaatcgatgggacacaaatctagattgtagagcaaagggctaaagaagcttccaacttgggaaggtatggcagggcaggggggttcaagcaaaggaccaggtaaactgtcagccaccaacagataactgaaacaggagaggggcagggcaggacagtgaaaataggttgatggatctgaaatgattgacctgtttagtctctccctccaaccctggttagggcatgtgctgaggatgtccagctgacctcaatgagcttatcctgggtctgtgtgttattcaccacggagctcattttctgggttctatgatgcaaaccaaaagtttttaagtatcaccctgcggatccaattaccctataaactctttggaggaataggatggggtctctgaaagccagggcaatagattcttggaaactgtaaaagcacaactgaatttgtaaattgttttaataacacaattaatacaagaatacattctctttgtcagaaatttaaaatgtgatggataaagctaaaatctttattcacaaccctcaaatcaggttcctctacctgttcctcagaggtggacattattttaaatcaattttgggtatatcttttcagactcttttctatatatttacattcatatatgaccttgtagaaaatgcattttactgtacctttcttttaaatatttggagggcctttaaaatttttttattctgacataatctcaaaatgacagaaaattgcaataacagtaaaagaaatttctgtatacactttacctgatgtactaattgtttatattttgctccatttggtttagcattttctctactaatgtatttttatatgtgtgcacattttttttctgatccatctgagagtaagttggggtcatggtttccacttatcctgaaatacttcagttgtatttcccaagaacaaaaatattcttagtacatttattcaaatgaggaaatgcaacattgacccaatgctattatctgacagttcagctccagatttcactaattgaaccactaatgccttcacgcttctttcttaaacaaagaggcattatattgccctcatcttcttttttcaacgtgcttcatcttgcttttttcaacacgtttctgcatatagataacccaatgttatcggcatgggcaaagtgcgtcacagtatgaatgcgccatatattatttactgtttcccccattggtgggcactcaggttatttcctacttttataattgcacacatcctcaggctgaatattagtgggtattactttggattaatgttcttttatttttccttaataaatccttcactggaatgaattactgttttgaggacacacagtgaggacaaagcaagactcacaatattgaggaaagttccttcaaaaggagttaaataagagatgctcctgattcacataatgtgggatcgggatatgaaagcagcacaattattctgagttttctgacagataattgtatcttcttagaaagaaaaaacaattaaggaacttcttggtgaagaacaattcttggaaaaatagttaacatgcatgctatctttttatggattcagtgctgtcttagagaacttggaccagaatgcagaggcctcgcttgctccaaagacccttagacagaaacaggcagacctcaccctgcacccagagccccatgcccacggcaagcagtgttctctggaccaggacacgcttctcctgtactctttgcaaacttccaccagtggggacgtttgctatttctgctctgtgtgaagcatttggtaccatctgggctggctgagtttcaacaaagatagtaaagaaacatttatcaagaaaaatcaaagtcggtctcgccaagtgtggtctagagagatttgcttccgcgatacatatgcggctctcttgctgctgggaaacacgactcaactttgaaacacttcaggagggacagccctttggatcttagcctgcagctactgtcaactgctcatgatagatggttttagtagccagagctcttggagatgtgaatgccagcagtctcaggatgcattccacagcattccgttgcacagaaagttttggcccctttggtagagaataagctcaaaaggacaaaagtagaagaaaggacctataaaggtgagggaagagtcatgcctcagtgagtaatgtttggctctgcaatgattagattcccaagaaaaggtcattcttggctgcacacagtggctcacacctgtaatcccagcactttgggaggccgaagcgggaggatcactcgtggccaggagtttgacaccagcctgggtaacatagtgagactccatctctacaaaaattttttaaaagttagctggatgtagtggcacatgcctgtagtcccagctattcagggtgctgaggtggtagcatcgcttgatcctgggagatcaaggctgcagtgagccgtgatcgcgccaccgcactccagcgagaccctgtgtcaaaaaaaaaaaaaaaaaaaaaaattgctcttaaaccacgagtcttgagattgacagcttcaaaatacaacactcttgtccagcaaagagcactctaaaagagctgtaaattccttaagcttatgatagaagatctttttccagtgactacccttgtggtgtcagttcataagactggggcggaggagggggagtggccttgccagggagaagaaagatgagctgtttcctcttgcctctgtgttaccaatcaaccagacagacaagcttctggcgcatctgagtgtctcaatcctgtgtgtgtgcagctcactatgtgatagatgtgtcactccaagatcccagcctagaaactggtacatgttattttccttggaaggctcaagaaatgaaagtaacagttggatattatattctatggggaaaatgcatgggtattttgagaaattattattctccagaacaatgttacttaatgtgtgtcttatagactggcagcatcagcatcacatggaaatgttttagaaaagcatatggacaggtttcactgcagacttagggaatcagaatctatctgtgggggtgggtgccagatacatgtgtctcatgagtcctctgagtaatttttatgcacactaaggtttaagaagctctcctgtggaagggttcgagtaaacatcgaatgcattgttaagaagaaaaccacaaatggttccatttgatgtcagtacgtgtggaaatggttaactcttcataataaaaatagacaaacaggcaaggcatggtggctcacacttgtaatcctagcactttgggagaccaaggctagaggatcatttgcatccaggagtttgaaaccagtctgggcaacatagagagacccccacctctacaaaaatttttttaaaaattagttaggcataggttggcaagcacctgtagtcccagctacttggaaggctgagttgggaggatcacttgagcccgggaggtcgaggctgcagtgaaccatgatcatgccactgcactccagcctgggtgacagagtgagaccttgtctctctctctctctctctcacacacacacacacaacaaaaacgtagtgaaagagggcattgcatatgaataagaataataatgaaatagcagtaatatatagcagttaacatttattgagtattttttaagttccaggttctgtgctaaacatgtatattctttatccaattttactcttgtaacaacctattttattgatcaagaaattgaggttcatatgtgtgaagtaactgcttggtaagatgcggaccctgggatcttatagccctgtgtccatgacactatatggtctgtcttggggacaagattaacattttattttgtcccctatatccccagggcctagcagaatgcttagcacttagtagggacttgcttgttgaacttaactgatcaaggtcaacatcttgcttttggtgtaaaaatgagatgcagcttgcaagctgagatgggagatgaattcagcctgtggaaaaatagaagacactgccatgttgctggagtgcagaaaaaatgtcagcacagaataagttacagcttgatcctggtagccgattcaatgcttctcccatctcatttattcggtctcaaccccttactagctgtatcattttagggaagtcagtcttatttattttccagcaatggtcagctgtttgagtgtaggaaaaggacagagtaagaaaggacaggtatttgaatttaagtagggctggggtcatgtgagacaagtaaaataaaaagaaagaggggcaagggagttgagggtctttccaaaggagtagctaaaatgcaccataaaattgaatctggatatgaatggagtaaaagcaagagggaatagggagatcaagagaatgtgttgggttcgagggactgattggtggagaatggactgacgaataggggaagatttattgcagtagaataatagaactaatgaattggaaaaatagaaattggtgtaagatagtagggtacttgaaactgagattgagaaagtggtataatttctgggataataggctccagagcgtgaccatggtaggagataactatgattgggggtgagcaaaggttgcaggaaatgagggggtgctttctctcctactttccaatattctttcttctaatctgtttttcttgttatcttgagtttacaaaatttctggttttatttatgctgtggatatttttccagccttttccctatgggctgtctgggtgcaggttatgggtgatacatggataataggtgcatcttggtttagagggtaactctttatttcttactgcacttatggaacacgagaaaaaaaagtattaaataatggctatggtaatggatatctttgtcttattccttactttaatggaattgcatttatcatgaaccatggtgctgttatttcagatagcctttatcctgttaaaattctctgctgtttctagataactacaatgatcttatggttttcttctttgatctataaatatgatgaatatattgaaaatagatttcctaagattgaaccatctttgcattcctgataggagtcattatgtattcaccttttagcagatagttagagtcgatttggattgaatgtattactgtggattgttctactgtaagtgagatgattgacattgtatccttaagagctgtgcaattctcattttctagtctgcttccattgactacctgcattactggtttctgaattgattcctaattaactacttcctgtttctccaagctgatgatttagtctccctcatcctttctatagccagttgcatcttcactgctgattccctgcctccttttctcctgtaagttcatcttttttttttgacggagtctcactctgtcgcccaggctggagtgcagtggcatgatcttggctcactgcaagctctgcctcctgggttcatgccattctcctgcctgggcctcccaagtaggtgggaccacaggcacctgccaccatgcctggctaatttttttgtattgttagtagagacagggtttcaccatgttagccttatagcctctttacctgggtgttctggagtcagggtggagctgagctctaatgctgctgacattgttccagccttctctctatgggctgtctgggtgctggttatgggtgatacatggataataggtgtaccttggtttagagggtaattcttcctttctttagctttttctttttgaatggaggtaaaattaacgtaacataaaattaaccattaactgtttttaaacgtacaattcagtgacatttatagaatattcacagtgttggacaaccatcatctctatctagttctcagaaattttcatcacctctaaaagaaaccctgtactcattaagcagtcactccccatttccctttccctccagcctctggcaactattaatagtagtctactttctgtctctatggatttacctgtttgggatgtttcatgtaaatggaatcatacaatatgtgaccttttgtgttggggtacacaaatgttcatagcagcagtattcacaacagccaaaaagtggaaacaacccaactatgcatcaactgctgaatggataaacaaaatgtgggatatctatacaatggaatattattcagtcatgcaaaaaaatgaagtgctgatacatgctataatgtggtgaactttgaaaacgttatgctaaatgaaagaagccagcctttcctgtgggctttgtggaaaataagcttagaaaacttacagttaatcttggtatgggaagagcagtgtaaaagtcagaaatccatttttaaccaacacagaccagagttgacatcttatcagcccatctcattttgtgcactgcttcagctatggatgttaataaaattaaatttctcactaaacaagtgtgatgccaaagaaccttccacaagttctgcagctgtcactgcttggtgcttaaacatgttggacagtattaatgcaaaaactgctttttctttttcagtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagattgtaagtggaaatgactgcagtgagcatgggtggtggaggttgggttatgtgccacctgaaatcagggagttcctcctcccttagctcctgtttccttccttccctacctccctccttttctgtcttctccatccctcactcctatctttccctcccttcttttccatctgcaattttgtattgtgagccaagaaaaaaaattagagctatttttttaatagagatgagaatgcctgtggtgtgggggagtgggtaggacaggaaatggtgtgatgtgttgctaagtgaaggcaagttgtgggagaaatgatggggctcagcaaataggggaacataacctacagggtgtggtgacagcctctctagagttgggtttatggatgatgcttggcctgcagccttctgggacatctccaccagcctcccttgagggtcttccctggccagggctccaagaatctgggagtctctttcttgtacatctaggcatcaggagttggttataacagccaattcactgagcatatatgatgtgtgacaaacactgggttaagcgatccgacttcatcggctcattttattcccaatgtagcaatagggcttatagaggttaaagagtatgcccaaagtcccatagcaaatatggggtggagtgggattcagcttctggcagtctgactttagcggtcatacttttttagccaccagctagaagcacagttccttgtcctgtctcctcttccctctctcagggcaaagctgggccccttctcagcctcagtcaaggacatgtctcagaacagacaatttccccaggatttttctccatgcatttcctcagcctcattctcaacccacctgtgtgcagatatacacatgtacacacccaattatgcaattgatatctgtatttcttataggcaataggaattcctgaatatcctgaaccctattaagacataagataacaaaagtagttagaactgttcttgtcatagccagtctaagacctctgcctgtttaagccacaggctgtcaaacagaaaaagctctcactccctggagagctagcctgggatggaaactgaatatgtttctttcagcagcttgtaatctttaaaactttctacctccaggtcttgtcctcttgtacatttattctgcttgagaaattactacaacctccactgatgtcttttctttttctctatgcagtcagctgaaagaatcggacaaagacagaagactgtcagtagagatttgggattgggatttgaccagcaggaatgacttcatgggatctttgtcctttgggatttctgaacttcagaaagccagtgttgatggctggtaagtaagattttgccttgaaagctaccatacagcttgctccatcaaacgcggggtcaagtatgttttcctttttctccaaaaattgaaatactaaaacagagtcccaaagtgaagtctggttgattggatctgccttgcagatatgttttgtttggtccttgtactaaaaacaaaaaagaaagaggccaggcctcgtgtctgacacctgtcatcccagcactctgggaggccgaggcaggtagatcacttgagctcaggagtttaagaccagtctgggcaacatggtgaaaccccatctctatcaaaaacatgaaaaattagctgggcatggtggtgtgtgcctgtagttccagctactcaggaggctgagatgggaggatcacttgaaccctggaggcagaggttgcagtgagcaaggtggtcagagattgagccactgcactccagcctgggtgacagagtgataaaaaagaaagagagagagagagaaggaatgaaggaagggagggaggaaggaaggaaggaaggaaggaaggaaggaaggaaggaaggaaaggaagaaaaagggaaagggaaaggaagaagaaagaaagaagaaagaaagacggaaagcaggaaggaaggaagggaggaagggaaggagggacagaaggagggagggagggaattagttctagtattttaaaaatctggggctagaaggcaacaattgagaacagttgaatagttaatgccccctttagacaggacatggattttctatttgtcaccgtcctcaccactccctattttattacatctgggccaatttactaaactacatgatgagactgtaactgcccagtggcttctttgtgcctgctgcccagacagagccgatttatcaagatgggagaattgcaatagggaaagagttttacacacatagagccagctaaatgggagaacagagtttttttatgactcaaatcagcctccctgaaaatttggaagctagggcttttcaaagatagtttggcaaggagtagggtggctagggaatgggtgctgctgactggttggggatgcagtaataggggtgtgaaaaatggtcctcgtgcactgagtccacttctgggtggggccacaggactagttggcaggtccaggtggggcagtctggttgtcaggaaggcaaaagcctgaaaagacatctcaaaaggccaatctcaagttctacagtagtgatgttatctgtaggagtaacttaggaagttggaagtgttgtgagctctgggataaaggctgataataatccatgtctacatcttagcagaattcaggctcctttcattctcctaacttggcaatatttcattagttttacaaaggcagtttagttttgggaaagggctgtcataatttaaaatatacaacaaatttctttcaaagttaggttggcggtctggtcggggtggagccattggttacgagaaatgcaaaaaaacctgaagagacatctcaaaaggccagtctacaatagtgatcttatctgcgggggtcattgggaaagttgcaaatcttgtgacctctggaataatggctggtaatcctttatgtctacaccttagcagaattcaggctcctctcatcctcctaacctcatggtccctcattagctttatgaaggtagtttagttttgggcaagggctattatcatttaaaatgtacactaggccgggcgcagtggctcacccctgtattcccagcactttgggaggccgaggtgggtggatcacgagatcgggagatcgagaccatcctggccaacatggtgaaaccctgtctgtactaaaaatacaaaaattagttgggtgtgctggcatgtgaggatcacttgaaccagggaggcggaggttgcagtgagccgagatcatgccactgcactccagcctgggtgacagagcaagactccatctcaaaataaaatgaaataaaataaaataaacactaaatttgtcacaaagttaacttggcccgagcccaggaaagcgtaagggcagtttggaggttaaaggcaagctgggggttggttagatcaaatctctttcactgacgtcatcattttctccctgttacaatttctgcaaagacagttccatgactggctccatggacactagagtggcttgtacacttcacctgaaagatatgagcaacccactgtcagatggtgtctgagaagctaccgcttccttgggagtccttagcaagtctggccacagatcatagatgtactggggtgttgttttcatagtcagctgctgtgtctcctttgtcctgaagattttattttgctcccttcctatggcaaaaaaaaaaaaaaatatatatatatatatatatatatatatatatatatatatcctccaatgttaccaacagagaggctgggtaagcccccttggcaactgtttcacagttaactgagtcaaggagtcagaagaaatagcttaacctggcactataactttgggagaagtggcaattgggctgctattacttctttaagataaattgtctcatatctgaattgtctcattcaggaccttttcagcttcaagtgaaagaaaataaaaatcaaactggtttagcgagaaagagatgtgtcctttggaccacacacacatctttcctttccattgttcaccttatgacttccttgtcttggctccatgtttcatcttaggccttttttttttttttttttttttgagacggagtcttgctctgtcacccaggctggagtgcagtggtgtgatctcggctcactgcaacctctgcctcctgggttcaagcaattctcctgcctcagcctcccgagtagctgggactacaggtgcccgccaccacgcccagctaattttttgtaattttagtagagatggggtttcaccatgttagccaggatgatctcgatctcctgaccttgtgatctgcctgccttggcctcccaaagtgctgggattgcaggtgtgagcctccgtgcccagcctatcttaggcttttcttgaaacatatattgagtgtccactaggtgctggtcactagaaacacatggaggtataagacagacatgacttcatggagcttagcttatggcagagggtgggttggggagataaacattgaacaaggaattacgcaaatgacaaatcaatgacaacatgatggaagatgtgaagaagacaggagctgagagttttgaacccaaaagtatctgagacagatttcaatcagtttagaaagtttattttgccaaggttaaggatgtgccagtgacacagactcaggagatcctgatgacatgggcccaaggtggatggggtacaacttgcttttatacattttagggagacgtaagacatcaatcaatacatgtgagatttacattggctcaatctggaaaggcaggacaactaaaagtgggacggggaggtgcttccgggtcataggtagattttacaattttctgattggcaattggttgaatgagctgttatcaatagaaaggaatgtctgggttacataaggagttgtggagaccaaagttttatcatgaagatgaagcctccaggtagcaggcttcagagagactagatggtaattgtttcttatcagacttaaggtctgtgttgatgttaatgctggttggcttttcctgaattccaaaaggaaggggatataatgagacatcgtgtctgactctcccttctcatcatggcctgaaacagtttttcaggttaactttggaatgcccttggctgagagaaggggtccatttacatggctagggggcttagaattttattttggtttacagaatgtaccccaaaagagttgtgttaaagcacaattcacaaatggttaaaaacatagttctcataagatagataatgggcattaatgggcattggccaaagatttccttagctcactaaggagaaaagcagcaggatgaatgaatgattccacagaaggtttgataaactgatgttcgtgtagtcagtagaaaaagatatgctgaaataactttgctcagttaaatataaaactgactgatatacaggacaatagaatcataagctttggggttatctactagaatgaaacaaaaaaaagattttggccaggcatggcggctcacacctgtaatcccaacactttgggaggctgaggcgggcggatcacctgaggtcaggagtttgagacgagcctggccaacatagtgaaaccatgtctctactaaaaatacaaaaattagctgggcatggtggcaggtgcctgtattcccagctactcgggaggctgaggcagaagaatcgcttgaacccaggaggcagaggttgcagtgagctgagatggtgccacggcactccagcctgggcaaagatttcacctcagttttctaaaagttaacatgtatctttgcagactagggaggccatctggggctgacctgatggtgaataataaactaaacaaagtaatattactgtgaggaaagaaatagctaattagaaaatgctctagcatgacattaaaagttcacacggtcatctttttggttttctttttcccccaagctttggatatttttccctaacatgcaaatgacttgactttgcagggtgtacatcagttactcacagtggatgtttcattctcattttaaatcaaacttaaagaggttaaagagaaagaatgcatgatcctcagggggtatcagtgtgacaggaggaaacataataataataattataataacaatagctactactcattgactcttaatagatgccaggctctgggttgagcttttccagatgtcgtggagtcacaattttacacagcactgatcaggtgtgcagaaaaaataaagcttatttcttttctataatggacttagactttctcatgcacttttgtgagctcctggtgaccgaggagaagggactctatatgctgcatgtggtactttctgagcttcactgtttcacttttctgactggtcactgttaacagcaaaacccagctctgtaaaatattttaaagaagtttattctgagtcaatataagtgactgtggcctggggaaacacaaacccaagaagctttgaataagtggtcctgaggtggttagattacagtttggttttacatgttctggggaggcagaagttacaggcaaagacataaatcaatacatggagattatacattggtttgggcccaaaaggcaggatagctttaaatggggcttatgggttataggagattctttaatttgcagttggttagagtaagactttgctaaaacttggagttaacagaaagaaatattttatgttggctgggcgtggtggctcatgcctgcaatcccagcactttgggagaccgaggcaggtggatcatttgaagtcaggagttcgagaccagcctggcccacatggtgaaaccccgtctctactaaaaatgcaaaaaaattagcaagttgtggtggcacatgcctgtaatctcagctactctggaggctgaccaggagaattgcttgacgcaggaggcggaggttgcagtgagctgagatcccgccactacacccagcctgggtgacagagtgagactccatctcaaaaaaaaaaaaaaaaaaagagtgtttaagttgaggatgctgtgcagcaagatggcttgcttatggtgcaacttcacctttgcctggcctggcgttagtcctgtttataatctgatattttattgccacaaagagtctgttttgtcagtcttatgatctctactttaacattcatgtcagtccattgttgtatataaactcccaaagaaaggaggcataacaagacgtgtccaatctcctttctctcatggctgataattctgtttttaaggtttttcttagatcctcttggccgaggagggggtctgttctgtcagtggggggccttaagattttatttttagcctacgttcctaaaccagcgcccactgaagtgggactggtcccacctagctttggggcatcattctggctttgtgctgaagatcctggcctgttgcttctccttgtgagttccctccatgcagcaccctctctgtcccactcataggccactgctgggcctggttcagggaggccaggaacctgcctgagtcctccccctgaggagtcttttctgctccttctgctgctgctggaatgatgttgcctggtgcatggataggtctctggccagcgttccagccgaggaggagggaaacccacctctccccaccacctgtcctttctccttcccaaggttctccaagccccaaagggaggggcttctcctacaatcacccaatgagttcatctagagctgattcactgagacggcaatattttagcagagaaagagtttaataaacacagtgccagccaagctgaaggatgggagtttattactcaaatcagcctcctccaaaattcaaagactagggtttttcaaggacagtttagtggtaagtgggggctagggaatggggaatgctgattggtgggttgagagtgaaatcatagggggtcaaagctgtcttctcatgttgagtcagttcctgggtgaggatcacaagaccaggtaagccagtttcgttgtatggattcccagtctgggttgcaccagctggtccatcagaatgcagggtctggaaaatatttcaaacaccaattttaggtctataatagtgattttatctataggagcaattggggagatcctgaatcttgtgacctctggctacatgtctctggagccagaattctaactttgtggctaatatgttagttttacaaaggcagttttagtccccaagcaaggagatggttagttttgggaaggagctgttatcgtctttgttttaaagttaaacgaatggccaggtgtggtggctcatatctgtaatccccgcactttgggagtgccaaggtgggaggattgcttcagttcgggagttagagaccagcttgggcaacaatgagatcctgtctcaacaaaaaatttagccaggcatggcggcatgcacctgtgctcccagctactcaggagcctgaggtgggaggatcacttgggcccaggaggttgaggctgcaatgagctgtgattgtgtcatcgcactccagcctaggcaatggagaaagaccctgtctcaaagtaaataaagaaacaaatacaaataaaaaatgaagttgaactgaaactaacttcttcccatagttagcttggcctaggcccaggaatggacaaggatagcttggagattagaagcagatggagttagttaggtccgatttcttacactgtcatagcttttctatgtcatatttctcttactgtcataatttttgcaaaagtggtttaactcccacacatgccatatccttcttcctgggctagtgcctgccttgtctactcccctaaggctgagagcagggaagaaaaaaacggcttaagaatagggatagtgtatcaggagtaagcccaaaatattactgcatttacacttagatgatcatttaattctccagttattctaggtttcatcatttccaaggctcagaatagttcagcagtgtgttagggatacacagcttgtaagcaacggtgctgggttcaggtccagatttctatgatgccagagcctaagcatatacaaattccattctgcctcctgatacagggttaggtggaaggctagagggtagacagctgggattttatttcggctttcctgactggatggatgctttgtgacctcaggtgagccacttcacctctctgtactacagctttcacagcagatatgccacccatcagattgattacaacaccccctgtcctccatccaccacttaggatagctgtgaagttgatgacataatagttggaagggaacttttccaaaataaaagccctctgcagatttttgcagataaaagtcctcctcagatttacggccaagacatttgcgatgctgtcttgactgtaaatggaccagatcctagacatttggattcttgcccctgggattctttgaacattatgtgatcttgagcaagtctcacaccctttctgaaactcagattcaccatttagaaggggatgggctccatcagctcttctgttgtgctgtaattgaagaccgtgtggcagaaacagcagatgcagctgtggaagctatcagatgtggtgcaccagccccaggccccctgtctgcctcttggccaactgccctgtatctgttgacaaatccgcctctttgtttctaattttgtttatttatactgtctcctttctttccccttcattttccagaggttcatctgttttatttacttatttattttcttcaaggaattaactctgggatttgtgtatcaattttgtttgttttctccttttctgtaggtttattttgtgtttggctttgactttcagttgaacattttactaatttattttttcttctttcgcctgactctgctctttaaaaataatgaatagcttttttgtttgtttgttttgagacggagttttgctctgatgcccaggctggagtgcagtggcacagtctctgcaggttcaagcgactctcctgactgagcctcttgagtagccaggattacaagtgcctgccaccacacccggctaatttttgtatttttagttgagacaaggtttcaccatgttggccaggctggtctcgaactcctgacctcaggtcatcctctcacttcggcctcccaaagtgttgggattacaggtgtgaaccaccgcacgtggccaaaaataatgaacaagcatttaagggaataaatgtttcctctgagttttgatatgctaacattctggcttttgctacttccttgagggcctgcagttgaggttttagtttcttttctaacatgctttaatttaggcattttttttaacccctagaattagatttttgtttaaatttttaatattaatgttaagttactgttttagtgctttcaagttagagaatatggcctgtgcacttttctttttccctcctgttttctttcctttctttcagcatagcttagtatttgttcaatgttgttaaaagttctgtggacttgcaagaaaaagattatattagctattcgtagagtatacttttttgtggagaaagaataaaccttttttcaacttttattttagattcacgggatacatgtacaaatttgttacctgggtatattgcatgatgctgaggtttggggtatgaatgattccgtcacccaggtactgagcatagtacccaacagttagtttttcaatccttgtcttcccctcccctctcccctctacagttcctagtgtctgttgttgtcatctttatgtccatgagtgtagggtatacatttattcattccaatgtattataaggtccagatcttttttttctgaggcggtgtttcactcttgttgcccaggctggagtgcaacgccgcgatcttggctcaccatagcctccgccttccgggttcaagctattctcctgcctcagcctcctgaatagctgggattacaggcatgtgccaccacgctcagctaattttgtatttttagtagagatggggtttctccatgttggtcaggctggtcatgaactcccgacctcaggtgatccgcccgcctcggcctcccaaagtgctgggattacagatgtgagacaccacgcccagctaaggtccagatcttttataccttcatattgtccttttgtttgcttgagctaaatgtgtagtgtttattaagtttcttcaggcaaaatgattcacaaacattctttttatttctaggggtttttgccttatctgtatatggcaatattattaaccacataactctacaagtcttattatattgacatgaagttatctttgttgcagctaatgcgttttctctataattttactttgttgctggcattcattcattcattcattgaatatacacagtgagcacctgctgtgctgaagagacactaatgagcaaaacagacaagaatccgtggcctcatggagttttctttttagttgaagaaaaataaacaacaattgtaaatgaacaaaaataagtaataaaacatggcatgtttgaggctgataagtgtcatagagaaaagtaaacaagaaatggggacaaggaatcttggggagtggagacattcagattttatagggaactcaggaaagaactcactgaaaaggtaacatagagcaaagatctaaagcaggtgaggagggagctgtgtggatatctagggagaggttgtcttaggcagcgaggacggcaagctcaaaggccctggggcaggagtgcacccggcaagttggaagagcagtaaggagactcctgtagctggagctggatccatgaggggagagtggaggaggattaggtcttggaggatatggggagagggttggcggatcctgtcggccttgtcaggactttgtcttctactctgaagaacacggggagccaaggaattaatgagattgaactgacctttgcatatgtcctctagttgtggtgtggtcgatcccttttccctagtaggtcctttcccattcttttatgtctaatctttctaagtcctttggtcttgtgtaacaagcggcacgttgttggatttttttttttttatttttgagacagagtctcactctatcgcccaggctggagtgcagtggcacgatctcagctcactgcaacctctgcctcctggattcaagtgatttttctgcctcagcctcccgagtagcagggattacaggcatgggccaccacacccatctaatttttgtgtttttagtagaggtgggccttcaccatgttggccaggctggtctcgaactcctgacctcatgatctgcccaccttggcctcccaaagtggtgctggggttacaggcgtgagccaccaagcctggcctttttttcttttttttttaaaattttactttaagctctgggatacatgaacagaaagtgcaggtttgttacataggtatacatatgccaggtggtttgctgcacctatcaacctgtcatctagatttcaagccccgcatgcattaggtatttgtcttaatgctctccctccccttgcccctcaccccctaacaggccccggtgtgtaatgttcccttccttgtgtccatgtgttctcattgttcaacttatgagtgagaacatgcagtgtttggttttctgtttctgtgttagtttgctgagaatgatggtttccagctttatccatgtccctgcaaaggacatgaactcatccttttttatggctgcatagtattccatggtgtatatatgccacattttctttatccagtctatcattgatgggcatttgggttggttccaagtctttgctattgtagctagtgctgcaataaacatacatgtgcatgtgtctttatagtaggatgatttataattctgaatctgaagatcttttttccacaggaaaatgttttaatgtttatagctataattgccatgtttcttatggtgtttctaaagttttctttttctttcctatttcattctttttttttcatctccttctaaacagataactattatcttaaatcagtgttatattacttttttttaaaaaaactttctgttattattaataatcacattttggtcttattacaaaaaaaaagcaaaaaacaaaaaacaaaaaaaactaatgctttggaatcagacttcccgggttagaatttctactgtaccacttcctagctgtgtacccttggcaagttacttcgcctctctgtgctgtgtttcctcatttggagataatagtcgtaattatgtcacaggattgttgcagtatcaaattagttaatataagtgaggtgcccaatgtctgctaaatagcactcagtaagtgttagtcattattgttaattgaataattattagaaaaatataagaaattggagaatttcagagaccccagattcccagtgcccataaccactattgaccctatagagagagagagtgaagcaaaaaatgaaatcttactgtgcatactatttggtaccttgcatttttcacctaaaaataatccgcaataaacataattgtggcaaaacttttgtgcccagctttaataatttcctaataaatttctaagcctggaattgatgactttaagcatatacacattattaaagggtttgccaaaatgtcctacaattttaaaaatcaatttacagtcttatcaatcttgtatgaaacttttcagtttattaacattaacatccagtgctataaatttcaaagatatgatacaaagattatacacatattgtattagaaattatgttgaacattttcatttgcatattgccatttgtttatatttatatatgactatgtccttttgcctttttcttattgacttgtaagaactttttatatgagaagaatattaatatgtctttcctgacatatgtatgttgcaacgttcctcctcctccttttcatgttgtaaattaattttggtaatatgcatttttcttatggtatataaagcattcggttcaactccaatctaatatgatagatatcaagccacttgccagaaacatttctcaagtttttcttttcattgactaattgttatctgaattatccatgctgtgttcactgtctcaaatgaattttttaattcagtgattatatttttcttccgaaagtagtctttcccactctcgtatttgttcccttttcacagatgcaccaacctcttgaatctcactgcaaatatgaattaggtagtttctagaatgttctctcttttggcagcagttgtatttcatgggagttactttgattctgcattgtttctttctatttaaatgactaaatttttcacacatcctattgtgcttatttgcctatccttatagaagggtgagcacagacatttctgtgtccttgttctaacatttcatatctggataaagggagacaggagtcttttgtattttttggaattctgttttgtcagatcaggagtcctgttcctgacatttgggcggggctacagtggagacaggtccataacaggcacccctcaagccagatggagagcccatcttcctcacgttggttctgtgcatctcaaagtcagaaggggtcctgctcctctctgagggggcacacgtgtcctatttggaggcagtagtggcagcgtccttcactcactctgtggcgtactggccaccgtgaacacacgctgtggcaccatgcccctgcccgctgcgccaggcactgacatgtctcctcttgcatatgaatgggaatcggcaaccctcacccggtcattgatggtctcagccggggtcattattgggctctgttggggcaccttttatggatgacagctggtcaattcccctttatctgtattttcccaagtgtgagaccccaaatactctagatggttcacagtcagggcataaataatattgaattgtgccccaagaaagcaattattttgtcagtgttctttcagttcttcaaattatggcaaagagaaaatctcagaggtctctgatatatcgttaacactctaacacttgctcttcgctgatctcccattaaaaaggggcaggggcaggctttcgattgagagcctttagtaagcaacaccatctacttgcacgtgcataaccttgatttccttgatttccatttgtttatttttttttctttttttttttattggaacattaattaggttttattttcactttttgtttccacagtaacatgtatgggattaggttacagtgtttatttgtccccaatcttttatttatttattttttttattatttttttttaattgattgactttttattttttattttatttttttttaaatttatttatttatttatttattttttattgataattcttgggtgtttctcacagagggggatttggcagggtcataggacaatagtggagggaaggtcagcagctaaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacggcaaccatccgatttctcaatcttttccccacctttcctgcctttctattccacaaagccgccattgtcatcctggcccgttctcaatgagctgttgggcacacctcccagacggggtggtggccgggcagaggggctcctcacttcccagtaggggcggccgggcagaggcgcccctcacttcccggatgggggggctggccgggcgggggactgacccccccacctccctcccggacggggcggctggccgggcggggggctgacccccccacctctctcccagatggggcggctggccgggcagaggggctcctcacttcccagtaggggcggccgggcagaggcgcccctcacctcccggacggggcggctggccgggcggggggctgacccccccacctccctccccgacggggcggctggccgggcagaggggctcctcgcttcccagtaggggcggccgggcagaggcgcccctcacctcccggacggggcggctggccgggcggggggctgacccccccacctccctcccggatggggtggctgccgggcggagacgctcctcacttcccagacggggcggctgctaggcggaggggctcctcacttctcagacggggcggccgggcagagatgctcctcacctcccagacggggttgcggccgggcagaggtgctcctcacatcccagacggggcggcggggcagaggcgctccccacatctcagacgatgggcggccgggcagagacgctcctcacttcctagatgtgatggccgcccggcagaggtgctcctcacttcctaggtgggatggcggccgggcggagacgctcctcactttccagactgggcagccaggcagaggggctcctcacatcccagatgatgggtggccaggcagagatgctcctcacttcccagacggggtggcggccgggcagaggctgcaatctcggcactttgggaggccaaggcaggcggctgggaggtggaggttgtagcgagccgagatcacgctactgcactccagcctgggcaccattgagcactgagtgaacgagactccatctgcaatcccggcacctcaggaggccgaggctggtggatcacgtgcggttaggggctggagaccggcctggccaacacagcgaaaccccgtctccaccaaaaccagtcaggcgtggcggcacgagtctgcaatcgcaggcactcggcaggctgagtcaggagagtcaggcagggaggttgcagtgagccgagatggcagcagtacagtccagcttcggctcagcatgagagggagaccgtggaaagagagggagagggagaccgtggggagagggagagggagagggagagggagaggagggagaggagggagaggagggagagggagagggagagggagagggagagagcgtccccaatcttttaagtctattttttttttcttgagacggtgtctcgctctgttgcccaggctggagtgcagtggagcaatctcggttcactgcaacctctgcctcccgggttcaagcgattctcctgtctcagcctcccgaatagctgggactacgggcgcgtgccaccatgcccacctaatttttttgtggttttagtacagatggggtttcaccatgttggccaggttgtctcgatctcctgacctggtgatctgcccaccttggtctaccaaagtactgggattacaggcataagccaccatgcccaaccttttttttttttttttttttttgagagacagggtcttgctttgtcacccaggctggagtgcagtggtgcaataatagctcactgcagccttgaccttctggactcaagcgattctcctacctcagccgctcaagtagctgggactactggcatgcgccaccatacctagctaaatttttttaatttttttgtagagacagggtctcgctatgttgcccaggctgatcttggactcctggcctcaggtgatcctccttcctcagcctctctaagtgctaggatgacagacatgagccaccacgacgacctgtttatctttttgtttgttttgttttgtttgtttttaacaattattttctatttgtaacaagtgatattgaatttccttccaaggaagaaataaaaagtgtcctttaaaattaaatttattattaaaaaagtaaaacagatatttcaacgctgatatacaaatctagcaaaatccacaaaggtagcatctgaatggataaagttaaagtttacccaaaatagctctgttttctttctattactttaatttgtaggaatccctggaagtccctgctgtgtggatagcacccttctcgatttccagcaaagatacagatgctctcttgtttttatatttcttttggtaatttccgtggaattttggaagaaaatttggaatattaaatgtggaggcgtagaggctcaaattgtcttctctgctttgaatcacctagcccatttttggaagctgcgtaagaagattcgtgaatggagagaaaacattgtgatgaaaattttaaactttggttaggaatgatctttgagagcgaggagttttggggtcttttttctttcccactgattcaaatgcttttagaatgtcccttttctttcctcacactcatctcatcctcttactagatgaaaaaatctttgtggtcaagaaacaaactgaagcccccatgtttattattatattagtagtagctgggcatggtgggatgtgcctataatctcagctacttgggatgctgaggcaggaggattgcttgagcccaggagttcaagactggcctgagcaacatagcaagaccctatctctgccagaaaagaaaaaaaagaaaaaaaaaacagccaggtgtggtgggatgtgcttttagtctcagctagttgaaagctgaggccggaggattgtttgagcccaggaggtcaaagctgcagtgagctatgattgtgctgctgcactccagccttggtgacagaacaaggccctgtctctaaaataataataatgacattagtcacagtaataataatcatgatgatgccactaattgaatacttgctgaatgccaagtgctgtgcttatcattttacatgcgtcattacatttcaatttcacaagaattctatgaaaaaggaatttgtattccaatttatagatgagaaaaacagaggcccagagaggctaaccagcctgtctaaggttatgagatgagatttgcacccagacatggtttgactccagggcttgtgcgcttaaccactaagggatgccgtttctcaaaaaggctgactacagcacattttgggaaaacttttgcagagaaaatagcatcatgaagtcaagtccatggtcacctaaatgcagttgagtgccaggatggcaaagtggcaccctatgcaccctatgtagggtgaaaggtagaaatgctggaagagcatgacaagagtgtatttacagtcaggcagtgggggttgcaatttgggaggatagggtgagaagatcacttgaggtcaggaattcaagactagtctgagaaacatagccaactcccatctctacaaaaaaatttttttttgtttaattagctgggcatggtggcacatgcctatagtccccagctactcaggaagctgaggcaggaggatcgcttgaacccaggagctcgaggcttcagtgagctgtgattgcactattgcactccagcctgggtgacagagtgagaccctatctctaaaagcaacaacaacaataacaacaacaacaagaaatttacgatgagggatcttcatagcattctttcagaataagaaactacttaatggacaaaaagtaggtaaaaatatacagtaatttaacgatataactaagaaaactgtgtaagtgtgtatagagagagagtgagaactttgcctcctatgtacatgtgatatacattttttttctgctgtccatggaagagttacaaaaatacatagtgtacctggtagtgtaccatgcacactacccccacccaacatactgaaaaacaaaccaaaacaaaccaaaaaaccctcaacgtatattttttcaagtagagctttatataggcctccttttcatatgctgatcaataaaataataccgagtcgagtcatgaaatgtgtcccacccccttgtctcccttcaggtttaagttactgagccaggaggaaggcgagtacttcaatgtgcctgtgccaccagaaggaagtgaggccaatgaagaactgcggcagaaatttgaggtgaggtttcttttctttttctcttctttcttttttctctttcttttttccttctttcctcctgctccctcctctttctttctctttctctcttattcttttttctctccttccttacttccttcttcctctctcttttctttccttctttctcctttctttctttcttgcttacttgcttgctttctcgctttcttcctttctctcttgctttctcttgcttgctttctcgctttcttcctttctgtcttgctttctttcttgcttgctttctttaccccccttttctttgttttttccttccttccttcctgccttccttcctctctctttctctttccctctcattctttcttttctttctctctctgtccttcctttgtttctttctctctccttccttcttcctttcttccttccttcctttcctcccttccttctttccctccttcctccctccctcccccctttcctttctttcttcctccttcctctctcttttcattctttctcccctttctctctctcttcctctctcttgtctctctcttctttcttcatctcctttctttcatcagtgggaaccagttaggtttgctgctgtgctgattttcctgtttatggcatggtttctactaagacttttcatgactctgagcctttgcaaggttgttttatctcctagaaaactctgattaatccttcaagaccccaattaaatgcccttgccttatgaagttattcctgcttccctgtctgcattcaggcttagacatttcttcaaaagtgctcattcactgcccaccattttgatggtgacttggactggaatggtagtcatggtgaatgaaagaagtagacagagggccgggtgcggtggctcacacctgtaattccagcactttgggaagctgaagcaggcagatcacttgaagtcaggagttggacaccagcctggccaatatggttaaacccagtctctactaaaaatacaaaaaaattagctaggcatggtggtgcacgcctgtaataccagctactcggaaggctgaggcacaagaatttctctgggtggcagaggctgcagtgagccaagattgtgccactgcatgatcagtaatgctctgttgcccaggctgcagtgcaatggtgcgatctcggctcactgcagcctgggcaacagagcgagacttcatctcaaaaaaaaaaaaaataagtagacagagaagtgatatattttggaggctgagtcaactaggcttgctgatggatggaatctggattggctctattgacagaatgatgctatatagttaacgaatggaattgattgtgctaatgacttcatgaaataccctgggggtagatcttcccagagaatagttttatcaaatggaaagcccttggctgtgaccttgagttacattgctggctctgctcctacctgaaataaatccctttccttctacggggacaaataaacaccattttcagctacctaagagcagcaggtgtataggacacatccttgctttacaaagaaaatgtttgggggaagataggtttgaatacttacattatatgtgcattgagtgattttagtagtttcctgaggaaaagcacattattttgttcccacaaactcaatacactgagtctggtgggagatgatcaattctagataaaccatgatggcctactaactccccaaaaatgtatataatagcatagctaaaatgaaattaatttttattattgttattcatcaaataatgacacacacaaataaaaaaaaaacgtgtaaagaccatgtaaagtcctgggaaagagaggtcaggtaccttgagaacatgtacaagagaaatgtcacgtagtttgagagaatggggaggtgtcaggaaggaaacagcaatggaagtttaccatgtaaaaagaggggaaaatgtattctgttctgcaaacagcatgtgcaaaggccctgtggttgggggttatatagcagcaatgtgagactgaaagaagaccagcctgggtagagcagagaaagccaaagagagtccaaggaaaggctgaggaagtaggcatgagtcacagtacgtagggctgtgctggccttgacaaggattttagcatttatcccaagagtatttatcccaaggactttagcatttatcccaagagtatttatcccaaggattttagcatttatcccaagagcatttatccaagagcatttatcccaaaagtatttatcccaatgattttagcatttatccaaagagtatttatcccaaggattttagcatttatcccaagaatatttatcccaaggattttagcatttatcccaagagcatttacccaagagcacttatcccaagcgtatttatcccaaggacttgagcatttatccaaagagtatctatcccaaggattttagcatttatcccaagagcatttatccaagagcatttatcccaaaagtatttatcccgatgattttagcatttatccgaagagtatttatcccaaggatagcatttatcccaagagcatttacccaagagcatttttcccaagactatttatcccaaagattttagcatttatcccaagagcatttacccaagagcatttatcccaaggattttgttttgttttgttttgtttttttgagacagagtctttctctgtcacccaggctggagtgcactggtgagatctcggctcactgcaagctccacctcctgggttcacgccattctcctgcctcagcctcccgagtagctgggactacaggtgcccaccaccacgcctgcctaattttttgtatttttagtagagatggggtttcaccatgttagccaggatggtctcgatctcctgacctcgtgatccgtctgcctcggcctcccaagtgctgggattacaggcgtgatatcccaaggattttagcatttatcccaagagcccagttaccacacgtggtatatttcagtacgtcagagttggttgcctctgtttggttacggggctttgagttctagggctctaaattgcagacatgaaaaggcagccattagtgagtgtattcctgtttctgagggcacatcgtacacagcaagataaaggacaagtttgtttgttgaaagaaacaaactatcaagtttgttctcccctcaacttgatagaaatagcgcttaggggccaggcacggtggctcatgcctataatcccagcactttgggaggctgaggcaggaggattgcttgagcccaggagttcgagaccagcctcagcaacatagcgaccctacctctattattaaaaaatatatatttaaaaaaaaataaaaaaagaaatagcacttacgtattcccaaattccttgtcttgagcctatgcccacccgacatgctggaagatagtgatagttctgacccagtggggtcctcccttcctgggaacaagtggaacagacacattggccttgagcttatcagtcattctccagtgaccttgataacagaggcttgttcccaaagtcttggactcaagcccaagtgaactgaaaaaagaaccttccctccaagtagaactaaaaactggatactgtttgataaaaattaagacaggaaggcagtctttccagagaacactttctgtctctttcccccaacttgctgatgaagtggtatcatttgctgctgttatagaaatgtactattacgggtgaaaaacacaaggccagtattttcttgtatataaccaagtctcagttttgcaaaatgatttttttctgtcctggggcagctggggtgacatttcagaacaccaaggaaaagatttgctacacaaacagagcatttgtctgggccagtaattggcttggaataggagactgttttatccgcatgcaagaaattgtgtccctttctttctagcaagagcctgcaaatgcttgtttatgcctgaattataatcgctgcatactgtacttgttgatttaaaaaaatgtttccaacagaccgaaaattgttctcaggctcacagaggaatttcagttgaccttgaacatgagaaatgtaatccctgggcgataaccaattagcacccggaatgactcagaaattactttcaagcctcttatctggaggaattctgagtgacagtaaaatcgagctgctagaattggggtaatagaatttcatggtagtgtgagcttggcgcagttaccacacgtggtatacttcagaacatcagagctggctgtttgcttagggggctttcagtcgaccgtgggctttggaaaagaagactccattttggatggcgcacagtgggatttctcagagtcttaaaatttatttgtataacaaagtgcttactgtgtgccatttatgattctaagtgctttgcaaatattaactcaggtaatttaatccttacaacaacctagaatggtaggtactattatcacgctattttacttttacaaatgaagaaactgaagcccacagaggtttaagtaactttataaggtcccagagccagtcattgtcctgggtttgggttttcccagaaacagactataaggattcaagtgcaagtactttatttgagaggtgatcctggaagcaccataagttaataaggaagcattgccagaaaaggtgggaaaccaggaaagtaagtattatcaagcagactactgctgtgggcagctagggtttaaccctgctggagaactctcaagtcagcgcggaatgcatgcctcagaatttcccaatcaagggacaggaagctgaggggttatccgtcggctccccttccgttgcaggctaagggctgctcccagggaaatccactcacccgcactttcaatgtgccctgtgcgctgtgcccgctcctataaccagaaaataagctacaggcaaagaatcacaggtgtttgctgttagcagccctaggtgtagagagcagcatgctggtggtgtcttggaggaacaccagcgattgtacctgtgcaatgtagcctaatggttaagtgtgattgcttgagagccagactgcctagatttgaatcccagttctgccacctccttgctgagtggctgtaagcaagttgctttgtctctctgagcttctgattccctacctgtaaaatggggaattatagcacttcttacctcatgaggttatgtgaggattgaatgaggtaatgcgtttagcagagtgtctcacatgtcatacatatccagatgttagatgctagcatcatggtggttgttataattattgtctcccccttcgggataaataaagctcagaacatcctctttctgggctttggaagggctgcttggaggttagggaaaatctacagggactcctagcctacagaggtccctgccccactgctgggtagctgggagtgcctgtagtagttccttgtaggggtggagtggcagaggaatctgcagttttagccaggacaggcattcatcatcgggagtggagcccagagtctggctgccagggcttctccactgtcccctcgtgctgtctggaaggtggcttggctctttgctcagaaatgctatttgctttctctcttagcattgagttctagggctctaaatcgcagacatgaaaaggcaaccattagtgtattcctgtttctgaaagcacatcccacacagcaagataaaggacgagtttaatttgtgcctcaattttaaaatgttcgctctttgatgcagtgtgtgctaggcattgtccccttggaacaatgggatatttcaaaggacaaaggacagggctcctgtcctctgaaggctcactgagtaggggccacaaacccaggtgttttcaggagccaggcaaacaacaagaaggcgaaagagcttggcatcacccagtgttagcagatccccttcttcaaaagaagctggggatctgggttttcatatctccaaattttcaacagttggcaactaattaaatattaaaatgacaacaaactctgtgcagaccagaccaacagggttatcagacttctttttttttttttccagggttattagacttctgatctagattctagaagttaaattaacatgcccatgagaaaagttataaaagcaagctgggagggagggaggaaagaggggtgccagccccagattcagaggagagaagggagtttctagtgctgagggatgaggctgttagctgctccttgaaggacaaggaaaaaatcaacccctcttcccacccccccaaaaaagtccttatctgtccactacgcaaagtcaaatgaagaaatcaggaagtttgaggtccgtgctcacgtttcatggggagtgtgtgctgggacccgcaggtggatgggaaagttcccaggatgggaaatgggaactggggcaggcaggacttggatcttcacagtctggagaatggagactgtgaatcagatgggtcctgagccaggattcaaagaaggcaggacacatggtgctaaggtgatggggcagcagggaggggagtagggaaagtgtttgggtcaggccagcttgggggtgatgatttaggagggtgtgaggacatagcccgagaaaggtgagacggcttctgtcctaccctggctcttttgtttgcagtttccattgcaaataagatgaccttgtagttttaactaccccctcgttgcctctacaccccaaatctctgtctccagtccagatatctttgctcaagccccaaacccatgtatacaactgcttactgggtatttacacttgggttaaacctcaacatatcttactgcaaagtaaactgaccaagtatattcacagcagcgttgttagtaggccgaaaggggaaacaactcaaatgcctgtacacaggagacgggataaacatcaacaatgagtgccattcagcaatacaaagagacaaattaccgatttatgcaaaaacatggatgcatttcaagaacattttgatgagtgaaagaagccaggcacaagagtacacactctacaatgctgttcagatgaaattcaagaacagacaaaactgacctatgggatagaaactggaacagagattgccttagtggcgggggttgcggggggcgtcgactgggaacttttggagggtgatggaaatgttccgcgtcttgtttggggtttgggttacatgggtgtgcacatttgtcaaaatctacagaactgtgcacgtgagattggtgcactttgcggtgcccacctcaagtttcaaaacatgaataaagagaaaatggcggatgctttgttagccatggttcctatatggtaacagtggaatatgcaccccatgagggagaaataaaccttgaagttttaagctgctgtggggaagaggggatctcaacatgcctgaaatcacaccggtcatctctgcccaccctcttccccacacttccaaacttgctcctcctccgcttcttctcatctcagtggaaacaaccagcatcctgccagttggtcagaacagaggctggggagctgtccttcatctccaatctcccttctcccttgcccaatctgctacccatctggggtcagtctgtctcccaaatagatccactttgttcagtctacactgcagacaactgagtccatcatttttttttcttttaagacagggtctccctttatcactcaggctggagtgcagtggtgcaatcatggctcactgcaacctccaactcctgggctcaggggatcctcccacctcagcctcccgcgtagctgggactacaggcacacaccaccatgcctggctcatcatttctctccttgataatgcagtgacttcctagtgatcactcagcccacgtgctggggggtctcctctccactcagagtgacctgttaaatatgtatggtcataccatagccctgcttcaaacctttcaaaggctgtctgtcatgctcatagtcagcctgaatttcttaaggtcctttcaacactttgtctgcctcctgtgccatatctgccttgcatttcatgatccagccagacgatgtttcattccttgaatgtgtcttcccctctgttccataaatgctgttcctgctgccaataccagtttatctacttcagcaaccccaacataccttttggacacagtatggaggacccaatcccagctagaatgcacgttttttcagagtatctgtatccattttgccctctgatgtatcctcagcacctagaggagcacttagcatgtagcaggtactcaacaagaatttttgatttgtttgttggtttgtttatgacagagtcttgctctgttgcccagactggagtgcaatacagtgatcagagcttactgcagcttccaactcctgggcttaagggattctcctgccttaagcctcccaagtagctgggactacaggcccactgccaccatgtccagctaattaaactttttttttgagatagggtctggctgtgttgcccaggctggtcttgaactcctggcctcaagcagtcctgcctcagccttccaaagctttgtgattacaggcatcagccaccacatccagcctcaataaatgttttttgaatgaatgaatgaatcttccctgatattcaaaactttggaaagatttattttgcctctttatcttcaaagcaaccaaataatgcaacaataataatagctaccattcactgagcatgtgttgtgtgccaggaatgatactaaggactctgtgatacatcatttcatgtcatcatctccatgtcttgaaaaggtgatgaatgtttaggaagcttcaatcaccaaatgcaaattaagtgccttctctgtgccatactcctctaggtaccagggaaacagtggaaagcaaaacagacaaaatccttgccattggggagcttacattctggtataaggagaaagatgataaattgggaaacaagtaaatatatggtttgtaagatggtgacaagtgttttagagaaaatcaagtaagtaaggcggatggagattgctgagagcaattttatgtagggtgttcagggaagagccctcttatcagaggtgagagagttctggggaaagagtgctctgagcagagggaacagcaggtgcaaaggccctggggtaagagcatgtttggtgcattcagagagcagcaaggaggccagtgcggaagtagaaaggaggctgaaatcagaggggctcagtcatctgtggcctttggcttttactttgagaataatgggatggtatatatattgggcagaggaatgttatgacttaactgatgtattctgggccacacagctgattcatgtcagaggattctaccacgaggctttttttttttttttttttagtgagagagagatgggatctcactctgtcacccaggctggtgggcagtggtgtgattatagctcacagcagcctctaactcctgggctaaagcagtcctcccaccttggcctcccaggtagctgggatgacaggtgcacaccaccttgcctggctaactttctttatttttgtagagacagggtcttgttatgttgcccaggctgttctcaaacttctatcctcaatcgaatctcctgtctcagcatcaaaaagtgttggaattgcaggtgtgagccactgtgcccagccacacatgagcttttaactccacagttttctctctgctaaacgtgaatccagtaacgaagtcctggcagctgcaggtctcccactcatggcttccagtttttgcctcattccaaagcacctgctgccactctgagccccattccacagctcatggcaaggagtccctctcccattgcactgaggacacacgtggccctcactcatccatttatgcaacaaatatttagttgggaactatactagttgtcaggaaaaccatggagaatgagaaatattccgtgtccacaacagtctccaatttattggaaggaaacaagtgaacaggcagttatcctccagtatttatgggaagagaagtggatgaaggaagaaaatcagaggagaacctagtgcagacagagagaatcgatgagggcttccctgagccatgaaaatgtgaaccccaagctgggttgctgaaggggagagaatagccatttgtaccacagtagcagcagcaggtgcaaaggccctgtggttggaggggcctgggacatccaggggagtgaaaggagaatgaagctacattgcagagaagaagcaccctagcaatgatggagctggaaagccaggtagggcctaaacacacaagtccatgaaagcacctcgatctttaccctgaaaatgatgggatgccactgagacattttaagcaggaggggacttggttggatgagaggctcactgtggttgtgtgtgaaacccagtgtaagggaaatcactgtgccttgtgcaggtgagagatgatggcaggtagtgatggttgagatggaaagaagtagatgaattctagagacagctgggaggaaagaaatgacagttctggttatggttgagacatgagggataaaagaaagatggagttgcaaaggatgtccgacaggtttcaggcttgtggagtgatgcatggctatgcttttcatggggacagggtgccggagctgcaggaactacagcttcccattgtgtgcctgtgccttcctacaagatcgtcctcaaaccctgagcatgttttctgtgtgcttcctttttgcagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtatggtatgatttggtggctccacctgctttggaaggaacatctaacaacacaggcacatttgctgttcctatgggacggacgtcctagtgggagagagagtaagaagtaaatagagccacactacactttgtaatgaataccatgaaggaaatgaatggagtgctgtgtcacaaacaaaaaggcgaccctttcagtctgaggaggtgacacatatactgagacctggatgatgagaaagaactagctatgctttcaaagagctaggaaagaatgttctcagaagagagcaagtgcaaaagttccaaggtggggacaggctgggtgcatcctaggaaccatcagaaggtgttggggcaaaatgtcactagcagaaggaggtataggacgtgatgttgcagagataagcagggcccaaggatgcaaaccttataagctacaatgaggagtttgggtttcactcacagtgcagcggggagccattgaacctttttaagcagattagtgacacgatcggatttgccttttggaaaagatcactctgacagccaagaatggaaacggttcctttcaaacagttgcacagtggaaggatgaccctgggactcatacagtgtttctggacgcttttatagatactgcgagatgctgttttactgaagttgagattgtgttataagtatttctgactcatttagtgttgttttggggtttttagtctctttgcgtgccacaaagatgtctagcataaatctcataccatgaactcaggtgtgcaaaaaatataaatttcttttccatctatgtaacgtaagccaaaaacctgggagttatccctgagcttccctctttcctgtattcccactgttcctggccaccgccccccacagccatgtacaatgcattggcgaattctgacagttccttcaaagtatatcatgtattcactaacttctcttcatctctctaataccacccaaatctaatcattaatatcacctggataactgcagaaactcctcagtggtttctcaatcccaatcttgttacctataattaatcccaatcccaatcttttttacctataattaatcgttacctataattaattgcaatcccaatcttgttacctataattaatcgttacctataattaattgcaatcccaatcttgttacctataattaatttactttctacttcgtagccgtaataattttttaaagcttacattaggtcaaggggctcccctgcttaagaccctccaatgactttccatccaattagaagcaattctatgttacatccttagcttgtatcaccctttatcatctggcccttgttctctgtgtgacttcctttcttctttctcctccccatcacccactgtgctctggccacaacatcagctcttgggtcactgaaacacacaaagctccttcctcccttagaggctttgtgattcagctccttttgctgtttgcaaggccggctgcttcctgcaattcacatctcaacttagacgccacttcttctgaaaaatcttccccaactacccactgaaaagttgccgctcattcactgtccattatgtttaactctctcatggcacccatcactgagcaatgcttttcttgtgtccttgttgattttttctctcttccctttctaaggtctaagctccacaagagtagggatcttctccgtcgtggtcgccactgtgatttcagagcctagggatggaattcattcagtgcccagattgaatgcgtggattctctctgtctgtgggtggcaagggcatccactgagatggactaagggatctgaaatgatggctcaaagtctgaagagcttcagcatgggatgggaatagagagtaagggcagccagtaagatggcccatccagtccctaaggttgggaataggcagttggcagtggtccacaacgttgtatggtttttaccagcagctctgagtatccctggggtggagatggagaaggagatggtggatttgaactaagcgtgggattagtagaatcagtgaactagaagattatggaagaaagagagttaaggattctgggaagagagatgtccactgcagatccacagagcctgtaccaagtgctcaagaaaagcatgttgaatacatgaatgaaaatggtatctagattgggttggggaagatgtctagcataaagagggtcatcacctgggtgggaaaaagggagtttagaagtctaaggatgaaaaaaaaatagatgaggtcaagatacgtaaaatgttaggaagaattgaggcattgagatttcaaacatggagcagtttctctgatgatgaggaagaaagtggcctaaataaagaagaggttctaataagctgagtttttacaaattaaatgagcactttttttttctttttgagatagagtctcactctcttgtccaggctggaatgtagtggtgcattacggttcactgcagcctcgacatgctggactcaagcagtccagctcctacccaagttcacatctttctctgacccccaaataactgcatgcaccaccatgcctggctaatttttgtttttgtttttttgaatcagaatcttactctgttgcccaggctggagtgcaatggcgccatctcggctcactgcaacctctacctccagggttcaagtgattctcctgcctcagtctcgcgctcggctaatttttgtagtttttaatagagacagggtttcaccatgttgaccaggctggtcttgaactcctgacctcatgtgatccgttcgcctcggcctcctaaagtgctgggattacagacatgagccaccgcacctgacctaatttttgtatttttttgtagagacatggtctcactatgtttcccaggctgctcaagtacttataagctcaagcaatcatcctgccgtggcctcagaaagtgctaggattacaggtgtgagccaccgcacctgtcctaaattatatatatatatgctttcttttttccttttttttttttttttttgagacggtgtttctctcttgttgcccaggctggagtgcaatggcacaatctcagctcaccgcaacctccgcctcccaggttcaagtgattctcctgcctcagccttttcgagtggctggcattacaggcacgcgccaccacgcccagctaattttccacttttagtagagacggggtttctccatgttggtcaggctggtcttgaactcctgacctcaggtgatctgcctgcctcagcctcccaaagtgctgggattacaggtgtgagccaccacgcccggccatgatattcttaataagcaatgcattcacatgattcatcattaagattatattaaaaggataaacactgagaagtcctgctcctacccaagttcacgtctttctctgaccacttactgctactgctttccctatgtgaacacttttattcagttaatttgcgtctttccagtccccctgagctaatttaacattttttattcttgtccttattaactcaaaagttcatgtactacgcctgtttttgatcacttaacaaaacagacgagaggatgtttgatggaggattggaagttctggagagtcccatggaaaggattggggttggggggtagtgggtggagtcgtaggagaatgaatcactggggagcaatgagagaatagatcatatgtctccatggaaactgttataataattgagaactctgttccagactggagatatagcatcagataaatcatagatgaaaacaacagtaagtcatgaaagcaaagtagaataacaaacacctctatgatcctttaaaacagagtaatcctttgcaactctagtgttgccaactagggttgtaaattaatgcaggttttatatttgaattccaactttgaacattttgcagtctggttaggtatatagatcaatctccataaacagaagaacacagctgcagtgatttgctcttccccttcgaaagatgaaagtgatggggctttggggtaatctgtttccacctcccttaacccaggaaaacaaaacaaaacaaaacaaaacatgtttttaaaccctaatggccaggtgcggtggtttgcgcctgtaatcccagcactttgggaggccaaggtgggcagatcacaaagtcaggagttcgaggccagcctggccaatatggtgaaaccctgtctctactaaaaatacaaaaattagccgggcatggtggcaggcgcctgtattcccagctactcaggaggctgaggcaggagaatcgcttgaaccgaggaggcggaggttgcagtgagccgagatcgtgccactgcactccagcctgggtgacagagcaagacactgtctcaaacaacaacaacaacaacagccccactaataatttgtggggcaactagggaatggcacaagccttttggtaagccctgtaaaaatgaaacaaggcaggaagcaatggtgaaggacattgaatttcaaatgtgtaagcccgtttcaaaatctttcaaaagaagaaaactgtggagagtttgtttttttaaacaggcagaagtgtttacctggaagggctatcttaccaaagcagggcctgttggcatggctggcttactcggaggtagatgccttctaggacttttaatacagagcattcaaacgtgtcattcacgtttaaaaattattttatttctcaacttttattttagatacagagggtacatgcgcaggtttgtcacatgggtatattgtacccaggtagtgagcatagtacccaataggtggtttttcatttagtgcttaatggtgcttagaattttatccttaactgtctgtttttataatgccttgaaactttgagttttgccaacgtctttcaagaattgaactttgaatgattgctggagtcaaaattatgctgcatatatataaattgggcagatttgtaccgtccggattgatgatacaagcttaccttataaagtaaatacagcaaatacttgatcaagtatatacacagcacaaggataactctttatattataaacgtgattcctctaaccctaatgtgctgccataataaacatgcattaaatatttaatgaatgctaatactgtgtgtcttctgagatttcatatgtgctcatggtaatgatttgtatgatccacgtctttaaaaaatagtatgcaggaaagtttgaatggaggctttcttgttctcttatacccctgactcttgcctatggatggaactgagctaatgtacgtgagttgagatgggatcagggggttagaaaggagctgggggaggcagctggtgtgctatagtggacatagatctataaccataaagaagctgaaagaagcttcagcacagaagatctatgtaaaaatggtatttactggaaaacagaaatagcccaaatggtatattcataataaatacaaaaaaaaacgaagtgactctctcctctctctttctgtccctctctcatgcacgtgcatctatctatctatctatctatctatccatctgtctatctaatctatcatctatctacctatcatctttctgttatctatctacccatcatctatctatcatctatcatctatatctatcatctgtttatcatctatcatctatttacctattatctgtctatcttattatctatcatctgtctacgtatcatcaatcaatcaatcatctatctgtcgtcatagaaagattttcataacatatcaaataaaaataaaagcaaattatggaacattatgattggcaatataaaatgtgtatagaccaattccttttatgtaatatactcatggtccctgctttcattaaactttttcttcaacatttcattatgaaaatttaaaaaatggaaaagttgaaatgattgcataatgaacatctataacacccaccacctggattccacaagtaacatttgactgtatttgctttatcatgtatccatctgtctatccgtccatcaacgcttttttaatgcatttcaaagcaagttgcagacatccatacactttacatttgcagataactgcaaatgcactttacattcagcatgtataccatttaaccagaattcaatatttgcaatgattattttaaaggtaaaattacacacactgaaatgcagctatcttaagtatatcattctatgagttttgaaaaacgcatagtttttaaaatgcagtggaggtatacacattcatttaaaaaatcacacaggcatgaaagcaactgtgatgtttagtatgttccatgggcacctgcgggagtgggatttgccctggttgaagccagagaagtcttctgtgagaaagtggctcgagctatagctaaaggacgagttaagttaactatgcaaagaggggaaatagtaaatgaaaatctcagaatgtctctttgttcctggcccccacccccaaaataggcttggttaatctgtgtggctgacagggcacctaaacttttattagggtagattcatctgctgtaacaaatagacccccaaatatatactggctcagacacaatagaagtttaaaattttcattaaacttctaagtttaagacgtttaagacaggcgcgcctggccacacccactctctccatatggtgattggggacaaggtgtctttcgtcctgtatggctccattaatccctagagctttgtttttctctgcagtcagagggtggaggaggcacaagctgcttcttaaaagtctcagcttgggaagtggcaccaatcatttctgcctactctctattagagaaaatatagccacgtggccacacttcagtgcaaaggaggccgggagaacaatttgggtggatgacacgtcgtctcagccacattccctacttttcagtcctggctgcaatttttcacggtgacacacaaaagaccttctgacttttccctttagagctcttgatgtatcacactccacacacaaaaaacttcaagtgcctcttttctgtgacatttctttgtgttcaaatcatggagcacgccaggtgttagtggtgactttcttgaagctagcacgagccaggaataagtcaagtaggaagaagtcagcagcttatgaaattaaaaagaaaaagtgaagttactatagaaactaggtgcccaggtatcacattttttctcttttaaaaatcccatccagctctgttgctgtctatgaatctaagatgatctaaaatcagaagcagagaggtgagagacagaaccattaagcttccccatctagtgcttgacttccctaaaataatcccaggacactgaaccaatgacattaaatgcctgggtgtatcactaaggaggctgtggagggtctggtggtggccccttccactagggtacccctagaaacttggcatttgtgtgacactctccaagatgctggcatcaacttttgtagctcaaaattcagaccgtacaacagagttgactatagtcttggccaagttttccaaatattagtcatttatgcacctgttatgggtttttccttgccattacatgcctcctttattcgatcatatttttctttaaagtgactttaacttgacttccttttcttcttcttaacattgccctaagcaataatatatgtgaaatcacaagtttgatgtaccagttatacatttattttaatgtgtttggtttgatataccagttatatatttattttaatgtgttttaggaaaatatattaaaagaagagtaattttgttcttgtactagtacctgaaccacatttggtgaaaaactgtcataaaatcttacacttacacaatgtaagattgaggtgatttggcagctcgattaccatggtatttctaagaatgtaaagtcttttgttacaattcgtgtgcgtacctggaagttacaaaaagtctctgttcatccccctcctccatatcctttccttcaaataaggaatatgcgcaacactgcctgtatccttaaaaatctttcgtgtgatcttgacctccctctaccctcctttactcactaaatatatccagacagcaaagctactctttggagattttctaccttcatttcctccccacccactccttccttatccttttgtattatgtctcctccccttagcaactttcagaaacatctgtctcccaggttatcagcagtcttgtaactcatatctctccagatctgagcatgaggcatcctggcttgctcaggggagtagggcaggcatgaggggaagggaactggaaataagattggaatccatacattattctgggcagaagtcatcacctttacagtaacttcccactgaaaggcataactaaggattcattcattcaagaagtatttattgagcatctactatatgccaggtacccttgtaggtacagaggcaatgtctatgaacaaaacaaacaaatatatctgcctgccctcatgaaacttatattctagtggtagtgatggtgacgacgaagatgatgataacacctaacattttttgggtccttactatgtgccaggctctgttataagtgcttagtatgtattcattagctcacacttactctatgatgcagctactgttgtccccattttacagatgaggagagtgagatgcagaaagttggaataacttgctgaagtcacacagctagtaaatggcattaaacagatcagctttgatttagatgtgtatgatttggggctttttttttttttttttttttcttctagagacagggtctcactctgtcacccaggctggagggcagtggtgcaatcatagctcactgcagccacgaactccttggctcaagtgatctgcctgcctcagcctcccaaagtgctggcattacaggcatgagccactgtgaccagctgattttgggatcttgattgcttgaaacttaacatgtaatttcctagttttaacagcgattccgtggaatgtcacaaacatattctaggaggttagtcatttttccctcttattttctcatctttccctctaagtgctaagcagagtttatggccaggtgcagtggctcacacctttaatctcagtgctttgggaggccaaggcaggaggatcacttgaacccaggagatggagcaacaaagggagaccccatctctataaaagcaaaaaacaaaaaaaaattgcatgccttattttcagtgtaagttgctgccattagacaaaccacatactcctagtgatggagggctctgggttttctgttcatcctcatcactctgtgcttattggctacctgtccatgtgtaaataacacatgtgccctgtgctcattggaaccgtgagtcatccgcagggattcctaagagggcccatgagaatggctttcactcctccagcctctgcccttctgacctcctccacaggcttcagccttatgggagtccccaagtcttggaagcatctctagtgagtgcagtgactccttagctggttccttttcaaccttcaacctccattttcttaacccttaccaactctactgcccagctgcacccactccaattccactcacaccctgcccattatcgccaacgtttctgagctcatgctcattgacaaggaccatgccatggatttgcatgcattatatcatattaattcacaccataatcctgcaaggtagtcactgataatcactctattatatcatatagaaattgtaaggcagagaggttaagtgacttctccaagaaggaggcgggaccttgaaagctggttttgtgatttcagttgcctcttgccatctcttctccactttggggtccacacatcttcccaaacccctagtttaaattttttttttttttttgacaagagtctcactctgtcacccaggctggagtgcagtgacgtgaccatggttcgctgcagcttcaacctcccaggctcaagcaatcctcccatctcagtctcccaagtagctgggactacaggcacatgccaccacacccagctaatttttttattgtttttgtagagacagggtcccactttgttgcccaggctggtctcgaactcctgggctcagggaatcctcctgccttgacctctcaaagtgctaggattataggagtgaaccaccatgcccagtccaaaccactactctttcctcttccttttttcctttctttcttccttccttccctttctctctttttgacttttttgaaacagcagttacaaaacgattacaagagctacctaatgaggccaggtgtggtggctcatggctataatcccagagcctctagaggccaagcctggaggattgcttgagctcaggagttcaagaccagcccagcctgagcaacatagcaagacctgatctctaaaaatgtgtttaaaaattagccagacacagctggatgcagtgggtcatacctgtaattgcagcactttgggaggctgaggcaggcagatcacgaggtcaggagtttgagaccagcctggccaacatagtgaaaccccatctctactaaaaatacaaataaaaattagccgggcgtggtggcgcatgcctgtaatcccagctactcaagaggctgaggcaggagaatcacctgaacctgggagtcagaggttgcagtgagtcgagatcatgtcactgcactccagcctgggcgacagagcgagactccgtctcaaaggaaaaaaaaaaaagccagacacactggcacacagttgtagtcctagctactctggaggctggggcaggaagagaggttgagcccaggagttcgaggctgaagtggctatgattacaccattgcactccagcctggacagcagagggacaccctgtctcttatatatttagaaagctgcataatgacatttgtgggtttctccttcttccatgaaaaaaaaagcaaaaaatggtatctcatgactgcattggtatgaagacaaatatattaatattacatattaaaacatgtacttccacctaggttcacttttttccttgtgatttaaaaaaaaaaattaaagtgccttatgaaccttgaaaacagcatgggccctgagcactgtgcctggtgggttttgatggagaagtcagccctatgttccagctccagcatctcaatagcacctccctctgcagcctccaaacttttcttcccaaaggccagggtgcttaactaccatgctctgtgagcatgagagagcattccagagttccaggccccagacctcagtgtcccttttttttttttttttttttcctttttgagacagagtcttgctctgttgcccaggctggagtgcagtggggtgatcttgagtcactgcacctcccaggttcaagcaattctcctgcctcagcctcccgagtggctgggattacaaacgcctgccaccacgcccaagtaatttttatgtttttaatagagacagggtttcaccatgttggccaggctggtctcgaactcctggcctcaagtgatccgcctgcctcagcctcccaaagtgatgggattacaggcttgagccaccacacctggcctcacagcatcatctgctggagccaagcccggcaccagattttaacaggaagaaattgcctgaggagattaaaaggcagcttagttcatgccaggaacaaaggccttctctaaagtctgagcttctgttgtgggagtctctactaattttaatctcattagtggtatgtattcacacacagacatatacatacatacattagatgtggttatataatcctacagacaaaagcacttccctgtacttcagcctgctttgctatcttcctgcaccatatggtgagttcctttatcatatggttcacagatagctcaaagtgtttgctacctgtttccttaatcctcttccagagaacctttttgacatttgctgtctgatcttggattcctgccttctctttggttctatcgcaattatgtcacttccctgcccccaccaagccttcaacctttccttctttcatatgcaattctgattgcagcgtgtttttttttttttttttgccaactcatcttcccagatcctcgtgaggcccttcttccaccttcccgaattttccaggtctctcctcaatgaagtgacttactgctcttccgcagcctctgccttcaattctcagaaggtagtatgttacaagacaagataaggttcatttttctcaagaaaataaattatatcaaggaaaatgaaatgtcaggaatttaagttttacaaccttccatctgctgcaagtagattgtcaagccagagtgagtaaagcgggtatttgctgagaagacatggcttgtttctgtgtatctcaagacacccagaggcaagaagtgccacctgaatgagagagcttccagcagtctgataaccatggctccatctggggggttgtaggggggcccccagcctgtcatccctgcttctcgatgacatctctctgcagatacgcatcagcaccacctctctcagccttgttgatgcttctcaagtctccatgtctaattctcacatgtagaatatcctaggaatctaaaatcccgggaaagaaaaactgatgggccagtgtggaccagggatccctaggatccaattcactgtgaccggggaagcggttacttttccaaccatccatcaggaaagatgacaagaaaagcaaataggatgtgggcagttttcctatgagaaagaagaaaacgacgggcctgtctggcacacaggccaaagtgggagtttcctttaaatgtgtattattttttattttaatttttttattttgtttatttatttatttttgagatggagtctcactctgtcgcccaggctggattgcagtagcatgatctcggctcactgcaacctccacctcctgggttcaagcgattctccttcctcagcttcccgagtagctgggattatatgcgcatgccaccatgcccggctaattttttttttttttttgtatttttagtagagacggggtttcaccatgttggccaggctagtcttgaactcctgacctcaaatgatccatctgccttggcctcccaaagtgctgggattacaggtgtgagccactgtgcctggccttttattttaattttttagagacagcatctggctttgttgcctaggctggagtgcagtggcatgatcttagctcactgcagccccgaactcctgggctcaagcgatcctcctgcctcagcctcccgactagctgggactacaagtgcatgccatcgtgcctggctcatttttgttttttttctagagatgggatctcattatgtagaccaggctggtcttaaacttctggccaccagcgatcctcctgcctcagcctcccaaagcagtgggattacaagtgtgagtcacgtcgctgggccctgtgttttctctaaaatgttgcctgattctttgggaaaaatatcgcaaagataaatcaagtcctcttgtagaaggaccagatagagcccattaacatggaaactctgtctcaggtgatcattcatggctactggtccaattattgtgctatcatggtacctgccatcctctgcatatccatctcaactttatctctatgtattatttcagaaatttacagtcctggtaaaatgaatccctggttactaacagcataacccataatcttttctataatacaacaaacataatggcagaaatttgtggattgtaatcatccaacacccatgataaatattttggatgtacaaatgtggatggtacctatgattattcatgccgtagttgtttcaaacccccaccccaccccacagtttcaccttatgtactgacctcattgaacaccactgcggagattgataacatttttggagcactgggaactcatctgagtgttttataggcattgctcatttaatcttcaccatgggtcttgtgaagtgggtgctgttattatctgcatttttaaatctgtagataaagagacagagtctctattttgcagatgagggaatagaggctcagagaggtgagaagcttgcagtcctgaagcggtggaggcaggttcaaaccagggagcctggctgcagaatgtgttgccactcagctccatagtccccttgcatccagtgccccctactcctgctgtgctgaaacccgttctctattagcagtgctctgtaactccaacaacaaaggggggcagtgcttacaaggcagatcagattataaacaagctttcttcctgccacctaattgttgccatgaatgacaggactttaagggtttcatttcattctctttcagtagaagccatcaattattagtttattttcccagcaaccatttaaaaaagagtcaaattaaatctgcttttattttaactatccagctttgtcaaatataacataggattcaaagaaatttgactaagccatatatgtcaccaatgtttattttatttatgtatttttttttggcatttctgttcttttgtgagtgtgagtggtgagaacacttgggatctcctcccttagcatatttcaagtatataacacagtattattaactgaattaccatgccataccttttaaattgctagtacttatttatcttgtaactgaaagtttgtaccctttaatcaacatctccccattttctctactcccagcccctagcaaccaccattctgctctctgtttctttaagtttgactattttagattccacatatgtgagatcatacagtatttgtctttttttttttttttttttttttttgagacacagtcttgctctgtctcccaggctagagtgcaatggcacaatctcggctcactgcaacctcacctcccaggctcaagcgattcttctgcctcagcctcctgagtagctgagattacaggcatgcaccactatgcccggctaaattttatatttttagtagagacagggtttcaccatgttgaccaggctggtctcaaacccctgacctgaggtgatccacctgtctcagcctccccaagtgctgggattacaggcgtgagccaccgtgcctggccccagtatttgtcttttggtgtctggcttattttgcttaggataaggataaggtgctccaagttcatgaacatttatttcagctcaaaagaaccgttcagttactggaattgatcaatatcaattctattggtaaaaatcaattctactggtatcaacaattagacgacacagcccagagtgtgaaaatagtagttctctcgcatttcttgttacaacccaattagacatttcttattagacccaaccacacatcctcatttaaataccagggccaggtatttcaggtttcaatctccttgttccactcctcccctttctagcagtcactgtgagtcatcccttctaggggtgtagtgacatttgcttaacaatagcaagtccacagaaaccagagatgactgggctaaatgcaccttcattctaaacttcgtttcacactttcatggctttctcagctagtgggcaaaaatgctacttgattaaattacaggtgtggcatggcctcattttaaaaggttgaaatcttaatgcaacctgtcaatctgacctctgaaatgaaaaattagcttatctatcacacagatccatgcttttatcatctataaagagatttttaaatacagaaaaccttacgtaataaatcaagaaatagccaagttgtatcatccgagttgatctatacgccggatatcactgctcttcttttcatctggccaacgtgaagactgtattcgaaaagtgctgcagtcctacctacatccacactattaattcccaagcatcttctccccattatatcactttccagtttttcctgaggtacgtcttcacttggcagagtctacccagttgccttctcctaaacagactgttagaagtctgaaatcatttttagactgctggcttcctctttactgctagaggcaagtgcatttgattccttcaaaccacatgacttcgcatcagactgatgtggccactgtcaaatgtaacatttaaacatatgtttgtgtggacatatgtgtttggaacatttcatccgaagtctgacgcttaagaatacactttggaaaatcagaattagggccttcaagataaactagaatgtgataggacatcttcatttctggtcaaagttggaagtttaggagagcctcaaaagtgaagaattcgccaacaaccatggtgaatgcagtgtactgagttcttgtaaccacccggtgggatcttcttgcctgctccccagatagagccgatttctcaagaggggaattataatagggaaagagctttacacacaaagactcaaatcagcctccatgaatatttggaggctagaatttttccaagatagtttggcagggagaggaggtggctagggaatgggtgctgctgattggttggagatgcagtcataggggtgtggaaaatggtccttatgctctgtatccacttctgggtggggtcgcaggactggcttatgggttcacgtcggggctgtccagtagtcagaaagggaaaagactgaaagacatctcaaaaggccaatctgcagttctacaacagtgatgttatctgtgggagtaattgggaaagttgcaagtcttgtgacttctggaataatggctagtaatcctttatgtctacaccttagccgaattcaggctcctttcatcctcctaacttggcagtctttcattagttttacaaaggcagtttagtttgggggaagggctgttaccatgtaaactatacactaaatgtttcccaaatttagcttggcccaagtccagaaatgactaagggcagtttggaagtcaaaagcaagatgaggattggttagatcagatctcttccactgtcatcatttagttataatttttgcaaaggcgatttcattctttgctatatgttaagctgttaacatgccttatgtcatgaaatcatcatcatggccctactaactcttgttaatggactcttgtctatattttaccctgatatccaacctgctgtgagacctcttgcttttgtttgtttgtttttattttttgttttttgagacagagtctccctctgttgcccaggctggagtgcagaggtgagatctcgggtcactgcaacgtccacctcccaggttcaagtgattctcctgcctcagcctcccaagtagctgggattgcaagcatgcaccaccatgcctggctaatttttgtattttttagtagagacggggtttcaccatgttgacaaggctggtctcgaactcctggtctcaagtgatccacctgcctcagcctcccaaagtgctgggattacaggcgtgagccactgtgcccggccaagacctcctgtttggaatggctttcccctccattccaggcctctggttatcagagatgaggtagcttaagcccttcagtgcttaatccctggcccaggcagaaggagggctttggcaaatccgcatgctagaaaagatgagtttggaagggcctggaaaccagggtacatagttccttttcccttgagattttagaagttgacagacggtttgctggttttgtagggaaatcctatctgccacagagcatgtggattacccagggaggatcctggaggtcacgtgcccagtaccacctctaagcacagacagtatgaccttgcctttcactctgggctttgtgtaaggatctcccaggacatagatttcatagcgacattggtcgattgctctgattcactttctgcctttctctttcttgcatatggagaatgtgggaaagaatcccctatacacacccacaggagttagaacatccttcttatcctccataatcgtgccttcaaattaataattatggcttgctgtgtgttgggccctgagcttaacctgcattatgtcacttgatctcacaacaaccttctgagggagaaactgtcattattccccttttatggattggggaactgagactcagagaggttgagtaactcagccaagaacacacagcaaaccatatgatagagtcaggatttgagctcatgattccaaagtctgaacttgaaccttctatgactataattctaattagatataagcttccagatcatcagactctgtcgatgccataatctctttcttacatggcagagatggtcaggatacctgccacgtggtaaagacgtggatgcagaagttaacctccatttgattagcttcggtgcaccaagctgcacccaggtttctctcgaaatcctgctcctgagtgggtgagtgccccgggaagagcaggtggttggcgtttgctcagttttccagcccctgatcaccctgatggcctctagccagcttttctctctgtcctcctccagtgagggccaggcctggcacaggcagcctcccaatgtttagaaggttccgatttaattggtctagagtgtggcccaagcatcggcttctaaaacctccacagggagttctaatatgcagcagggagaagcagcagctcagtgcagcaggcaaggctcgtccacggaagggctgggggaaggaaggagatcatatttgccttaaaacttggagttgagctcatctgacctaccctctgcaggtcttcagggggactgggaagaatccatgcaggagatagccccagagatcaaggggatcctcaaagagatgggatcttaagatagagggagggtacactccttgcaacagatcagcaccctgaccctgtacccagcctcgtccacaaacctgctccctagtgctgggcatgggatacagagctaggggtcgtgtggtcccccggaggcctacagtatatacacatgagctgtaacttgcttgtctgtccctccccaagttgacctcagtttatcacaccttactgatgctcttctgccaatttagtgtttgaggaccctgtgagccctaaaggtctctttctcttattttattattttattttattatttcatttatttattttgagatggagtctcactctgtcatccagtctggtgtgcagtggcatgatctcggctcactgcaacctccacctccttggttcaagcgagtctcctgcctcagcctcccaagtagctgggattacagatgtgcaccaccacacctggctaatttttgtacttttagtagagacggggtttcaccatgttggccaggctgttcttgaactcctaacctcagatgatccacctgccgtggcctccaaggtgctgggactacaggcatgagtcaccgtgcccggccgagataggatcttaagacagagggagggtatagtccttgcaacagatgagtaccctgatcctatacccagtgtcatccacaagcctgctccctagcagggatgggagagggagctagggagggaggggcatgggagagggaactagggatcgtgtgatcccctggaggcctacagtatatacacatgagctgtaacttgcttgtctgtccctccccaagttgacctcagctcaccacaccttactgtgttgaggtataatttacagaagactcacttgtttgtttcatgtaatcttgaatgatgctcttctcccaatttagtgtgtggggacctaagagccctaaaggtctctttgtctattttagatgcaccatctgaattcaagttagaatcttttcccaatcactgtttgttagtcaagcttgcagactgtgacagtgctagatgttttggtctcttcttccttgcctcctcctcctccttttctgattctgttgcagggatgttattaagaacaccatccacagcacagtgtgttcaaacatccatgcaaaacatttctcttagacctaagttctagagaaagcttatttttctcctcaaaaaacgattttcattatagaaaatatgaattttgttatgttgcatatatttctgattgctttggtttccaggaagcagaaagagaaagtaggagagagagaaagagagagagagaaagagagagactgagaagaaaagagggagagaaaaaaaagaaaagagaacgaaggagagagggagatggcaaaggagggaaagagagagtatatatctataaagtatatatgcatacatgtacacatacacgtgtatttactatattctttttttctttttgagaccgagtctcactctgtcacccaggctggagtgcagtggcatgatgatctctcggctcactgcaacctccacctctcgggttcaagtgatactcctgcctcagcctcccaagtaactgggattacaggcgtgtgctatcatgcccagctaattcttttgtatttttagttgagacagggtttcaccatgttggccaggctggtctcgaaatcctgacctcaagtgatccaccctccttggcctcccaaagtgccgggattacaggcatgagccaccaagcccggccactacattcatttttaaccacctgtgttgaggtataatttacagaagattcacttgtttgtttcatgtaatcttgaatgatccctcaaattctttgtgaaatatgagttggatggagccttatgtaaattaaacaatgctgacacccaaggaactgaagatctttagtgaccttgatctgggagatttttaaagcaacttctcctactcatgaaatcctttcattcattgattcaacggatatgtattgagtgtcaactgtgtgctagatgttggggacatgacagtgggcagctcaaagaaaatgcctgccctcatggagcttccactcttgtgagggataaaaataaacagatagatattaatataatgcccgtgtggtaagtgctgtcaagaaaaacaaaggaggggaaggggatggaaagtgacaatggggcctatgagtttagagaaggtggtagggagggtgttggtgacagggtcacattggagtgacctgaacaagatgagggagcaaactgttgagtgtccctaggggaagagtcatgcaggcaggaagagcaaaaggcagtgattctgagaggtgagattgagtcccaagtacagtaggaggacagaggaaagccttaggaaggtggagtgacatgaacaaacttaagtttctaaagcatcgttcaggtgtatagagaatagaatggaccaggtgcagtggttcatgcctgtaatccagcactttgggaggccaaggtaggaggatctcctgaggccaggagttccagacaagctggggcaacagagtgagacctaatgtctaccaaaaaagagagaaaaagagaatagaatgtttatgagagcgagaagaggggaagcagaaaacagggtaggagacaactgcaggaaaccaggctaaggatcaaggtggctcagatcagcaaagaggttgaacttagtatatattttgaatgtagagctgacaaatcttgtgattgtactggatgagagatacaggagagaggaactgagggtgactggatttggctttggacttgtggcaagtgtatgttgaagttgagcagttgggaagcaagatcttgggtccctggctgtctctgcccttgcacactagtgtggccatttgcactgctccctcaggacaaagctcccgggccagttgaaaaccggaggttggtgctttgtacaaagctcaccatcagccccctttgttgtttggtgaaaagatgatgttgacgatcaccactgtaatgggtagaattgtgtcctcgtaaacaatgtatgttcaatttctaatgaaggttgcctcacttggacatagggtctttgcagttataagcaagttaagatgtggtcactctggattagggtgggcctgaatccaatggctggtgtcctcataagaagagggatatttggataccgacagaacacacagggaagaataccaggggaagacagaggcagagattggagtgatgcgcttaaaagccagggagtgccaacggtagctggcagccagcaggacctaggagggaggtgtggatggaacagatcctccctcagaatcttcagaaggaaccaaccctgccagcaccttgatttgggacttccagcctccagaactctgaaataataaattccttttgtgtgaagtcactcaggttttggctcttccttttggtcatgctaggaaactagtagaaccaccaggtattaaatatttataatttgccatgcacagtgctaagttaaggtgtgcactaagatactttatcccataaaactctctcagcagcaccaaaagcaaagtattgttggcatctccattttataagatgaggagaagattgaggttcagaaaacagtgaatttctcaaggtcgtacagcttgtatgtggcaaaacttggacacgtaccaggttttctaactctaaaagtccatgccctaaccattatgcaacgctgggccacagtcaggggccgagattccaggcacgctttgccattgggattcgccagtaaagttcatcaccacaaactttccagccaggaatccctgggctactttcctctgttttatttgctgtcatcagagttctgctatttatcacatctctcccagaagattcttgggggaacagatgtggcttggaatttgataagaacgtcacttcaacacatcctttcagtctgtttggaatcctcaccctggagagagagggacagctgaacaaacagcccacgccctctatgttggtattaaagtttctggaagctccagaaactgcttgagacaattaataagagatcatttccatttaaaggaacatttttgaacgtgggcatcaccagccagggcaatggctacttttctgctcttttcctctcccatggcaaaacttcacagcatatggccgggcgcggtggctcatgcctgtaatcccagcactttgggaggctgaggcgggcggatcacgaggtcaggagattgagaccatcctggctaacacgatgaaaccccgtctctactaaaaatacaaaaaattagccgggcatcgtggcgggcgcctgtagtcccagctactcgggaggctgaggcaggagaatggagtgaactcgggaggcggagcttgcagtgagccgagatcgcaccactgcactccagcctgggcaacagaggagactctgtctcaaaaaaaaaaaaaaaacttcacagcatatgtggaggcagaaaggtctgcccaagccacttgatggaagcagggccgtgtttgtcctgcttattgggcacatcaccagtgcctagcatcatgcctagaacaaaattcccaatagagcttgtagacctgatggaagaactggaatcgtgactgcagcatgaatgcacaccaagctcatctcgccaagcaaatgttagtggttgtataagaaatagaaaaaggaaatgactgttctctctgtggctatgtgcaaggtggataggaaaagaggaataggaccaggatctaaaactgaatttaaaatattccagcactgatttgctcaccactgaacacttggcacttagggcttgatgatgggtgtgtttaagggcatggatttaagggacaggtgactaggtgtcacttcctagtggaatacggacgagtcacctagctttgttaagccctcccttcttcatctgtaaaatagggatagcagcagtttccaccttacgtatttactgtgggaattaaataagataatgcatattggaagtaatcagtgggcatgtacatggttattgttataaagtccaaactgtcccaacgttgccctttttttccttggcacaaacactaggcctttgagtatcacaaattctttgtccagccaccctacttggtggctggatctctgtgattctattagagacaattgtctgctacatctcagagagatgggagtcagcatctgcaatttgatttctgaagcttaagtgctcatatccttataggaatcataggccaaggtttgtagatccagatcgtttaatcctaaggaagcactgttcttttccctttggctgaaatatgcctcctgtgtccccgccttgctagtcctattgatacttcaggtgtcagcttaaccatcacttcccgaagagcatcttttgctgacccactcagcgatgttaagtcttccatttaaacactccaagagcaatgtgtacttctgtttcaggggtctcattatgattgatgttaggtagttatttgtacaggagtgtaagcttcatgagggcaggaaccttgtcgttctgcattcctggtgcctatctcagtgtctgacacatcctagaccctaaattaatgttaactgaaagaattgtctagtcttctaggtgctggataaaactaggaaagttgatgcatttggaaggcccaatgaattccatctctgttgcctctctcagttgaagctttaaacaatattgttattattgattgaaaagagcatgcataaccaaacccaaggtggcagggaccactgctgaccaagctgggttgcaaattaaactgcagccatttttgatcatgtggttactcttcttttccctgatccttcttgaaacacttattctaaaacgagggtcagcagactattggaacccaggctactgcttatttttgtaaataaagttttattagaccatagccacactcattcacttgatccagaccgccctgcaaagcctataatatttcctgcttggccctttatagagaaagagggacttgataaatctgttctagttatctattgctatgtagcaagtcattccaaaacatagaagcttaaaacaacagccatcctatattatctgtcatggtttctgtgggtcaggagattgggaatgatcactggttggttgtggcttgaggtttttcctgcactggctggagcacctggggctgcctggtcatcaagcttatcaggtagtaccagggtttcttcatggggtcttgttccctggtctagcattgtgtcttggggtagaaaggaaagaaactgacagaagctacagcctcagaagtcttgcagggtctcttcaccacattctgttcattaaggcagccgcagtgcctgcccaggttcagagactctggctctgattggaggagtatcaaatatttgtagacatgttttaaaacctctataaagtatcacttccttcgtgctatggggacagctctcaaaatgtaactccaagagaggacagagagatttatatcgaaaatgaaagcttgattagaatattaagaagaaaaggaaagttttctctcatcctattaatgactgctgagaaagtgttaggaaaatcaggatggaaggattctgtcagctttacctactgacatctcctagccaccttattaaatgaatcaattttgataatatctggtgattataatcaacataggaagaatatgtttattaaaatgcagactcccaggtcacagcccagagctcctgaaggagagggagtgcttggaatctatatggtaagcaaagaccctcaagtgattctgacataggcaagaggcactgtcctttataaagactggaatttgccttgttttaggtcacatactgacatgatgctacttggcttcatgtattttaattattagtaagaatttgagctacctatgtaataattttgttttagggatctctaagatacataatccattcaaagtaatataaataaaaataactttattggaggaacataaaggtttcaaacagaaaatggctaagcctcatgagagattggaaactgaaagcaaggcctctgcttgttctcttaccttctttgtttttttccccctgcctcaaacatctattttattcctctttgcctgcacagtggtagaaaaggaccacgctaggctgagtgtggtggcttacgcctgtaatcccagcactttgggagacctagatgggcggatcactgaaggtctggagtttgagaacagctggggcaacatggtgaaaccccatttctactaaaaatacaaaaattaaccaggtgtggtggtggacgcctgtaatcccagctacttgggaggttgaggcaagagaattgcttgaactcgggaggaggtgaacgaagatcatgccactgcaccccagcctgggcaacagggtgagaatctgtctcaaaaacgaaaaacagaaaacaaaacaaaacaaaacaaaaaaggaccactctaggaagatctgtgtattctctgttgagggacccaggactgactcctcagagtaccctaattcaaattcttgggagggggaatccgattggcttggctcaggttgaggaacttacctctgatccaatcagctgtgaccagctgtatccactgcccaatcagaaggttcttctaataacacagagttggaagaagtgaaaggcatgctagggttttcatttccaaattaaactgcagtcattttttatcatgtggttactcttattttccctgatcttcttgaaacacttgttgcaaaacaagggtcagcaaactattggagcccaggctattgcttattgttgtaaataaagttttattagactacggccacactcattctcttgatccagaccgtcccgcaaagcctataatatttcctgtttggccctttatagagaaagtgtcctgactcctgctctagaattcagttcgcttctatgtctaaatttttgctatgccttatgcatgcccgttctgttttccgttaatcagtatagggcatgttgttgagggcagggcaagacactgggaatcttcacacacccctgtttattgatttttaaaactatctgtacaaatgcaatagtatctcctacgatgcggagcacatagcattgctgatttgcaagaagatttcaactgctacttgagattgttttaggtgccgtgtagttgcactatgaaataaaattaaatcacgttatgataaggttatttctgtgtctccttttactctttctaattacttgaacaagcaaatctcatttgatgacaatatgctctctaacaactttctaatacaattttttcctttaacaaggagaagatgcagagcctgactcagaaccttcagcagccagcagtatatagctagaatttactggcaccgctttgcttttatttatttttatgcttatcttccatttatgacttgtgatactggcttgccattaatagtggtgatataaagtttccttttcaaatttagttaagttgaaatgtgactagatttttaaaatgctaagcaaataacagtttaggtggcaggaagaaatgtgaaaaaacggatatgaatgattgaagtgcggaaatgcctgagctacagtaactgacatagttacaaagcagccctggtgcccagaggaggtagtggccgatttggtctgaatggaacctccagattagaggaggagataacagcccagtggaatctcagattttcaaagcagtgcaagagcatggaaggacgtcatagacagtgggagtcgaatgttcaaaggaaaagaaagaacaggatgtggtcatggaattgtttggctttcaagagccactgaagggctttcagcattcaagtggcacagtcagagctgcattttcagaacagtcattagctgaagcaagttaatctccctgagcctcagtgtgtttatctacgaaatgggggtaattgacacagatgtaggatgtccacccctgtccctggtgaagggggaaattcccagccattctgccctgtctctcttccatgtggaaggctaagatgtcctatcatgactgcatctgcactgaaggtgtctagggcccctccttctctcgttttggttgggggaatgggagatagttgcagatattcaggattgttggatggtgccttgaccggtggtgatgggtcagggagagtgtattagtccgttttcatgctgctgataaagacatacccgagactgtgtaatttatgaaaaagaggtttaatggacctggggaggcctcaatcatggtggaaggctaaagtcacgtcttacatggtagcagtcaagagagaatgagagctaagcgaaaggggaaaccccttataaaatcatccgatcttgtgagacttattcactaccactagaacagtaggcaggaaaccgctcccatgattcaattatctcccaccaggtccctcccacaacacgtggaaattacgggagctacaattcaagacgagatttgggtggggacacagccaaaccatatcagagggtgtccactgtcaaggacagctcagcaccaagcccttcttactgggctctggagtttctcagctgagaactcttcttctttccatctccaattcctctgctcacttgtcttccagctaagtcacctccctgccccctccctgcacatgtcccggccccagctctctctggaatccaggagcaggaagtccctgtctccacctgactctacatcttaggaaagtgactcccttgagtcattgtttctgtgttagtaagcattgaggaaggaaaatacatcccttgggtaccagggagagaacagagggaggcaagaaataaactgaaggtgcccatcctagcacttggagccctgtcttgccatgcacgtaagcagagggtctgcaggagccactcagactggcagcttttcttttttattgtgctggggaagaaagaggttaaaaagagttctcttgctgtggaagtgtgtgacagggaccctcttcctaaggtgtcccaaatccctgcatctgcctggcctttgtcactgtggctgtgatgagagagaagatggtgaggacaggagataggaatgctgtgagctggcaagctcagctcggaagcttcagtgcatgggtgcatgatctggaagcttctgtgcatgagtttagccagaccttttgctgctgggataagagctgagtggggtgtgcagagctgccttcctgctgctaagcttattctatatgtcaccccttctagcctgagtcctctgttgcatcctctggtcctccagctgagttgagtgtagcatctaatttcctcaatcacctgaactctggccctgattggttcccttaccctcctgagccttaatttcctgcaatatgggattcacaatggcacctacttcctatgatgttatgcaatacaaatgagtaacaataagtgaaaacctggaattgtttggtcagtagaaaagtgctcaaaaatgtaatggtggttagtattgttgcctgcaaaatatctgacacagtgcatgcagtgaatacttcaatctgattctttcttcctccaggaagccttcctagaagtccccaaaccaggttaggactcttcgtaatggggttctgccttgtgcttcctacagggcttcttgagacaatctgctggtcattgttctgtctggcataatcacaaccaaagaatgttcaaagaatattcccccggttgggagagtgggagagggggtgacacgcagaaaataccgatgtgtctgtgagccacactggttaactggccctgaatatgaccacagcacagctcatagaaggaagccccaagacaacaggagaggctgttaaaatattaaattaatcatctctgtaattaatttgcaaaatatttcttcctctctggagttaagggtcagagaacgtgcttgtttctttattgctgtatccccagtgcttagcaggttcttagtgaacattaaatacttgaattaataaaggaacaagtgccctaattttagttttgtcagtcattcactcattctgtcattcaacaaacatttattgaacatgtactatgagccaggagctattgcaggctcttgggttacaccagtaaaccaaaacagcaaagatacttgccctcatggggcttaccttctagctgggcattgacacattgcctgttacctcagagggatcaatatacaatcatctcccctggaaccatcctctcttgattgagttcagctattcaaagtgcgaggtcagggctggatgcagaatcacccctgtaatcttagcactttgggaagccagggcaggtggattgcttgaggccaggataccagcctgggcaacatagtgagaccttgtctctacaaaaaataaaaaataaaaaaattagccggacatggtggcacttacctgtagccctagctacttgggaggctgaggcaggaggatcactgagcccaggatttcgagtccgcagtgagctatgatcatgttactaccctctaggctgcagtgagtcatgatcatgctattgcaatctaggctgggtggcagagcaagaccctgtgtctgaaaatataaaagtgtgaagtcaatagaaaacattacctgttgtttcagagtcaacagaaggcacctatacaaagctaagtgtggctacaaatgaacaccagctgctcataactggcccccagactccttccaactgccctgacatgcttgctctctttcccaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggtaacttgtcccatggccctgggtattccacctccagggcttcaccaggctttggccaaagctatcttagcagcacccagcacagagatacctgcacccttccctttctagacacagaaagatgtaaggcccagggaagtcagctgagagttctgaggttgctactgagaaacgctctcccctgagacagatgctgtctcaacttagataaaggaattcaggcaactggttttataattaacagagcagggcctttctctgacagcaaggagtgacttggggacaggagctgggtgaaaaggttcacagcttgtggatctagatggttccattcagccctctagacctttggataaatgcacaagtacatctctgcaggttgcctgaggcctttgcatgggcctcattggagggaggatgttgcctgagaacacagccctcgaggactctcagggaaggtacacagtgtcctgggaaggagctagtgagttcagagccatggctgccaaggtgagaagggagcacttgtccatttgtccattttctgctcttgactgtgatttcaaccctatctgcaagagcaagagtccctgctttaagtaacctcttacctttccctgttcaaattagaccttggtttccatacccagggatggagaggccagagcccaaatgcaaaggggtacaaagttaattgatgccttttaggattctcagggccaatgacctggtgacttaagatgttttggggacttttcaagattaattttgactctatccagttctcaacttactgagtagagtgactgattttagagcccaacccatatatgagatgggacactacagtactttgcatctaatttgatgtctttagtgatttccctctcactttaattcttttcttttatctgttctattatctgctgaagatatcctgggctgtgtgacctgtagcattttcacagtctggatttcactgactgtacggtcttggggcacctcaacatgtttcctctgtcttctgtatttcgtgcaattggcagctggttctggaggcttggtcagactcagctaggatctctttggcaagaccatagatggtgacctgttctttcatctgaagtcgtataatggcttgttgtctctcatagtgaagttggcagcgactgatggttggtgcctagatctgttaactcattagggattgtaaaatggtgatatcctaattctatcatttatttttcatttactagtgagaatgcctttataaagaagggcctcccttcacctattacttagttccctagtggtatagttcctgtgagaaaggcaggataaatgcttgattctttctctttatttaatagttctcaagataataaattggttcactgttgtgctccaagggtggctaaagttggcttttttttttctaaatgggtctggctctgtctccccagctagagtgcagtggcatgatcatggctgactgcagcctcgatctcccatgctcaagtgatcttcccacctcaacctccctagtagctaggactacaggcacacaccaccacgcccagctaatttttgaacttttagtagagaccgggtttcaccatgttgtccaggctggtcttgaactcctggactcaagtgattcacctgcttcggcctcccaaggtgctgggattacaggcatgagtcaccatgcccggccaaagttggcttttaaaataaactgttttgagtggaagaagagacaatagaaagaaaaatattaagtgaatgataatttacatcatgcaatggagacttggcaaagaccaggaaaggggtacacctaaccttactagtccaaatctctagtcttaccatggggatttaaggcctaaaggtgttcaagtggtgatagagacaaggctgggatttaaacctctaggctcccctactcccttaccttctcccttttccattggttatccccagatggattcattgacatcatcaggcaaaggacagtctccgtccagtaaatcaactaagtaagaaagggaccttgtgcccagcatagaggctgagcagcagcagttttccattttagttggatatgttgagagtgggagaaatgaatcatgggtgactaatgttcattgtagtgtctttgtggtttattattttaaaaatgattaaatagagtagatttgagattattcttttaatattgaaccaacctactcacctatatttcaatatgctttctggaattagagagtaggggctgggtgtacatggaaattttgcagaagtctgggtcccctccagggattgtcatgtgccagggaagagagactgagaaccaggagagcctagaacacaagagcccagtgggtttgggtcttgcatggtgacatgatttggctgtgtccccacccaaatctcatcttgaattgtagttcccataatccccatatgtcgtgggagggaccaagtgggaggtaattgaatcatgggggcggttacctccatgctagttatgatagtgagtgaattctcacaagatctgatggtttaagagggacttttaccccacttcgctctgcacttctccttgctgctgccacgtgaagaaagacacgtgtgcttccctttctgccatgattgtaagtttcctgaggcctctctagccatgctgaactccgagtcaattaaacccctttcctttataaattatcccatctcaggtatgtctaatggactaatgagaatggactaatacacatgggaatgaaggcctcccatgttggagaccaatgcaagtaattgaatcgtgggggcagtcacctccatgctagtcatgagagtgagtgaattctcacgagatctgatggttttatgagggacttttaccccatttcgctctgcacttctccttgctggtgccatgtgaaggacacgtttgcttccccttctgccgtgattctaagtttcctgaggcctctctagccgtgctgaactccaagtcaattaaacccctttcctttataaattaccgagtctcaggtatgtctaatggactaatgagaatggactaatacacatgggaatgaaggccttcccatgtggagaccaatgcagaatctccccaaccgacaagtccaaggatggaacagattgctttctcagttgttgagggtctgatgaagtctttaacctatctctagggattgtatcgattgaaagaaaaaagtgcttggagagacgcactcactgcaagcaagagaccctgagatgccaagtgcagttggctgaaggaagagcagatccccttccatctcacctgcactctgcgcatatgctcattgagtgaaatgctccaatttaaattattttttctcacttctttgtgggctaagcacatatattttaatgttgcataaattaaatttattttcaaagacttataataatgcctactatatgtgaggcacaaggcaaacaattttaagtctcttgacaacttagataggttctgtcatcattcccattgtgtagaccaggggactgaggccacacagctagtacatttcagggccaggatttgaacccaggcagtctggctttaaggagttttgcatttaattgctatgctctgagatctttttaaaaaaacatgtatatgtataagtatatgtatatgtatatgtatatgtatatgtatatgtatatgtatatgtatatgtgtgtgtatgtgtgtgtgtgtgtatgtgtatgtgtgtgtatgtgtatgtgtgtgtatatgtataagtatatgtatttttagagacagggtcttgctctgtggcccaggcttgagtgcagtgaaacaatcatagctcactgcagccttgggctcctgggctcaatagatcctcctgcctcggcctccctagtagctaggactacaagcatgcatcaccacgcccagttaatatttaaaaatattttgtagaaacagggtcttgctatgttacctaggctggtctcaatcttctaggctcaagcaatcctcttacctcggcctcccaaagtgctgggattacaagtatgagccaccacacccagcctgaagtcttttgagtgtggatcacccaaagaccactccacctgacacccctgggttagaatccctcctgcaggcctgtctccaggctccaccaggagcctgtgctctaatctagccatggtcacctctcacctgttcagtgaagccacactacctccacctcttagcttccctatctctgcataaaacttgatgttccatctgagcctctaccatgcatgggtcttcaacaacgttgcttcattccagcctcacaaaaatcttgcagtgaaagggattatctactctcccattttgcaggtgaaaggattgagaatcagggctgcatggtagttcttcctcgacacagcactgggtcattggctcattgagctcagagcccaagcttttgttagtacatcatgttgagttgccaccaaaatggccttgacaatgatgatacaaacaagaacaaaaagcagcagctaacagtaataggttgggcactctactcagcactctagctgtattatctcattttatcctcctgatacctctattggaaaggtactattactaactttaatttacagacaagaatgctgacattcagagaagttaagtaactggtgcactgtcacacagctgctaagtagtggagctaagatttgctctgcaagactctagaaccccaaacccggaagcctttgctaacctacctgtgccttaacttcacattcctggttttggcttatagaatattttcactttacagccaggcacagtggctcacacctgtaacaccagcactttgggaggtgtaggcaagtggattgcttgaatccaggaggtcaagaccatcctgggcaacatggcaagatcccatctctacaaaaaattagctaggagtgatgcacgcacccgtagtcccacctacccaggaggctgtggtgggagggtcaactgagcctgggaggtcaaggctgcagtgagccatgattgcatcactgcactccagcctgagctacagactgatactttgtctcaaaaaataaaataaaataaaataaaatataaaatattttcactcttacgatcacatctaatcttcacaaaagcactataagtattatggtccacatttctattcaatggaaactgacccccagaaagatgaaatggctcaagttccacaatcagtaagtggcagttccagggcttgagctcaggttttctaatagccctttgggtgtttttttttttttttttttttaatactatggaagttactccgcttatcctacagggatattgcaaggattagataagattttatccatgggaatgattattaaaatttagggagcactgcatatacatgaggcaagccattgttatcatgactaaaatgagcaggaaggtgacacctctttctggggatgtccttgaaaatggtcatctggctcctgctcattttctagcattgcatggcctggatctgcagagcagggcttcagaggaggcagtggagctggaataggccatatccctaaaagggcattactgcctgtatacagagggtattactgcctgtatgctgcctgtatacagagggtactaatgcttattgattatttcaacaaagacttattcattgaaataattgtatcaggccccattgcatcaccatgatgaggtacaaaacagataaagtccctgtttctttggaatttacattctcttgggggagactgataataaactataataatgacacaaagtaaagaggatggagatggatggattggggcagagagatgctatttttgataggatcatcaaggaaggtctctctgataaggatgacatctgagcagagaccagggcaagcaagggagcggggcatgtggctatctgggggcagagtgttccaggcagcaggaagagtgagtgtgaatgcccgcggcatgagcatgctccgcgtgtttgaggaacagcgaggaggccggtgtcgccccggtggattgtcattttgtattttgtgacccagaattctttttgaatcagctacctttaaaaaaaaaagagacaaatccaatataacatgctgtaaatttgatgtttttctttctagagactcagaattttaaagataaaagattcttaataggctcttaaaaaatctcaaaagtggccaaaatactggataaaagtgaaagagacaaccagcaatgtacaaaaccattttttaaaaatcaatttttaaatgatgtaaattcgatttttaaaaacttatttaaaaaagcaaagttacatcagaaataatcttatattggaataaaaatatctttcaaacatatgcacagcacggtgttaacagaaaatgtaggatattaaatcctatttaagatattattttaagtgtgttaaaattgaatattcacatggaaaagaatcagaagggggcataaacaaatcaaaatattgatttgatttagggaggggtctgtggataagtgccttctttttgaacttacatcattgcagaagtagttataatatagttgtttaagttttttttaatgtaccacaagatggcaaagttaatatccaaatagatgcaaaagctcccagaagggggttgagttttcagagatttgctcattagatggtttaggcaaattgtcctagaagcacaaagggataataagcctgtactccacagtcaggtgaatctggatctgtgattgcttgctagatgacctctaggaagtcacttaacagctctgaatatggatttcatcatctttaaagtgggcataatcagggaggattgaaagagatggtgaataaaatataataaacatgaaatggaggttgccggcattattagagctggactggaggtgcaccttgctgcataggtacgaaagaattatgtttcttccattccttttgcagtttttctcagggacaattgtcagcccggcacattcatgcaatttcccaactgccagtgggcacaggcagttaagtttctttagcaaaacatctattttaactgttttcttttcaattgaacatatgcacctctttttttttttaaatagaattagattttatgagtcattgaaggacagaagttacttcctccccaaatttgctgccatggcccagcaataactcagttgcaaggcatgctgggaggaacgtcaattcagaatgcaagagaggacagggatggggtgaggatgattcccacatgtagagtggacccctgatggcccaagaatgagccccgagaatgtcccaggggtcctggtaactcgggctcagctctgggctggcagcagtacccaaggatatggttggacttaagggcattgctgcaggtggctctggctgttgtctcagtcagcagtgatcaagttgtaagaaacagaacaccccttcccctgccccccaccaaactggctccaatagctccaaaaaaacagagaagacttttttttttttttttttttttttgagacaggatctccctttgtcacccaggctggagtgcagtggtataatcatggcttactgcagcctggacctcctgggctcaagcgatccccctgcctcgacttccggagtagctgggaccacaggcatgcaccaccaagcctgactaattttttaaaatttttttgtagagatggggttgagacctatgttgctcaggctgctctcaaactcctaggctcaagtagtccccatacctcagcctcccaaagtgttggaattacaggcatgagccaccgcgcccagcctggagaggattgttgatgagaaattagttaatgcgtgcaatgtaccttattcaggtgatgggtgccctaaaagccctgacttgaccactatgcaatctatgcaggtaaccaaaaaaagaggattttattggaaagaaaccacccaaagacaaaggtgtacctgggcctcatgaggagctagaatctgtaatcctaaagcagtctagaatagatttctaggtttctttgtccttgctttctttgtttctcactgctcctggtaaacatgacttcgttagctccttgcagtttgcctatctggcaaattccctgcatttcagatcatagtcctgggaaagagaatctggttggttcagcttgggtcaggtgtttattcctggcccaatcagctggcaattggttgctactaactcactaggaaccttttaaaaggggttgtatctacagggagggaataattggtgctcatgccaggtgagaggcaccatcttgagtccaaggagactaactggattcaagcaggacatagttataggctagtggtacaaacatggcatcattgcctcccaggggaggaaactggtgagagcttggcaggtgttagtgctttagccaactaaagccatccaaggatcttgagtacaggaaatgaatcagaaatgcaacccaggcaaatagagctggggcaggtgggaatagacacagccttatgctctctgttttcttgatggtggcctttgcatattcattcaataatcaaagatctgtggaattccgaggaagaatagaggtagttctagcctttgaaaactttggcctctatgtggagggacaaggcttagaaagctgaaaacaaacaaacaaaaaagctagaggagcatcaattgcttgattctaacagtgattgcaaggctataaaatacagaggaagggaaagttgtgtgtgaacacatgtcattgagtgcacacttacttgggtaaggctttttgagtttgcatggacttgacatgcgtcatctgatgtatcttggcaacacccctatgaagaacaagctgtcattacccccttttgggaaggtagagactctaagtaactgacccaaagtctcagagcaagtatccagtataactgtgactagaacccaggactagctgataccagaaccagggctcttaaccacagcactacacagcctctctggagagaaacagatggttctgagcaataaagggatcagcttccagacgggatgaatccacagaccagcttggaaaatcattaaagatcattaaatagacaaattcttgcagcaacttcccttggagcatggtacatagagctgcccacgtggtcggttttctctgttcatggtatctgattaaaagtggcaagtgtccccctggcagtcacacaggcatcatgttacactccactttcagctgtcttaggggaagattgtctctttgaattcccttgcttcctctggagacctccaggtgaattctgcacctcccacctagtcatcattttaaatcagactatcctcatactcatgttccaaatttgggaaattctagccaaccattttgcataatgtagtgacagacagacatttagttttatttatttactgattatgagagattaaggagaaagggaattttaaattacctgaaggcacttgaagcttagagggcagcggtaatagtgtaatgaagaatcacaataacaatgacaattttgaagaagccctttaaagtcaagcagactagccagtttgaagagaaagatggtgagtttgcctttccgagcttttaattggagttgacggtggaacacccacgtagaaacgtcctgtagccagctggagctgactggagctcaggagagagggagaggatagaaatataagtcaagactcatcagcccagcgagatgagagttgaaattctgagctgtgacaagttcttcttggaaaattgagtaagtaggagagagccaatctggacttcaagtcgatacgcaagaaatactttttttgattttcatatattagagtccaacaaataagccctaatcaaaaaacactgagtgtggtgataaggaagattttgcaataatttcgtaggaggaatggggaacaaaggcaaatttaagggtgctatggaggggaataatatgtaagaattagaggcagtacgtgaggtccatttagttagccgaagcccccatagttcactctttatgcctctcatgcactttcttttatcgcattctattttatttatttatttacttttatttgaaacagggtctcactctgtcacccaggctggagtgcaatggtgcaatcactgctcattgcagccttgacctcctgggcacaagccgtcctctcacctgagcctcctgagtagctgagactacaggtgtgcgccaccatgcctggctaatttttttattttttgtagagccagggtcttgccatgttgcccaggctgacctggaacttctgggctcaaaagcaatccttccacctcagcctctcaaagtgctgggattgcaggcatgagcccctgtgcccagccacattctattttagattagggtttgaattagttgtatacttgttttaaccaagattctgaattccctgagggcaagcctgaaccttattcatcgttttcatccttttaatgcctgcctaatgccatgacttgcaaaaataagcgctcgatgaaagttctaaaactcacttctctgctccagattggctctggattgcctctgacaatattttccagattttgatgttgcttactgtggagtgggagatgaacctggtggtacatgaacacattgcatttatttttaaaataagtcatttaaaggattgatgtaccagagccagactggatattgcataaagatgatggactccagatatgcacttcttttctacagagaggatgaatttccatttatgactttagtatgaaatttaaaatttttaaaataattgtgtttaagttttttttaagtgagttaataaaaatacttttaaaataagtcaattttagtagaaaaggcagacaaacttagtaaagatttttttcttttctttctttctttttttttttttttttttttttgacacagggtctcactcttccccaggctggagtgcagtggcatgatctgggttcactgcaacctccacatcctgggatcaagccattcttgtgcctcagccttccgaatagctgacattagaggtgtgtgtcaccatacctggctaatttttgtatttttagtagagatagggtttctccatgttggccaggctggtctcaagctcttggccttaagtgatctgtccaccttaacctcccaaagggcttacaggtgggagccactgcacccggtccagatatgtacttgttttctatagaggggatgaatttccatttatgactttggtatgaagttaaaatattttaaaataattgtgtgtaagtttttttaacggagttaataaaaatatttttaaaaaataagtcaattttagtagaggaggcagagaaacttggtaaagatcttaaagctggttgggagacaagtcacgtttgggtggatggtcttaggcagtgcatcataatctggtcttaccctacctttccccttttttcttttatatgactccatgaattttactccccctctccagcaataatagccatcaaatcaggaacgtaagtgcttagttgtattttccacaatatacgttaaaacaaatacaaagccataaaggtgaaaccatcatacatccatggactacctaaaatgatctcctacccattttgggaaacacggccgtttggaaatttatctggcccctgtccctcgcctgggaatccttaacatctggcactgtggattatccacagaaacatctctggcaatagagttgctcctggcatagagtgggcatcattaagtgtttgttcagaaataaaaggacagtgagatgccaaccgtaacatttaatagcttaggcactggtgtgttgaagccacatgctcagtacagttcaaagatgatagatcttagggtttccctgcatatggttagcggtagaaacataccacaaaacacgaccttacctacagtggagcgatcccctgatgtggggattccgactaatgagtctggggggcaagccgagttcttccaagcagaaagcaagcaagtgaaatctctctctcacttacttctctctctgtggccaatgccatctgctagctttaaaaataatttttaaaacaagtgttttggttctcttcaacgtgcagcaaagacagatgctatttttaggcttgttttctattaaaaaaaaaaaaaaagccaaagaaccaggggctgggtgtcggcagttctggcttactgtctgcattttgccaccaacttgtatgtgaccttttggcaaatctcctatgccttggaccctgagaatataagtgatcatttcacctccttttctcattagacatgttgagagggtgaagcagtattggtctgagaaataaaaaccattttctaaaaattagtcagtgtgggcaacatggcaaaaccctgtctctacaaaaaatacaaaaattagccaagtgtggttgtgtgaacctgtagtcccagctactggagaggctgagacaggaggattacttgagcctgggaggttgaggctgcagtgagcagagatcacgccattgtactccagactgggcgacagagtgagaccctgccacagaaaaaaaaaaacaaaaaaattggttaacttgtgctctcctgtaacctgccagcttctgtcttgatgtaccactaaatctccatgttccttctctcccatcctggactggaagctctttgaggggaggacacatccacacatccatacaatgtctagctcagaacctttcacacaagatgtacccactggaggcagcatcatgaggggttgagagtgtagagtctggaacccaatgcctaaggttcagaccctggctttgcagcagcttatcagctgagagaccactggcaagttacttaccctttctgagcttcaactttctcctctttagaagggagagaatgattatacttgtcacattgagttttgtagagggacaagtgagacaaaatatgtaaagcattcagctcatcacgtggtaagtacccaagaaagcttaatttcattattgttgttgttataattattaggcactcccacatttgataaatgcacatatgactgttacatataagataaagttctatgtgctgtatggaagatttttttaaatggtgaattaaatgcttgttatatggccagcatcatgttagacactctacacatgtgtccttgtttaatattctgtgggcaagtgaaaaatgtcccatctacaggtgaagagaaagcccaaaattagattaaataactgctcagtgttgcagttagtaagtagtgcaacaagacttcaaatactgtattgacttaaaaggtgaaatctttgcttcactttcccaccacctcttctcccggttttatagcccctcacaatagctttgcaacttttgacagcaagtcaccttttacgttgtgactcagccatagcaacatataaatataaccaaaacatatattccacaaaaagtacttagtggtgttctgtgcagcatgcactgataatttccatttcatcatttcattatttttctttcttcttctactttttttttttttttttttttttttttttgagacagtttcactctgttgcctgggctggagtgcagtggcaccaccatggctcactatagccttgaactcctgggctcaagcgatcctcttgcctcagcctcccgagtagctgggactacaggtgctcaccaccatgcctggctattttttttttttttttttttttggtagaggcagagtcttgctatgttccccaggctgttctcaaactcctagcctcaagtgattttcctgtctcggccctgccaaagttctgggattacaggagccagccaccatgcctgacctcttttttctattatttttttttaagttgatcatgacccaccaaattgattcaatcatcaattaaagtgagatacaacttgagtttggaaaacacttgtctggcttcaatactcaggcagtattgccaggacatctcattttcatcacatttacagtttgcagccctgtgtatgtttcattccagcccctcagtcagtctgttagagattatcgcatatgttatcctcattttataaatgaagatatcaaggctcagggatgtaaaatggtcttgccaagcctccccagtagtcagaaaacgtggagtcagagctttgattccaaccttctgactgtatgaatgctgctttggagacccagtaactcctgctgcctcgaggatcacccatttattcacttaattaatgtatattgatggctcgctttggtcaggcatggtgctgggctgttggtacacagcggtaaacaaattttacatggctcctggatttgtggaacgttcagtcacatttcgcattagtccatttctttcagagtgagaccccgaacctttgtgttagcctacgtgaccttacatgatgcgtccctcagcaccaccctgggctcatctcctaccctgtcccccttcttctttcttctccaagcacatgaggtgtgctctagcctcagggccttcgcacagcctgtttctccgcctggtaagctctcactctcaatacctgcatagctgctttcgtcatctccttcaagtctttgctgaaggatcgccttctaaataagattatcctgaatactttattgaaactggaactcctttctcccatctcatccagctggtactcccaatcctccatactttgctctgtttttcccccgtggcactttttaatcttttagccttctatttttatttttatttatttatttattttttgagacagagtctcactctgttgcccaggctggagtgcagtggtgtgatcttggctcactgcaacctccacctcccaggttcaagcaactctgctgcaccagcctctcgagtagctgggactacaggcgcacaccatcatgcccagctaatttttgtatttatattttagtagagacagggtttcactatgttagccaggctggtctcgagctcctgacctcaggagatctgcccgcctcagtctcccaaagtgctgggattacaggcacgagccgctgtgcccggctatcttttaatattctatataatttgtttattatgtttagcatttattgccttttctgtgtctacttgctagaatgaaagacaaaggccaggaatttttgttggttttgttcactgctctatcctcagcacccatctataacctggtacctagtaggactctgtaaatttgtttttacttgaatagatagatgaaataaataaccatcaagttcaaaatataattaacaaattatgatgtggtcagagattaaaaaaagaaaagaaaagaaaaaagcccacaggctttcatgaaagagtataacggcagacctaatttagattgggtgggttagaggaagtgacttttttaggctgagaacataagagggacttcagttcccaaattcgttagcgcagactctgccattgcaagccaaaggaacgtagcgtaaaggagagatttcacccaagcagaagtctctaagaagagataaagtgattcattcattcatttagcaaacaccctctgatggaaggagagaaacgagtcacatattggtgttgcccaagggccaaaacacacatctgacttatttaattccagcaacatcactgaggttctactattatctcctcttgacacacaaggaaacccaggtgttgaataacttctccaaatacatccagctattaagagacagagctggatttccaaatgaagtatctttggcaccaaagcttgtgccctttccctctctgggcacctgctatgtgctagttgtgctatcagaaacagggcttacacagccaacaagggcatagcccctgacttgaagaagttcacaatatcccttgaaagacatgctgaaaaacttccctgattaggacacagatttttttttgtccccagttcttttacttctggacatgccttcctagattactgtttttcaaaccttgataattcatctttttgtttttgatagccactatgttatctattggtgagtacctcaaaattcagtggcttaaaacaataagcatttattatctcagtttctgtggggcaggaatttgggaatgctttacctagttgatctggctctgggtctcaaaggaagctgcactcagattgccagctggaattttagtcatctgaagccttgtctcgagtgaaggatctgtttccaaggtgattctctcacaggactggagttggtgctggctgctggcaggaggcctcagttctttgccaaatgtaccttcccatagtactgcttgagcatcctcatggcatggcggcaggcttcccaaaaagcaagtgatctgagagagagcagggtggaagttgtaggtcttttacgcgctactcctggaagtcattcattgtcatttttgcagtatccaatgggttacacaggtcagtcctattcattaggggaaggtactacacaagaacataaataccaagagactgaaaaatcactgtgggtggggggagcatcataaaggctggctactacagctatctatcacctgtaacattatttacttaatattttccactttttgttaaaatcagccttatcctaaacaataatatcagttaagtcacaagattaatatgctaattgtattttccagcaaaaacaaatataaacttgtaattattattattattattatttttgaaatggagtctcactctgtcacccaagctggagtgcagtggcatgatcatggctcactgcaacatccccctcccgggttcaagtgagtctcctgcctcagcctcccgagtagctgggattacaggtgcctgccaccacgattcgctaatttttgtattttgttttttttcagtagagatggagttttgccctgttggccaggctggccttgaactcctgacctcaggtgatctgcccacctcagcctcccaaagtgctgggattacagctgtgagccaccatgcctggccaaagttgtaattattaatgaaaaaaattatctgtgtatcacctatgctcacttgcgtagttccagtgacacaaaccttacccttggggaaacaggaagcccagcaaacagggatctgtcagagagccctggtagttttcatcataaattccagctcttcccccactgtccatttggagccccagaagctacgggatgctaatgttgctgtttgctgtcctcttccaggaccgcctgtactttgtgatggagtacgtgaatgggggcgacctcatgtatcacatccagcaagtcggccggttcaaggagccccatgctgtgtaagtgagaactagtgctgtgctttctccttgggataaatgggtaggttagtggttcctttgagggtgtttttttgccaaagagggatctttaaacacctcgggcatctttttgaaaaaatatttagccagggaagaaaggtgttctgcttaatatgagatacttcttttttttctgacaccagctaagaacctgaagctcagacagacaccatggctcatacctgtaatctcagtgttttgggaggctgaggttggaggatcacttgagctcaggagttagaggccagcctgggcaccatgacgagatctcgtctctataaaaaataaaaaacttagctgggcatggtggcgcacagctgtagtctctcctaaaaataaaacaaaactcaaagctctaaaaccacagctatttatttatttctaattcatgtccctgactgcttagaaaggccctatatcttccttggggattatcattgtagattttatgtgtccatttgctaatatttattgagaacttactataagccaggccctaagtgcttaacaaacatcgtctcacttaaccttgagaataactctgggagggagatgctaccatccctgctttacaaacaaggaaatggagatgcaaggttttgaaagcttgcccaaaatcatggagctagtaagaagcagttcccaaattctgaccccggtttttctttgcccatgttctttatcttacaccactctccgtcttagatgccttcactccatgggggtgaaggatcaaggtgctcggtggcaatggtctgtggttcctgtgatggggagactgattctgggttgttggaaatgtgtttcctctgctgagtcaattccatccccttcggttcaaaaggcagctacagtctcttctttttagaacacagatttcatcatgtcattcccctgcttaggaacatggcaagttataggaattagcaatgataacctctcctggggagttttctaagatcttattgcctctccagagagcccccagagctcatctagaaccccaccttgtcatactagaggcttggtggctcctacccagttcagcttgccccctctcctcccacctggacaggttgtgagcactatgttctgataggatttgcattattcttgtgcttccaaatctagccatttgtatctcctggcatgactctaataggactagctttgcttttacttctaacatctaattgaccacaggctttaattccattgtcacacaagacatgtcaagacactttacatagttccccaaagccctgcccaacctttgtggcataactgggcttcccagttctcttgaaacctctttctttctgtgctgaccttcaataagaggttacactttagacagatgttgtttcttattccagctgcgccattcattcactatataacttgcccaagttaatctctctaaccctcagtttcctcatttgaggaatggggagatactagtaggacctaccttacaggattgttattaggattaagtcaggtaatgcctaaaatggtgctggggagatggtaaaccttcaacagatgttagctgctattgttaagataatttaacttgctatatagtctgaaagtataattctctcttttttgggggggtgggggacagggtctcactctgttgctcagactggaatgcattggtcctgaccatagctcactgcagccttgatcacctgggatcaagcgatcctcttgcctcagccttccgagtagctgggatcacaggcatgtgccaccacacccagttattttttttcttttatttttagtagagacaaggtctcactatgttgcccagctagtgaaactataatccttcatccagttcatcatatcccatgtccccttctccactatacaattgctgaacttctgcctacccccagtttgtccttaaggcaaccccatcaccctctaaaccaccctttgaatccatctgtactttcagcactttatgagctatatagctgaccatccatgggttctttaatgtcctacacctagttcaatattgtattgaattctgagcattgccaagcatatggtgtccttgagtttctccatcgctttttttttttttttaatttcagattttacgctgcagaaattgccatcggtctgttcttcttacagagtaagggcatcatttaccggtaagtgaacactgctgtactttccatctcttcatctccctcagctcctccctgccctgcctctttcttcagctgcttttaaaattagaatccgcggtgggggaggaatcctccagaactaacttgggcatgtgttctgccaggcagcatcgcccactgccctggcaaagtttgggcagctctatatggtggtagaaaatctcggtggactgtgtcaccaatgatggttcagagcctcaaacaggagactgtttgctctaagaggagactcacagagaggacctcagtacttctttctcttgcttgtggaccctacatttgaggagcaggcaaagaattttggctggcagaatgtgatggatcacattattatgaaacattttttatttatttatttttttctgctatgtaagtacaacttggaaatggatctctgagtggctgccctgaaagacaggattaagttcaggacttggcatttgctggtttttggaggagcaaatggatgatcatagctgcatgagtcataccattttatatttcatgcaaggcagacgattgcacccgaggctgctatttgtcagcaagtccagggcgtacaattctccttgtactacattgatgcaaatggcatagccagggcaggcttgggctggtttgttatgcaagagaggctgcaaggtatgaggcctccaaatagcatttggcatgggtgggggtctatttcaaagattatgaagaaccacaagagtctcttccattcatgtgtttgacacacatttatcaaatcctactatattctaggcactcttctgggtggtgggcatacagaagtgaataaaacagatgaaaccccttgcccccgtggagtttatctttctcatggtgggagttagataagtgaatcataaaaacatagtctgccaagtagtgataagtactatggagataaatcaagcaggggagggtgctggtgtacactgggtgttggagggttctctctcattctgtagagagcatgatgatgagggcctggagagttaggggtgacttgagagtcctgggccttttgccttaactgcgggatatgggattaaaaggcatgagggggctgggcacagtagctagcacctgtaatcccaacgctttgggaggctgaggcaggaggggtgcttcaagctaggagctccagaccagcctaagcaacatagtgaggcccacatctctaaaaataaaataaaattagccaggtgtgatggtgcatacctatagacctagctactcaggaggctgaggtgggaggatcaattgagcccaggaattcaaggatgcaatgagctgtgatcatactactgcattccagcctgcgtgacacagcaagaccctgtctcaaaaaaaaaaaaaaaaaaaaaaggcatgttaagattagccctggtaagtacaaggcagatagcggaggccaggctatgggatgctggtaggatggagaaatgggaagtggggaccttgtcagaggctttcagagtcctggggcttttagtcacacctgaagtggtgatatggaatctatagggggaaggatgatcttattctgagggcacaaagtccccgccattcctactttctcctaatgatggagggaagaaggtcaagaagaggagtggttttacttggcatgtgggtgatcctagtgaaaatgtaaaaatagagagaagaagaagaatttagaagctgaggcaagaggatcacttgagcccaggagttcgaaactgcagtgagctatgattgtgccactgcactccagcctgggcaacagagcaagaccatgtctctaaaaaaagaagaatttaaattttaaatagtatgatcattctgcccatgcccatgtttgccctcaatgaacacgttcactatgtgtgcatgaaatggcacatggaaatcctctaattcccttagtttctcttttgactctcatagtgacaacatctttttgtgctgaatattattctggttttgaaaggtgcacatgaggctgggcgcagtggctcatgcctgtaaacccaacacatagggaggccgaggcaggcggattgcctgaggtcaggagttggtgaccagcctggctaacatggtgaaacctcatctctactaaaaaatacgaatattagctgggtgtggttgcacatgtctgtaatcccagccactcgggaggctgaggcaggagaattgcttgaacccgggaggcagaggttgcagtgagctgagatcaccccgttgcactccaacctgggcaacaagaatgaaactccatttcaaaaaaaaaaaaaaaaagtacacatgatccgccatatgacatgatccctaaattcaagccgatgacttcagctggtgcttaaccaaagagacaggcatcatgggtgatttttcactctacatgattttcaacttgggtgctgacattaggacctaactcctatgtgggatgtgcctctactaaaatagaaccaactgggttcttgagaagattaaatatggaactacaagtttattggaagaaaatccactcccattgtaggaaacaggagaggaaataattagtgttccggtcaattgagttgtgattcagggctagtttctaatcaatcaggaagccgcactgggatctgggatccatggatccggctcactggccaggcaggtggtaaaattaaaagattagcatttcaggtgctaagatgatacctattccaaagccccttttcctaaactaactacacactctccctttcatcttccactattaatatggtctttaaaggggtatttatcaatcttttaagccagtctgcatctgaacccttcttttgtgtatgtggaagaacagagtcaatcttctactataaataatgaaaatgacagatactcatttcacagcccacctgtagccagggcaggcacacaacccaagctctgacagttggtcatacttactcaagaccttgaatcagaaactagcggccaaggaagcagaaagcatagaatcaagagtgaccatagtaattatcagcaactactttccagaggcaagagaagagggtcttaatagcaataggcagagtccagcattagggcttcgtggaacaaggggtgatgtgtgtgtcccatggcagcttgggtggtggtgtcactggacaagccctgagttgcagttaggcattgtttcaggctgtatagactcttaatctggttcttcagtctcctcaaagattctatgagctccccaatatcctttgatgaattccttttcaggtaaaaatcatcatagttggtttttgttgctcaccatcgagaacgctgatggaaatagagttcttgaaattgatagtcaaatggaaatggtaaaaaataaattacttgacaaaagatgtatggttttatcatttcacagagattgatttcatagtggtaagatcttttaagatgttacaaatcactacctccttcatctaaatctctacttaattgaacagttcttaagtaaagaggatgaaggattatgttagacttaccatctttaaggaactggagatgttgggttgtggggtgggaagggaaaaagattcttcctatcaaacttagtgtctgatttactgaccactgtctctggaatgtgtgttggttttgcccttgatggttttctgaaaaatgaaaataatttctccatccaccttttgaagcagaaatgcggatttattacacagaacaaaagattagggtgtgatatcaaaacactgtatgtgacagtgaagatgacagaggtgccctccagcctcaggactgcctggctcttggcacctgaaacttcttttctataatagatgaagattttatcacttccctagtctacccagctgcctgcttctgagcatgtggtcgagctgaagggttgtcatttgtcactattagagaaatcacatatatcacatatagacctacctagtaagtttatgaaaagcaaattgctgcaaagcctgggttttctgagttccaaactttcacacaaatcatggtggcttgtagatgagcatgaaggctggatatgagcagcaccacggacagcgccaaaggcatggcgtgttgggattggcaaacatcagtgggcaagtgcaagtggacctccccatccctttgaataaggagaccccacagacacagataggagatgccaggatatagttttcagattgtattcttttagttggaaatgatgacagcaactcaattcaaagtaacttaggttaaaagaggcatttattggtgacataactgaaaaatccaggtgcagatctgactttaggcctggataaatgcagaggctcaagtgacgttatgagggcacattttatcaccctccctctaggctctgctttctctatattagattgcttcttttcatctggtgacccctggagtttctagacttccataataccacctgaacaaccccaatgtaaaatgcacttatccctttcctgattatgccagccaaagtgccagcactaatacttaacagctttgattggcccagattggatcacatgcccattcctgaatcaatcactgtgaccagcaggatggaatatttccattggctgggacaggcccacttgaccactgctggagccatgttacatggaagccatgttacacccatgttacatggaagaattgaaggagggtggttcttctaagaaatattagaatgctgtcatcacaaaacactagaatagacagaaccacagatgcccactacccaatcaagatgaccgaagggaaagatctgaattaaggaatagatccccctacctctcaggaaatcggatttccccatcttctattaggaccgatccatctctcagccttgctcactggtgcagaaatataaagcattgacattggagtaggtgtttagggaggaggaaagtgtgttgatattggagcaatcttgtgtgctaaagacctacaactgttccccaaaatatcaagctcttctcatcaacacagatgaaaataaaagagaatacagcacatatcctttaggttagagctcagatgtcaccgccttagacaggtcttttctgactgacaccctgcttaaagtgacttcctccaatcactatcttatgtcctctttattttcatcataccacttatcagaatctgtaataatcatgcttacagagtaattgttatctttttcccagcactgaaatttaatctgaagaacaggaggcttgcttatcttgtttactgctacatactatacctggctccaggcatagtgcctgtcacatagtaattgtgcaacattttttttttttcaagacggagtctcgctctgtcacccaggctggagtgcagtggcgtgatctcggctcactgcaacctctgcctcccaggttcaagctattctcctgcctcagcttcccgagtagctgggactacaggcgcccacgaccacgcccagctaatttttgtatttttactagagacggggtttcaccatattggccaggctggtcttgagctcctgaccttgtgatccacctgccttggcctcccgaagtgctggaatcgcaggcgtgagccaatgtgccctgccaaatgtattttgattcaaagaattgatggaaactcctgggtcatgtcctagaaggtggcccaagagatcagggaacacttagcattaaatatttctttcaatcagcttctttttttctttgtaatttttagagatattttaaaaaataataattttctgaaaaatgtatcttcttacaaaatataaggagtctttaagtggcaaaggaaaattcttggaattttcctggatccaagaagcgtcatggatgctctgccctttgcttaactttctgtggatctccgtcttttcagaagtgctgtctctttgtgtccttgtgagacacttggcacagttggctgtgtagaaaaagaaaagcacggaggcttgcggacctctttttatctccctgccagactgtaagctgttggaggtcaaaggctggtttctactgacctttgtgcccacacaacacctaacacagtgttttatgcataatgagtggctgttggttggcttgaaatgcatagcgtttaattaaatctctaaattcttgtgtctgccatagtgacctaaaacttgacaacgtgatgctcgattctgagggacacatcaagattgccgattttggcatgtgtaaggaaaacatctgggatggggtgacaaccaagacattctgtggcactccagactacatcgcccccgaggtgagagctgctgggcacacgttcacattgcggtgatgtaccctctgctccccagatggctgtgtgagagctgggaagggttgagggtggtaccttgcaagggaacctcggacagattcttattctatactctaaatcctccctttgagatcacacatgcaaattaatttagcacacatccagaagcccaagcccaaaatacatcaaggtttgggagaaaatttaaataaaacccaaaagaaccatccaacacacatcagtaaaattcttcgtcaaactgttgtggctcacggccatgtgataccgcctaattatgacattgaaatgtttgttgagagaaaaagagcatatcccctgggctggcatatgacatgggatctgtgtcctgtatatgtccctcagcaggaaaatggacaatagcccgtgatttatttatagcatgaaatactaccaggcaccaattcagaagagtgagttagatatatatgtagatgtgaaaagatcttcaagacacattgttagagaaaaaaatcaaggtacagaatgacaaatacaaggccaggtgtggcagctcgcgcctgtaatcccagcactttgggaggcagaggcaggtggatcacttgagcccaggagttccagaccagcctggccaacatggcgagacctcgtctctacaaaaaatacaaaaattagccgggtgtggtggcacatgcctgtagtcccagctacttgggaggctgaggtaagagaatcacctgagccccaggaggtccaggctgcagtgagccgtgattatgccactgcactccagcctgcctgggtgacacagtaagaccctgtctcaaaaaaaaaaaaaaaaaaaagaagaagaatgacaaataacactatgatactatttatggatgaaacagaaatacacagaacactgttctgttttcaatgagtaaaagcatacaaaaatctggaagatttcaaactgattttataacactggttacctctgaggataagggaattgtaaagagaaatttagctatttctgtatactgctgacattttttacaaggtaaatgtatttgggtattacttgagtaataaagtaattctttaaaaataataaggctttactcggacccagtgaagttttccctatgtgatatgctttggtctattatcattttgttaattaattagataggacacaatccataacacaacttcctgataggccaggggttccataatctctggttctcaactctaactgcagtttagagtcgtgagggagcttttacaatgtaggatgcagctggggcatggtggctcactcctgtaatctcagcactttgggagcctgaggcaagaagatcgcttgagggtagaagtttgagaccagactggacaacatagtgagaccctaatctctacaaaaaaaattaaaaattcgccaggtgcactaggtcacccctgctgtcctgactactcaggaggctaaggtgggaggatcacttgagcccagcaggtagaggctgcagtaagcagtgatcatgccactgcaccccaccctgggcgactgagcgagactctgtctcaaaaaaagaaagaaagaaagaaagaaagtgtttccacacttttaaagtacttcaagtcttatttgatcctcatgacaagccaacaagttaatccttttacaaaggaaactagagcctgggatgtgacagcagttgccgaaggtgatgtggttagctcatgacaaagcctgacctgctgcttatccctcccatctgtgggctggaggggaggcaacttcaccagccacacagttgagggtttcttgtgcttgcctgaatcacgaccagcgaggaacttctgagaaccacagatcctgggcctccacctgcagagattctaatgggatgatgcttgggcatcccacattgtttcttgtgtgtgtgtgtgtgtgtgtgtgtgtgtttgagacagggtctcactctgtctactcactgcaagctctgcctcctggattcatgccattctcctgcctcagcctcccgagtagctgggactacaggtgcccatcaccacgcccagctaattttttttgtatttttttagtagagacggggtttcaccgtgttagccaggatggtcgcgatctcctgacctcgtgatccgcccgcctcggcctcccaaagtggaaaacacgttcaatgagaagtgttctcctggaatgctttcccttccttgtcttgagggttacttctcagaatgcatttcattcattcataattgaccagtaaaattgtatacatttatcatgtgcaacatgttgttctgaaatatgcatacattgtggaatggctaagttgagttaattaacatatttattgtctcacatacttatttttttatggtaaaaacacttaaaaatccctcttagcaattttcaagaatacaatagattgttattaactatggttactgtgttacacgataagtctcttgaatttattcctgctacttaactgaaattttgtatcctgtaatcaacatctctgcatttctgattttggaatagaaatcaaagtgggagatagagatcaagaaacaaacattcactttatagccaagtttgctcaaataccctttttgagttaaacaagcaataactgaattataaaacattctaggattagttaacattttgagggcataatatgtgaaagccaccgagtatctcattcatcctcacataacttcatgatatagagattatagaagttaagtaacttctcctgtggtcagacagccaaccggtagacagcagtcaggattcaaagtcagactgcctaaccctcagacctcagcctttagcctttgctgtattacctcttaacctctgacatggttagttttacatccctgcatactgaaagatggacaatcacatagctcttctagacttttccatgttcttgcagtttgggaatatgaattaaaaacttcacaaccatatataccatatgatacaccaattctacatctaggagtttatcttaaggaaatacttggacagatgtccaaatgtctaattacaagaatatatgttacagcattggaagaaacctaatcaactggaaatttataagatagattttggtatatccattcaacggaatgctatgcacagataaaaattgattatgttcatatacaaatattaaattagcaaggaaaacttaagtgaataactggctttattaaagatctattgcccataatcccagtgctttgggaggccaagatgggagctttgcttgagtttgagatcagtctgggcaatatagagagaccccatccctacaaaaaattaaataattagcatggtggtgagcacctgtagtcccaactacacaggaggctgaggtgcgaggattgcttgagcccaggaggccaaggctgtgagctgtgagctatgatctcaccactgcactccagcctgggtgacaaaaagagacactatctcaaaaaaaaaagaaaagaaaaaaagaaaaaaaatcgtccaaatactaaagtgtttatgtaaagcacacacatacacacagagtttaatatgtattcagagaaaagagtatggaatgaagtagaccaaatattagtcataatttttctcttaataaaggattatgggtgattttcatgttattatctcagctgagctatcttttataaagaaatattaaaatagtgacaaatgttgttatctcttaaacgtttttatgtttaattatgttttaaaaacatgtaacgtaaaatttactattttaaccagttctaagtatacaatttagtagtgttaagtatatttacattattgtgtaaatgttgtaacttttacagaggagtaaagacagtttttccttttaaaaattccatgctcactgttttgaaaataataataacaatacaccttacttagtgcttcgaaaaggcaatgtgacagccacaggtgtttgcccagctgcaggtgcctctgcaaagcatgtctgtcattccctgaatagctaatataaagaaacagttcaggtgggcactggccttcttgtaaaagaagagtgaaatctgtctccagaagaaacatgaactgcaaacctccctgatagggtgccttctcttttctagataattgcttatcagccctatgggaagtccgtggattggtgggcatttggagtcctgctgtatgaaatgttggctgggcaggtaattgaattttaagtgatcgataagagaagtcctccctacccccatccacatggtttctttaggagaatgcatgtttggtaacagctcataaattggaacctctatgactttcccggccttggggtcatacaagtctgtggtcatttgaaagcctgggtgtgtggcttcactgtgggccccagggaggagggtctgccagttgaggggagctagggggagggttcaagcagggattcttctcctcccaccctcccctgtcatacaggcaccctttgaaggggaggatgaagatgaactcttccaatccatcatggaacacaacgtagcctatcccaagtctatgtccaaggaagctgtggccatctgcaaaggggtaagtgcatctcttaaagctgtgaccaggaccaccacataaaggcatgtgggctgtaccttgcccaagaacaccccaccaggggggaacacagcctgaactccacccttcactccatttgccaatatgagaaccctgatgtggagctgctacctcccggaggagagagagctttttttctgatttgcacagaagtgctgtagagagctgcctgcagctgcgtcttgctgctggctgggctgcagtctctgaaccagcacaggggaatgcttattgaatgaatgaggtagaaagcacagagattttgtcaaagagctggaagtcatgggaaagggcacaagaggtcttttgcacaactcaggctatcttgccctgctctgctgtatgtgtttagttaatactaagagcgtgcaacttttgttctaaaaaataccacgccgtgttgaggttaaggaattctctagataagcagactgaaattcaatgtactcaaaatcccactgtctcctctccccagacacacacacaaatggctaaaagggcatgcacgcttggacatctacggtttatgcacagggcacctgtgaagaaagcaggatgtgtgtttatggggaaggattgtttgttttgcatcttgtgttggaccagggcatactcacagtgacttctgtgagatcctaaagatcagcgaccctcacctttggagccatcagaataacccgaagtgccttaccagaatgcacatgcttctgccttaccccagagattaagtctgggtatgagtattttggaaaagtctccatttggcttgcagaccactgcctttaaaaatactgtccaaatgaagtgatttttcaactctgatggaagcctgaaagcaatagaattagacgcccagaaaatatgttctacacataatatactaataaaggatttgctctccctccacccagtggtacaggttagaacatggccgtgccttaatcagtgggttcccacctgtgtgtctgaataaaccagggctgccagtcctagatctgtgggatgcttgcagacttttcatgccctactttgttcttcctgaccccagccagatgctggatgcactgtcttgggtgaaggaaagctgggaaactcaggcaggccaatctgaggcttggcccagtttggaatagctgggccagcctctcagcctaaaagcgccttgtcacactgcctaaattcccactctcaatgaatcacctaaggtttgcacctcagctgcataggctaagatgcatgtatccctggggaaaccacctgtgaattagtctcaatcccgaacatctaaagtgaattgcttgaaaatattttctttgagggtgtgaggcagggagaaagaaagtgaagaatagagaggggagtcccagaggtgcattaggaacccaagcaaagcccataaagaaaaaaaaggcacacacgaaggcctccacaggcccccgtagacaagttattgaagggtgggggcgggtagagagaaggtggtacctggagcttttagtttgtttaataattaccagcatataaggatccagagatttctcaaaaacattcagctttcaggtttctcttgaaaaatcagatcttgccacattggcctgtcattcttacaaagcaccagtcagctggattggaaaccatggccctctgtagttggagcttgccctctgtaattctcagacgttctcatttggccaattctctccaagttcaaatcctggttcaggcattaattgccgcaggaccttggggaagttgtttgacggcatctgcagattggggataataatagcactccacattgggttctttgatgactaaacagctgaatactgtaaatcacttagaatagaggctggcactctgctccaagccccttggaagttattattactattactagtgctgacgctattgtgttatctgccaggttcctcttggcatttgagtttgcatcccctggaattgcaacttttaaagtaggggattttggagatcaagggaccctttgcaaatcttgacccttctactttctaggcacaaggtgtttttgttttgttttgttttgttttgttttgttttgttttgttttatcaatgtctcgctctgtcgcccaggctagagtgccgtggagtgatcatggctcactgcagccttgatctcccaggctcaagggatcctcctgcctctgcctcccaaagtgctgggattacaggcatgggccactgcacccagcctaggtgcaagatcttaagccacttcctttgcatctctgggcttctgtttattttaaaaaatggaatagtagtactcattgaaaagagtttttgagagcattaaatgagataacataagagaaagctccttgcatgatgtgggcacatagtaggtgtttaatacatccacagggtcctccccttcacacgcccgccctgcctggacagctgggggttctaaatgggtcatggaggaaagagcattttccaggtcagctgccttcagctcctgctccaattagcagtttccctggtagagccgttttctattaattcaggacccataaccttcatgattaactggggtgactctcttactattgagtttggggaccattattaattgagtgggctgagtccaatggggctcttccttcaaggagggtactccaaaaacgagtgatgctcaagcaaacagccaaatgcttcctctggaacagcgagccccaggggatacgtctgggaggtgatcagagattggaacagtgattaaatccagctgtctacatggcttcgggcacattagagcagagtgcgggaactgggcagagactccgaattaatgctggatgtttttgcagtaccttttctttgcttggcatcctcctgcttagacagaaattcagttgagcttttgaaaacagtcacctgtttaattgaagcagtgtcctttatatgtccattcccttaaaggcccgattttctactaaaaaaaaaaaattagtaaaaccttactcagatggctattcccactttgaacaaacttgaagcaaacagaagcccaaatagacaggaccttagggtgaaaaccagcagacactgaacagctgagactgaacataaagctataagagtcctgagccaggcagagctgttcaaagccttgccctgctccttagctgtttgaccttaggcagatgactttacttctctgcacccacatcctttacctggaaaatgggggataatagttgctgaggccttagagtattgttgcaaagtttaaagagtaatgggtaatggccgggaagcctttagcacggagcctgaacgcatatgatgttgtcatactcagtacacggaagccgttattgatgttattatcagtgtgaaccaaaacctcactgccctttctttcctcccatcctaatcttacacaaatgtcaagccttggctcaatttcctcaccctccataaacctctcctgacaaagccaggccacaaaaattcctgagaaaaccacgtgtgaaatgcactcccatttttcttaaaagcccaagttttagagctaggcagaggtggagtctgcacccagctcttactgactctaccacttcctctctggagtccttactgttcctcaacttctctgagtgttcattgcctttttattcaaatgggaaaaatagtatactcacctcattgggttattatgatgatcagggaagctcatgcatgtaaataaagaagtagcagctcggcgcggtggctcttgcctgtaatcccagcactttgggaggctgaggcaggcagatcatgaggtcaggagatcgagaccatcctggctaacatggtgaaaccccgtctctactaaaaatacaagaaaattattagctgggcatggtggtgggcgcctgtaatcccagctactcgggaggctgaggcaggagaatggcgtgaacccgggaggtggagcttgcagtgacccgagatcgcgcctctgcactccagcctgggtgacagagtgagactccgtctcaaaaaaaaaaaaaaaaaaaaagaagtagctagcttagaatgtaagtgctcagttaatttccccaccctggaggatacactttatatgacaagtacatgcttgtgtgtgagaccacaaattatcttgcgagggggcaacaggctgagtgactgtccaacagtgtaggaatgaatttctgggttcattccttccccatcatcagcaagtcctgggcagaagattctgccatcatgggcttctcaatgtgatgtcaactctggaaagcttttggacttgtatgcttctttctttttttttaattaatcaccaactcttctgtctttactccctgtgcatttgctcaagtcttgagatcagagatattttcatgctgctttggactcatttacaagaggaagcctgtctggtttcatcttggcgcatctattcatcttgttatttagcactcagagacccaaagatggagggttttgataattaagtaatttaaacggaacaccaaagaaacctcagcggctttgtgtgtaatgtatgatacaagggaaatgagctgggctaggttttgactatttaatgggctttcagaaagtaattacttgaaacttgggcccctttgactaatactttttcttctgttttgtcatttttgcaagtgctttactgagaaatgcaaatggtatctgaatgaatgtagcctttgcttttgtcaaactccagttttcttgttgtgggaggagggaagtttgaagatattgaaactgtcctaattaaatgcactggtaattgcacaaaacttattcttaaaccaaaatggataaatggatcatgtggcatttatttttttctttctgtttttttttttttggttgtttttttggttttgttttttttttttgagatggagtctctctctgtcgccagactgtagagtgcagtggcgcgatctcagctcactgcaacctccgcttcccgggttcaacaattctcctgcctcagcctcccaagtagctgggactacaggtgtgtgccaccatacccagctaatttttgtatttttagtagagacagggtttcaccatgttggccaggatggtctcaatctcttgaccttgtgattcgcccgcctaggcctcccaaagtgctgggattacaggtgtgagccactgtgcctggccctcatgtggcatttctaacttgaagttcacggccacattcaggcttcgttttgattaaccataacagatgattggcagtgggtcctattatcaggtcctctcctgcaaattcctggctgggattttttgctgggataaaaagcaaaaaacaaaaatgagttgagattcttcatttgcgctttctttcctaatgcattggagtaataatttctgagtgtcttacatttcctcttctgaaactcagcaaattcaatgtttttctttctctcgaagctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctgtaagtagcccattctctctgactgccgggtattcacacacaaggtattcttgcctgtgcctcatgttttccaaatgctccctgaggggtagacgtcaatgtgtctactggaacatgggtgtatgtattcacacatatgcacaaaatcactggttactaagatggacattttccattggcccagcttagtctctataaagatggaaacgacgatgcctattgaatttttgtttcttcgattcaattattgtaactgtcttagctgacaactttctgagaatggttcttgggtgagcagagttcagatccatttttggactgtgataaaggatctaattttgccctcattctttctcttggttcaactgtgtcattttttcttcatactgacattgaaaaggtcatgttgtttatctcaacagtatttaaatttaattctgaaacatacactatgtctgagtcagtaaataagatggcagttcagcagccagctcccacccaaggcaaaacagagtgaagcagagactgaagtcctcttgaactgaagaccccctccgggagggtttgggtgtggagatggctttgacataagttttataatgcaagaataaaactctcacatttcccacagtccatgtaccaacaggaaggttttctatccccaaagactcagcaggaagtacttgtcggcatcaggaaagaagagtttacacctgaattaatcaaactgttattctgctgggaggatatttccttgtgaaattaaatagagggcagacttggtgactcaatgatgggttgtaaaactactgactgaggctgaagagtgaacataaacaccatcattgaaacctaacgttgtaagggtttgagtgttaagatgaagaagataataatggtagttattttgatactagtattgttattcatttcttgagcacttacgtgctaggcacgtaatgataatagttttgacatcagagggttgttatgatgcataaagcactttgtacaagcctggtacagaggaggcactcacagagagctgatcatggttttcgttagctgtgtcatacattaattaatgtcccggtgtagagtctttgaggggcagaatcctgctgctgctattccttaagataacatctgtgtgtacattggggtcgaagagggccccacatgtcatgagcagcatcacagcttttatgggaccatttggaaaaagatgaaaaggtaacctggaaaggaagagtgagctctttgttcaggaaacagggaactcagaggtgagatgcataactcatatggtttttgtggggttatttatgagatcttgaaatgtggacctccctttcctctcttggccagatgcacacgctcccatccccaccagcatagaacccagcggacatctgggggtcatgttatagctgtagtgcagtggtttgcaaagtgtgctgtctatcagtatgcagtatcagtatgcagtgtcagagccagcggtattgacatctcctgagcactttaggaatgaagttcttggtctccaccccagacctcctgaatcagacactctaggtgtggggcccagtgttctgtgtttaataggctctccaggtgacttgatgagctctcaaggttgagaatcactgctgtggagtttggcattaggagctcagccagggaagctaggcagagaccagagggaggtagcatggagaatcatctccttttttttctttttttaaagacagggtcttcttctgttacccaggttggagtgcagtagcgcgatcatagcttactgcaacctcgacctccagggctcatgcgatgctctcacctcagcctcctgagtagctgggactacaggagtgtaccaccatgtctgcctaattttttatttttatttttaaataaatggggtcttggccgggtgcggtgcctcacgcctataatctcagcactttgggaagccgaggtgggtggatcacctgagctcaggagttcgagatcagcctggccaacgtggtaaaaccccatctctactaaaaaagtacaaaaaatagctaggtgtgatggtgggtgcctataatcccagctatttgtgaggctgaggcaggagaatcacttgaaccgaggaggtggaggttgcagtgagctgagattgcgccactgcactccagcctgggcgacagagtgagactccatctcaaataaataaataaataaataaataaataaataaataaataaataaataaataaatgtggtcttgccatgttgcccaggctagtctcaaattcctgggctcaagtgatcctccaaaaacctcagcctcccaaagtactaggattacaggtgtgagccactgcacccagccaagagaatcatctctttaagtggaagacactggtcctccttctagtcagggcatggggtgatggcttccagaagaggtcacagactcagatgcctacagaggccaagcagataatatgaatgagggaagagggctggtgagatagaagagaaagtgttggagatcgatgcaagccagagagcaggtgatctacctaacaggctcagctgatgttcacctcccgatggcctgccccgcaggatgcagcctcctcagggctgctccatcttcatggtatttggggctagaactcggtgctgtgggatgcagcagacctgtgagttgattgacagatcctgttacagtcagtgtagtatgtaggccctgtgtagtaagggcttagtgaaagggtgtataaagttaagatgtttatataaaatctcacaattttggctgggtatagtggctcacacccgtaatcccagcactttgggaggctgagccgggcagatcacctgaggtcaggagttcgagaccagcctggccaacatagtgaaaccccatctgtactaaaaatacaaaaattagctagatgcgatggcatgcacctgtagtcccaactacttgggaggctgaggatagagaatcgcttgaacctggaggcagaggttgcagtgagctgagattgtgccattgcactctagcctgggtgacagagcaagactccgtctcaaaaacaaacaaacaaacaaaaaaacaaaaaacaacaaaaaaaaaacctcacaatttcttttatatatcagaacaaatttttgaaaattaaacacagtttggggcaaataaaacacacccacacccatatgtatcccatgcattgttggtttatagcctcaggggtagtgatggttcaaagtcaggttgctatttagccagcatctgttagcaatggttatttacaaccagagtccattttgaccggttaaatattttgaatagccctgctaagcagtaatgaatataagaggtctagcctcgtgcctggctcatagaaagcactcaggaaaaggtagctgttattatcattgataatataaaaagattacaatacttagtcattatcaacgagatccctcaactgttctgcatttgatatgatttcccactgacctgtgtcttgaattcctccatgtgggtttaacaatgactttcaaagtacagtgatcaggctgtgctacatacttcaaagtgttctggtaccagctctaaaggagcaggtgctaccttcagtctccttagactgaattagaaataataataaatgatacattatccaggtacagtggctcatgcctgtaatccccacactttggaaggctgaggcaggcaaattgcttgagcccaggaatttgagaccagtctgggcaacatggcaaaaccccgtctctacaaaaaatacaaacgttggtgggcgtgatagcatccacctgtagtcccagctactcaggaggctgaggtgggaggatcttgatcctgggaggttgaggctgcagtgagccatgatcatgccactgcactctagcctgggcaacagagcaagaccctgtctcagaaaaaaaaaaaaagatacatcacctacccatttgatccagcctgcctgtatgccttttacattgcaaatgcattgcatgagagccctcctccccccaatcccaggattttatatttctccttcctcaccccttcttaactgtctgccacttccaaaaggcccatggtgagcgtgtgcagagttccatgtgccttgtgggatgtgaaaaggcatgcatgtatctgtcagcgtttctgattcatgcatgctattaaatagagtgtggtgagagaaaaaacaaggaacaataacagaggattatgttcaaacatcagtgaagggtgctattattggaggttcattaaaataactttaaatgggtttttctaagttgttctcaatgccatcttttattgtggcaaggagctgttcacagagcattgtttgaaactgtattgaaatacactagatttggtgtattgttgcagggaacaagagtcatttcttttttaatgttcgcctggttgtgtgttgcttttgctttaaaacacccaaatggctctctgttgccccagtctcgtatctattgctccttggcatatatggcttttgaggtcttccagtgctagatctctgtcctcttcctagctttagctcctgactccaagaacagcattcctgggcttctttcagtccctcaaacatgcagtgccttgttttcccttgcctgcttcatctgtgcagagccatgcacctgggatgcccgaagccctttcctatgctctcaccagccccctgatccccaccgtgccttgccttttccccctcatcaaatcagtagaacatcaaccgctcagggaggctcttgttgattcctgagtagatatctgctactgtcccatcaagaaattcatcacaggctgtaataacatgttcaatctcatgcctgtctttttgactactttaagattgtgactttctctgtgtcaaatcccagtgcctagcatagggtttagcacattataggtgctcaggaattcttactgaatgagtgaatggccatagaacaagatgctgtaacacagtgtgctgtggaacataaaggagtcttttgggatatatattagagtgcatggtgtttttcttatgtacagcagggtatcgcaaataaattggttgttgtgtaagttactaccctatttataaaggactataatttggctgctgattttgcaaactgtcatggcatcgtgtggttttgcagtgtgtgctgggagagggtgctggtgaaggatctgaagaggcaatgcattgaatcacaggactttgggtagagagatctgcagcttcctgcagcctaaccttgcacagtccaatccagtgttacagatgccatgatgtagccctgcagagtgtcttaaattttaatgtgcatgcacgagtcacctgggtatctggctaaaattcttactcagccagtctgcggtggggtttcagattctgcatttctcacaagctcccaggggataggacactgtggggccagggactccacctttatgtagcaggggctagaactcagtgctgcagggtgcagcaggcctgtgagttgattggcagaacctgttgtagcagtgcagtaggtagaccctgtgtagtaaggactgtagtgaaggggtatatacagttaagtatagaatgttctggtgaagttattgttcagggcacacagcaggctgttgctggccagcatgtggtaggaggaaggtggtggtttgggtactaaagggcagactctgtcgctgagtgcatgatggagcagtggcttgggaagaagcgtgtgctggttctgtcctctggtggggatgttgtcagatattgagttatccattcagtgggtgatgaggttaggtaatgttctaggtgatggaaacatagcactaaaaataattaacatccctgccttcatggagcttatattctagggagagtgggcaaaataataaacatagaaacaagtaaaatatacgatgtgtcagaagttgataaacattatgcaggaagctgaagtagggatggagattggaagagccaggtcagggagatgtccttatgatagagtaggtggagaaaatgacgtttcagcaaatacaggaagaagatgagggaggtgggagccatgtatatatctgggtgaggggggagagtgatttggttggtagtagcagatgcaaaggccctgaggcaggagcttgcctggcatggtcaagggagagcaaggagtgcaggtgcctgagccaaggggttgagggagaaaggaaaagggggtgtgagatcagagaggccaaaggaaagcacaggccactgaaggatctttggcttttacaccaactcatgagccaagaaataacatgttctgactttgggtttttaaaggatccctctgagtgctgcagggacaagggtgaaatcagggagactggttgagactcttgccataatccaggcaaaaggtgataggagcttgggcaggttggggctgtttgagaacccccaagttggcatcctcaggtcctccccagttcctggcatcttgtaggcactcagtcattgtctcatggagacatgaaggcgctgatgaacatgagtccctgcagactgcccacatgattgctcctcaagtataaaacatggtagccaagagtttggtcccagtagcaataggatgaatgaatgaaatagatggtcaggaaagcttctgtgatacagagcgctggcttgcagggcatagagcaggaggacatggttgtgctcttggttggacttcctcctgtccatcctgttgcaaagaatgtagtgatatcggagggtgcagtggctgagggctgtacccagggagttgctttgtgtctgggtgatccagctcagaattttgctgacttgtagcaaaaggtgcattgagcctttggcatggatgagcatattttattgcagaagtggtagtacatggagctataatgtcacaggacaagatatgctaggtaatatgttcacattgaaatgcctaatggagagtttggtggcattcatgtattgtcacgaattggcttaatgaagtcctgtcactcttcctctgaaaggctcccatagtgtccataacacctaatgaagggcttactgtgaaaactgggtagggggatgagcccagggtacaaggattcagccgcctcagaagacaacccaggtagcagcatagaagcagtgaggtgaagaggaagagaaagctaagtaggcttcattagagtccttggagtcttttctgctttttatttatttgttttttcattgtttttaattaattgcccaggctggtgtcaaaatcctggcctcaagtgatcctcccacctctgcctctgaaagtgctgggggttacaggcgtgagccactgtgcctggcacctgtggagtcttaagcgctaaagtgtgtgtacaatgatctgcccagtagtaaacatggctctagtattcttttaaaatattatcaatcagatcatcaattgttctaaaatatggtcaaccagattgtcaagtgttctaaaatatgatgcatctgatcgtcaatgctctctgggcagggcttgaggagtacaacctgatgagaagcagacgttaagatcccctttcctccactcctgacattggagcaaccatccagtcctgtctagacatcactacaatgctcattccctccttccttccattctagcctgtgtcaggcctcactaactccaaacccacttgtatgacagactgattccaatcatttctgctcttgttaccgattcttatctgcactttacttaaagccccataattttgaggcatctggacagtaggaaaggctgaaaacctggcaagcttttatagcttgcaaaggtccttgtcctatgctctgttagtatcatttccaaaatactacttgggctatctgatcacatcccattgcccgtatcctctgagagtctaaatgctgaactgcttcagaaactaaatcatactcacaggacttggtttctcagcaattttatcatctgaaaacattgtttatgtagctgaggtcaaaagcttcaagtactgctttaatgagctgcgaatctgttcatgtgacattctcttccaaacccaattgccctttacactgtatgagtaagtgcctctgtgtgtgtgtgtctgaatgtgtgtgtttgatgtgctgacatttctgaattgaatccagaaagtgtaacctttgtatgtttgctgttaaaactccaaattcaagccttaagaaaaggatctaacacttactcaatgtgatttatttaagcacagaacctaactcccccaaagtatcaaatactcaagagaacaattcatttttgaaaattgtgatttaaaataattctcataaaacctttactgttcaaatatattagaaaatatattgcatttttgtctgcatcaggcactgttttaactgccttccatgaattgcctcatttaattctctcaaccctgtaaggtagggttatcaccacagtatagatgaggaactagagcttggaaaagttaaggcatttgcccaaggtccagcaactagaaagcagaggagccaggacttgatccctggactgtacactgcacaagacccttgtaaagattattagaagcacttggagcccctggtaaggtttgtgattgtgctaccaggagagtcatgataacaccatcgaatggtgtctgttacataatagaaaaagactgagtattcttacaattcaaatgatttaaatttattttaaaatattgcaacaaataagtagcatcttcacagcttttataattcgttgtcaggattttaaaagatgcaaatcttatttgttccttagggctttgattttgaggctgacaaagacggcatgcattgactaacctctgaaagaagggcatggcagcattgaaatgaggcagccgagacaggctcattaaggagtagaggtttccctgctcatttctggttgttcttttggggtatccactgtgtggagtttgcagagatcttaataaaaatatcaacctacatttatatactgacaaacaaatagccaagagccatttaggacacacagcttggagtctgtttatctctctccacctatctacacacccatggagaacccatttaaacttcagatcaaaccaggctccctttagatggttggaattgtcaggttcctgagccaggtgaagttcctaaatcagtttctgtcttagtccatgttgtgttgctatgactgaataccacagactagataatttataaagaaaagaaatttatttcttacagttctggaggctgggaagtccaagggtgaggggcttgcatctggtgagagacttcttgctgtgtcatcccatggcagaaggtgaagggcaagagagagtatgcgtgcatgtgtgtgcatatatatgcatatgcatacatgtgtgtgcacatgcaggggaaagatacggagccaaactcatcccttttattaggatcccactaccaagataatgttgttaagttctcatgaggtgccacctctcaacactgttgcattggagattcagtttctaacacatgaactttggcggggcaagtcaaccatagaacctaccagatacatgactttgagtcatgtactattatattattatttattattattattgttattttgatactggtccatggcccagggattggggatccctgccctaaatcgtgaggaagattgaggcccatgggtgccactggttggtagccgtcagcttcttaccacctaccggcacctccatagtcatcttgacctccttgcccagcttccatctctgtcttagcaaatatgttttccctcccccaactcatgtgagacttaccctcactcctgctctggactccagcctcttgatccttcatgcttatctcccctgtttagtctgtctacagcttctctctgtatcaacaaaactcctatggtttcaaataggaatctgatttaaactgacttttaagcaaaaaataatgatagttagtattcagatgtagatggatcatctacatctggtcccaaacaatgccagcagggaaacatttatctatatcccttaggattactttccccactgtgttgacttcattcttcattctcagaaggctttcttgggcacatagcaactcccaatttatgtcccattatctctgcaacttctaccaaagaaaagggcttcctttttataaaatcccagcagcctaggactcaatctttttggaagattattgggtcatatgcccatctctaagggaattgctcactgcaccagggggatggaatgtgctgattgaccgggcctgggtcaccagcccctcttagccagagagctggatctaatccagacattttgaaaaaagagaaggaatgtcctatctaaatcagacattttgaaagaagagaaggaatatctcctttaagaaaaaaaagccactgtcatggccgggtgtggtggctcacgcctataatcccagcactttgggaggctgaggcgggtggatcatgaggtcaggagatcgagaccatcttggctaacacggtgaaaccccatctccactaaaaaatacaaaaaattagctgggcgcggtggcgggcacctgtagtcccagctactcgggaggctgaggcaggagaatggcgtgaacccaggaggcggagcttgcagtgagctgagatagcgccactgcagtccagcctgggcaaaagagcgagactccgtctcaaaaaaaaaaaaaaagaaaaaaagaaaaataaagccactgtcactagaagaaaagacaatgcctgctggctgggcaaaaacagcagctgtcctttctgactctatcctggccttctcctttgtgcataaacctgctatgtctttttcatgttaaaaatcccctacctcaaacctgggaatcctccttactactactcttactactgctatgattactaccctaccttactttgcatacaaacacacttttgaaagagttgccagttcctgctatttccacttgatgacaatttattgtttcctcagtttggtgcaatctggcttctgctcccgccatcctattgatatttttctcattgagtcatcaatgacctgaaaactgcctcttctcataagcttgtctcatctttcttgacctcaccatattattaggtgctctaatcctttctcctttaaaaaaatgtgaaaaaataaaatattcaagcagcatcagaagctacaaagtgaaattaagattcccctcacccatggctcctagctaggcttcctggttctccttcccagagacacccattgcaaccaggttcttgtgtgaccttctagagaagatgtgttcaggcccagaaatagtctacatcacacacaaggatgttagcatgctgtgtacaatttctgtatcttgcattattcccctctgtcttggagattgtttcttatctgcttatctaactctacatcaccctttgaataacttcctagtttcctatataagtgagtttatctgtaggaaaagttcagagtgccttctttctttttaagcccctcttctccttcatttttatgacattgtgtgtctgtcttagtctgttttgtgctgctataagaatacctgaaactggggcctggtgcagtggctcatgcctgtaattccagcactttgggaggttaacatgggcagatcacttgagcttgagcccaggagtttgagaccagcttggggaacatggcaaaatctgtctttacacacacaaaaattacaaaaatcaaccaggtggggtggcacatgcctgtagtcccagctacttgggtgactaaggcaggattgcttgagcctgggaggtcaaggctgcagtgtcgtggtcacagcttgctgcagactcgacctcccaggcttaagcaatcctcctgctcgagtgacagagtgagaccctgtctcaaaaaaaaaaaagtggataacttacaatgaaaagaaatttatttggctcatggttctggagggtgggaagtacaagatcaggggctgtatctggggaggaccttcttgctgcatagtaacctgatagaaggcatcacatggcaagagaacacatgagggagggtaacttactttttaaataaattcactcccacaataataacatcaatccagtcacctccaaaagttcccacctctcaacactgttgcattggggattaagtgtccagcacaagaactttgggagaacacattcaaaccatatcaccacatttgctgatgttcttcctaccttcacagccactcccaatagaaattccaactccacaaagacttccagtgacagttgaatttggagggttgagaccagctcatgacccagaaaggaaaacagaaagcttactttttgttttgttacaagtgcagtctcttaaaaataaccacaaaatgcccccccaaatggcatatggaaaacagcacagagatggtgtgttaatctacctgaaatgtctttctaaggaagtgaggcttggatgggaacggaaatgcatccctttttcttcccagggtacacgtctttttctcacttcctctaactgggagccccagggcctggctttgtcttgtagcttcctgccgtgatgcaccaggctaagtgggaaggtttctgttctatgtctaaagtagcactggcaggtcctcattctgcttgtaattgggatgggaatatgggtaggaatttagggtttggcagagcgtacaggacctctttcaagccagagcacagccctgtcagacttactcactggacatgaatgggtcagtcagccctcagcagtaaccaccagctaccatgttaagtatttgatgtgaattttatcaagtcattctcgccacaccctacaagaaacttgagcttaggggacttagctaacttgcttgaaggttgtatagctgggaattgttggagccaggattggtacccaggttagcttaacttttaagtccgtgccacacaatcagatacatagtatgaggcaatgggatgtaatggaaagcccatgggctttggaattgaacagatgggctctggatcttggctctcctacttgaccctatatgaccctgaacaaactgttaactcttaaaattatctgttaagtagagataatccttttcctgcctatctcacagccttgtgggaatcaaagctataaaaagataggcaaatagaagggataattactatttgagggtgagtttacttgaagccaacaatgtgggtttaggatgaatggtgaagaatagataagaaaaaaaatgatattctgttgacatgggaagatgtttagagtgtatttcatctagtttcttttaaaaagcaagcaaaagaacagagtcatgattccacctttgtctaaaaactaaaaaacatccattcatctattcatccagccatctaggatacaaaccaagatgttaacataatacagagatttggggtggcgggattaagaaggattcttttgtgtgttttaaaattttttatggccaggcacagaggctcatgcctgtaatcctagcactttgggaggccaaggcgtgcagatcacgaggtcaggagttcgagaccagcctagccaacatagtgaaaccccgtctctactaaaaatacaaaaattagctgggcatggtgatgggtgcctgtagtcccagctacttgggaggctgaggcaggagaatcgcttgaacccgggaggtggaggttgcagtgagccgagatcgtgccactgcacaccagcctgggcgacaaagtgagacttcatctcaaaaaaaaaattattattataattccttttttttttttttttttttttagagacagggtcttactctgttacccaggctgaagtgaagtggaacagtcatagctcactgcagcctccagttcctgggctcaagggattccccgtgcctcagcctcttgaacagctgggaccacaggcatgcaccaccatgcctggccaatttttaaaaaattctttgtagagacaggttctctctatgttgcccaggctggtctcaaactcctgatctcaagtgatccttccacctgggcctcccaaagtgctggtattataggcatggcaccaccatgcctggcatcttggtgctttttaatagcttgtttgtttctgcgataaatgtaggagactgatagaagagtctggatctcttgtcaaatctaggatcaaatcgtggtcagatacttaaactaaacccattttctcattgcacagcaaggacttcatagagcttttggggggattaaaggaggtaaagcttgcaaaacacttaacacagtatctggctcatagttagtgcttaacatacactattatttgtccatttgattttttttcatccctgggttctagaaacgcagtggtgaataaaacagatgtgattttgctctcatgtggcttacagtctagatgagaacatagacaatcaacagagaatgaacatgtattaataattatagactgagatataccagattttatttctgttaaagaaatgaacaggatatcttgacagagaataacaggagggaagaatgagaatcctctttatttgaaggtggtctggaacagcttctctgacagggtgccatttaaactgagatctggaggaaatcaaaacactggatgttattttttaatgaaaattaagaaaagcaagagcaaaacaaaacagacttagtatcaaacacaaaagacccctctcctactgacttcctccctaaataaacataagagataaaagatccctgattgtaagggaccttcattattagcagaaaaaggagacttaaatctctctttttttctgccaaaacccagaccacaaatgactttttaaaatgatcaaatatgtatgcagctttgagcatctgattctccctggagtgggtccctcctgtattcggctgtgggaaactggaaggcataggaacgaccctgcatttcactggatgtgcacatgtgaaaaagaaagatgcgcttgtctttttgcctaggctatgtagcttggatgtcttttcatcgtgaccttctggtcttgttaacctgaaggtgtcctggtgtcttgatggaggctgggcaggtagctcccctgagccactagcctcatgttatcaaagtcggctaggcaacagacagcagggaggagccttatcctctcctccaccatcttaccttgtccatgccctctttttacctccatttcttctccaggctctttcctttcctcctccaaagaagcaatgtctctcttgcaggtcccactcaagtgagatgtcactccctccagacagagttcctggcccttcttgggttcctttcctctgtgctcaatggcagcacctgtcccatggtcccatgcagtggcctgtgtgtgcatctgtgtcctctgctagatcttaagctcaacggggacaagaacaggtaccctcttatgtatcgccagagtccagcatgctgctcggcagaggatctacaacagccaaatattagccttccttattatcccttagcaccaaaatacacgtcaaagcagccacttgttttagagtttttttgcttcattttgttttgagacagggtctcactctgtcacccaggctgaagtgcagaggcacgatcatagcttgctgcagtctaaacctcctgggctcaagtaatcctccaacttcagccttccaagtagctgggactacaggcatgtggcgtcatgccctgagaagttttaaatttttgtagagacagggtcttgctatgttgcccaggctggtctcacactcctagcctcaagcgatcctcctgctgccttagagtgttttactaagatgaagcatgttaaagtagcatcaggctaaccttaacaatttacccaaatactcccattctctttatttctatttttcaatttcttccatgataattgctgtctcatttaaaatagctttcacagcttcttttcttattacaaaataataataacaatacctgattgttatgtaaatttttaaaatataatcaagcataaaggggaaaaggaaaaaattaaaaccatctgtaattcttcgaatctccataagcctgtgtataaaatgtgtacagatattacgtatacatttgtgtatataatttatagaatgggaagatattgtacacactgttagtaattatataactatgtcatttaatattcttctacatcttcttttaatttttaagaatgttttgcatggtaatacatcaaatagatgtatcattatttatttaactgttttccctattggcccatagtagattcccaatttttctttcctctgacgattctttgatgaacaccctgtattttgatggggtaaatccaggagtatagaggacaggtcagggaaaacctcgtggaggaagtgacactgctctggagacagaaaggatgcacaggagatagctggatgagtggagaaggagtggaaggcaagtgttcctggcagaggaggcagcctgtgcaagggcctggagtcacctccaagagttcatgagtgttctaggaactggaaatacttcagtatggctggagggtgtctcagggggtgggggacacaggcagggaaggggccattgaccaagtgtccaggaacaggtcctaaatggccccttaagccatgctaaggagtgtgggctttgggcaatggggagctattgcagataagagcagggaaatggcatactccagtcagcgtctttaaaagatccctttagctggccatggtggtgtgcagctgtggtcccaagctactcacaaggccaaggcaagaggatcccttgagccttggaattcaaggtggcagtgagctatgatcacgccactgcaccccaacctgggtaagagagcaagaccttgtctcaaaaaacaaaacaaaacaaaacaaaaaagagatccctgtggcagtggtgaccaagccaactccacattcaacagcaagactctgttattaattcaatgaaacagaaattaaaagagaagagaaaaagaaaaagagcttacgtgtaacaggtcacagataagcttttcaaactgtctagattcttaaattcaggagcgtaattcaacaaatcaaccttcttactcctctccttaatcctgaaagaggtgcttgtggtttaaataacccagttggtttctggcccccattcctgttccaggagccccattgatgtaccctgatgacaagggagtcggattttctttttttttttaagctgagtgaggctgaagtgttcacccaagacaagccagagaggcaggtgcaatccatggtgcgtttttaattagatcccagccactgagctgcccatacttcaaggacacagcaggcaggaaactgatctgggctgtgtctcccaagggctgacgtctccatttagggagcgctcctgaagctaatggtcagtgacagctccatttgaaaaacacagaaacacttaacagggaggctgtgatctgccagccctgtaagctgctgattagcagggaaatcacgctccctctgtatcgcacccccttggttaatccctgttcttgtgtctcctctgtgctatctcacttaaagatttcattgttctctgaggcaggagggagtggggagagggagggggaggttgtggagctgccagaagctgtttcactgtctcccatcacagcctctggggaggcccaggcgaagaaacagccttctggtgtggatgggaaattgatggtttttaaagaaaaatggtccctgaagatgctctgtgtctcagcaaatgtgcttcctagactggctggcttgggttccaacacccaggccaaagaaaaacacgcacgggtctgccttatagtcacaccaggatgccataccagcagtccctgccaccatcacctctttgttgtctgctctgcctcccctttctacagtcctaagccaccattcctctcctgtggatgactgcggcagtctctccccgatgccacggccaccaatctagctccccaaacctctgcaatccccacactgcagctgaggggactccttgacgtgtcctctggaattttgaacttatcaaaaaggaaagcaaatactaaatttcccccctcaaataggatctcctcctcgtgttcctctcttactaaatagctcaggccaaaaatgccagggtcaccaacaatgcctctcttcctcacataccccacacccaatccatcagcaaatcttgtcaactctgaattcagaatataccccacatccgaatgcatctttccatccctccaccaatcaccttccttcaagcccccatcattcttaactggattatcataaccacctcctcactggttgtactgtttccactattgtcccccgctcatttaatctatccttgtacaccacaccagtgatcctgtttaaatgtaaatcagggccagtcttggtggctgacacctggaattccagaactttgggaggctgaggtgggaggatcacttgaggataggagttcgagaccagcctgggcaacatagcaagaccccacacacacaccctgtgtctacaaaaaaaaaaaaattagtcctgcgtggtggtgcacacctgtagtcctagctactcatgaggctaaagtgggaggattgcttgagcccaggagtttgaggctgcagtgagctgtgatcatgcctctgactcaagcatgggcaacagagcaagaccatgtctctaaaacaatgaaatattataaaaacaaaacatacgtcatcatatcattcagggctcaacattctccagcagtttctcatctagctgagatgaaaatccactgtccttacatggccatcaaggaccctgctctggctcgtggcccgctgtgtggccccttggtcactctgctctggccataccatactgacctcattgctgcttggtgactgtgccaggtgagctctgtcttggggcctttgcacttgctgctccctctgcctagcatgcctttcctcccgacatccaaagggcaccctctctcacttcactgaggtcttgctcaaaggccatttcctccaagctgaaaatggcatcactctcactccatcccctggactttcttcttcttttttttttttttgagacagagtctcattctgtcgcccaggctggagtgcagtggcttgatctccgctcactgcaacctctgcctcctgggctcaagtgatccccccaccacagtcctcctgagtagctgggaccacaggtgtgcaccaccacacccagctaatatttgtatttttggtagagacggggtttcaccatgttgcccaggctggtcatgaattcctgagctcaagtgatccaccatcctcggcctctcaaagtgctgggattataggcgtgagctaccctgcccggccttggctttatttttcttcacatcacttatctccctctggcactaaaacatatattcacatttacagttacagtctcgtttgttgcttctcttccccagtaaaatgtaagttccatgaagcatggattttgtatcattttctactagcacagagcctggcatgtagtgggtgctcagtaaatccgtcttgaatgagaaaatgaataaacaaatgaatgaatctggacaacaattctaaccacagtgagtttaccgaggggtcatccttctgtgggagcttccctccactggccagcagaaaagaccccaggtcttcatactatgtcagagagttctcattttctgagacctgaagccaagataacaaaaacagcagaaacaatttagcttggaatgacaaataggtttccttaagtctgacaagagtcttttaaaaattcaagactgtttccttagtatttaaaacttaaacaccatgcaaatgccctattataggaaacatacgctgtctgtctgtagggatttgtagtagaaaatgggaactaaataatacttggagccatgatgcgttgatcacatactcagtacctgttacttgcattctctcattttatcctcatatcacaaccccagtgtgataggaattaaaattgctcccattttacaaaagaggaaactgaaactttaaggaacttgcccagagttgcacagatagtgggtagcataatgccagggtttgaattcagtctacagactcacttttttttttttttttttgcgatggagtttcccttttgttgcccaggctggagtgcaatggtgccatctcagctcactgtaacctctgcctcctgggtttaagtgattctcctgcctcagcctcccgagtagctgggattacaggcacctgacaccacgcctggctaattttttgtatttttagtagagatgggatttcaccatgttggccaggctggtctcgaactcttgatctcaggtgatccacccgcctcggcttcccaaagttcagggattacaggcatgagccaccgcgcccggccccagactcacttttactcagataagaagtgagcaggaggcagaggctcttggagacctaagtcccttgcatgcacagcaaatacttctgcttccctcaacaaaaaggctttgaagaagagcgtgcacctcttgactttctcaatgtaccttcactcctccagcaactgaagttcagtggcagccctccatttctcatcagtatcaccccagttgccaattgcaatgatcctttttcggcaactctcctatttgacctctgaaagatattttagttataccaatgcccttcacctggggtttctcccagtccttagcttggctgatactgttctctcctggttctcctcctgctgtcctaagacactttaaggagcatttttatcatgggcaaatggaaataaaacacctatttcacagagtttttacatgaatgaaaaaggtcatatattcaaaaacacttggcaaatgtctgtttcattgaaagtgctcactggtttttattactcttgttatctctttccactccccatattctgtgctttaaaaaaaaaaaaaaaaaaaaggtttttcaagacctctctcctcctgtgcttttttttccttttttttttttttttttttttttttcctttttggagtcaaggtctcaatcactgcccaggctggagtgcagtggtacaatccctgctcactgcaacctctacctcgctggctcaagcaattctctcacctcagtttcctgagtagctgggactacaggcatgcaccaccatgcccagctaattttttaaagacagggttttgccatgttggtcaggctggtctcaaactcatgacctcaggtgatctgcccacctcggcctcccaaagtgctgggattacaggtgtgaaccaccacgcctggcccagaacctgtgcttctgactccctctggtcatcaccaggactctcattggcctctcaaagtcgttatccaaaatggaattaatcatctttctcagttttcacactttctctgtctcagttcatacaaccacagtctctgtcattcaaaccagagacttcatcatccccatccttgtcttcccgctggccccttccccacttcattagttagtcagccaccaggctgccaccgtacttgtatatttatttatttatttatttatttatttatttatttatttattttgagagagagtctcgctctgtcacccaggctggagtgcagtggcgcgatctcagccgactgcaacctccgcctcccgggttcaagctattctcctgcttcagcctcctgagtagctgggactacaggtgcccatcaccacgcctggctaatttttatatttttagtagagacggggtttcatcatgttggctaggatggtctcgatctcctgactttgtgatccacccgcctcctcctcccaaagtgctgggattacaggcgtgagccactgcgcccagtcactgtacttgtaaaaatggagccaggaacttgggctctgatgtcagatggacctggttcatcttgctctgctattggtttgctgagattatgaacaaattacatagtctccgtggtctcagttccgtcatctataaaatggagatcataataatgcccacttcatagggccattgggaagattaaataaggtaatgcaagtaaagaactttccagtaaacagcattttgcactggtatatagcaaatgcataataaatatcagcagtcataattgttattactcctactactattatactattaggttgtggttacctcgtagagatactgtgttgaaaacacatagagcttttgtgcaaatgggttttgctggcaaagaacaaggaaccccaaattagcggtttgccccttctcattaggtgggaattagcatgtacaggtgtgagcacccatgcatgcatgcacacatttgcagacatgtacatacacatatgtgttataactctgcctcagatgggggcctttttaatatagaaacaccagcaggatgggtgagaaatggcaatggttttctctctagaacctgattgcttcaccaaacaatggtttgtatttcctcccacatccctccttcctaattgaagagggaatggctgaatttacctcctggcaccttgcatttgatgttcagtgactgatccagctaaccaggggcctcgtggttgcccaggcgttgcaagcatcaaacccagatcttcactgggatcttcctccagtggctggagtttataaattgtattctgttgagttggaaaacatccactgctcctgattgagagctggaggacagcactttgaggggtctgctgctataaatactgggatctcccaggtgatgtataaatgggtcactactttgcatcttgcaccacctgaaacatctcaggtgccttaatcccatgttttccaacagatgagcttggctgacttctcggggtgggttggggggacatgccacatgcctctggccccaccatctcatgcctttgccatccatctcctgactggccagaaggacaccaggagcagctcatgagctacaaaaactgaaggtcgggaacccaaggtcgtgcaccaaaggtcatgagaattttgcattttatgttgctctcatttctgatcatttgaaacaacctctctgagtttctgaaagggaagggaatggagaaaagcacacccaattatgctaggttctgttttattttggcttttgtttttgttttttttcccacccaccacaagttcttttcttcccctctcatagtgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaagaaaagaagaagaaatactatttcaaggaaaactgctctttttgagaaacgtggacctaaactacaaagtgggaactgaggagggaactcaggagaaaggaactaactgcggagctttaatcttggccccagtgttcagccactcggaggggcgggggctgtggcccattcaggggctgctggtgggctgtagtggggtgggatgacctggccagagccaacgaggatactggagcccaaagtcaagtttagagaccagctgggaacgtgaatggggctcttgattttcttatcaaaatcaccactcctcccagcttggactaaatattctttctagcaagcagctttgtgagctccctgaagcccaaggaaacccttcggtgggagaaatttcatttctgtctgagaggattaaggcagcaggtgactccccctcctcgcctgccgtgtcctgctattctcaggcagctctaaggagaattcttatcacagttcaagtgatttccagaagttccagggcttctgagagaccatcaagggaactttaacaacttgacaaatgtccttgaagtaagatgcctcatctttagggaaaaatggggtttggatttctgcttaggcaaagtctcctgcagttcatccttctctgtcctcttcttgcttcaggcttggggaccgtccctgctgtccccactgtggtggcaatcaggacctaaggtgaagcaaacttgaagttctatctgacaagtttaggcagtaagagaaggagggaaatcggagcaaagctccctcactttattgttgagaaactggcatctggaaagaggaaggaatttgcccaaagtcagtcagctgggataaaaacctgggtgtcctgtccagaaagtgcagggtgctttctgctctgtagcaaggcagcagacatctctgagccaggcccaccaacaggcccttatctggtggttggatcatgatcccattttgcttggacatgctctcaggaagataaaaaccatggagaaacactaggccattgacaaatgatctgagacaactttagaaaacaatgtaggatgaatggaaagagaaagaaaggaaagaaagaagaaaaagaaagaaggaaagaaagaaagagaaaggaaggaaggaaagaaggaaggaaaagaaggaaggaaggaaggaatatagtgttataaatactgcactcaacattttccaaattcttgccattatttttcaaaagtttaatagtttgcagaaatagatactcaagccaaagtctgttttagagaaactttccatggaaagtcagaatttctaccacttccttttctatccacatttccagtgcagaagaaactgagaaacagagctttttgaagagaggacagggccatagcaacaaggaccttcttgggggattaatgggaggtcagtagaattaataaccctccttggatgagtgctactgttttcacatggcttcagatgctatcaacctcaaagaaatgatctcaacagagaagcttattctctcccaacttctacggtaaaatccaggagtattttctctggggatctgcccacaggacaaagtccataaaagcaagtcctgtctggaccatgtggttatctgaagcattagccatcaccagcacaacaaacggggcagggctttccaaggtggggctggtcagaagggaatctttgataagaggcccacaggcagggaaagcgaaatagggttgatgagaccaggggagacctaaaaaaaaggcagctttgtgtcttctagctccaaatatacctgccttttagctcacacactgtcctggagttctcagacctttaggggccctaacacagttcagttcatacaggggttcaaaagggacagtggcccatttgggagacctttaggatcaatgggaatcaattccattgttttgcctcagagtaaagtttctggctcggggacaattataagttgcaaaaaggatagaggcatatcccaagtcttccttcattccacaaataattacaaacaacctactgtgtgccaggcactattcttagcactggaaatacactagtgaagaagcagatgaggaccctgtttattgtttctctccaagaaattctccaagaatattgtttcttggagagaaataataaataaacaagacaatttctgaaagcaataagtgcaatcaagataattaaaggatgctaaagtgtgacttgtggggattgggagagagatgcacagacaatattaaagaggaggcattcgagctttgttgtgaacaccggaagtaacatgccgagcgcctgggggatggaaactcctatagcaccccacaggctaacagcaagcaggacaagacaaaaagggcaggtgggacatggtagagatggaccctacccaggaaacagctccatcagcatcttagcctgccccactctagccacacatacccacgtgtgctcctgagttcagtgtgcccacctcactcccacaccctcacatagacttggcaagagtaaggagggaactccatagagacattttacctatctcaggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgtgatgaggcctacatagcagcgatgtggtcaggtaaaaatcaggaacccactgaaatcttgggcaagccaccctgcctgcttgtgcctcggttctctcatatgtcatatataggaggtgaggactccagctccacctgccccaggtgggtgtggtgatgatgaggaaagacaagaggcttgcaaggaccctgaagaggtcggagcatcatacagattcctttattagcccacattctgatgttccctggtgagacttgccccaagcaattgctagtaaatgggggttaatttcttctccacctccctactgaacaaaaaaagaaatgccagacttactaggagaatcgagttgctttgagtttcttttgttttgttttgttttgttttgttttaaggctccccttacacaccctcctttaagctttgggttttctctcttatagtttgttgacacatgctaaaaatgtctttggagagaacttctgcctgataaacacccaattctagactgtgggtggattttcgagctgacggtggtcaattcctttcattaagcagtgatctgatttctccacatggccattctgccttcttgggggcagagtagatgggcagcagttcaccttttcagagaaagaggtcttctagccacctgggctgctactgaatggttttctccaggacgctctacctaatgattatttctataacattaagcatggtaataagtagcttccaattcaattcatcctaaagccaaagaaaatacagcaacacacacacacacacacacacacacacacacacacacacacacacaccactttatggcaattcttaactgacattcaatgacttacttcttttcttagaaaatttccaccacatttctatccccaagccaacatacaatgtgaaatgaaagccagtgcgtggagtgcagctgctaaaaattttcagcacagggctctttctgactctgctcatgagatggtatcagccacccaatgactggcgtatcttggtcctgtgtctttcttcttacgctgtgttaatgtgtttactttccatttggcagagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttttctttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagctttgcagttactgtgaactattgtctcttggaggaagttttttgtttaagaattgatatgattaaactgaattaatatatgcaa

SEQ ID NO: 1385 - DNA, 384633 bp, Homo sapiens; identical to SEQ ID NO: 1384
